United States Patent 11,180,807 (METHODS FOR DETECTING A GENETIC VARIATION IN ATTRACTIN-LIKE 1 (ATRNL1) GENE IN SUBJECT WITH PARKINSON'S DISEASE) - sequence listing, part 40

SEQ ID NO: 594 - DNA, 736980 bp, Homo sapiens
ggggtagaagcggcagagaccgcatattccggaggggctggctccaggccacgcgagccggagctggagacatttccagagccttgaggatggcaccggccctcgcacgctcaactcctgctcctcctcttcgcaatgagtaaacgacgcagtaggtcctacccagcctattttgctttaccaaagggctttgctttcttagggatgctgtctttggatcttttttttccctgttgtgttgcgttggttttaagtgcctgctggtgtcgtcttccaggggatggggaaatagtttcttataagatgatcacttgggtttaatgttgaggacgacgctgttagtttgcagtaatgaccctacacctctaaggtattaaaaaaatgccttttatttaaattttgttaaaggggcagagttttccctctttttaaccacctgatactggctctaaaggttttcccctgagaactgtgtacagggcaggagtgaggggttggtgatagaggtgatgatttcgtgtgttggtagcactgacgtattcaatgttgaatgtattctatgatattttatgattatcctgttacatgttttcagtataatttagcattacttttcagagacgtaccagttggcaataaaaagccttttctgtatttaacactgtgaccgaatctgctggaaatttttctgtccaaataaatttcctgaaggcatacatcttaaaatctggagagtcaccattatttaaatactttgattttgaagctttgattttcttaccttttccccccttaaatgaaaagcttagctttaaattaccatgtgtatatactttgaattctgtaaaataaacataaagcaaatgaaacaacaactttttacctctcagatgaagttttcttctaggtaactacagaaataaaaactgactgcaacatacagaggggcccatgacaaaggggtttataacatacactggctttttcaagcaaatatttcactgtctgtaacctcagtttgtggaatgaaaggttttacgccttagtttttactctttgtggtcaaaaagtaaggcgtgcaatgggccatttaactgtagaagattaaaagttagtgtaatatctggaaagttgtatatattttttattcacaactcatgcaagtatctcaaaagtctttggacatttcattgtatttcctggcggggaaatacaatgtatgtgagttattttgttctccgagtagcttttctctgtgaaggaaatcctgttgcatttatataaagaagatagtttatgtcactgtctgtggacaccatatttgatatcttgaggtgtatagttctaagatttgaagccaatatgatggcactaagcctgaaattaggattttcttattttgtatagtgagctaattactaaaatacagtctttcatatgcctcaaacagctaacataaaacattaaaaaagccacttgcaacattctgtgattttaaaaatcatttcaattataacaatgtatgtacatagaaatgctcatttattaaaatgcaagacaatttatgtgtataatatatttttgtatgttttatgtattgtaagtcgtttagttcttttaagagagagagagacagagcaagcaagcaagaacttgaatgatcgaacctgcattttcattaagagaatcagttgctgccctaaggttgaggtagtatgtggtttaagattgggcaaagcactagctgtactgtgtgatatttcccaatgagattgaaacaattaatgggaccaaagacgattttaatgtgaggacagagaggtagttgtgctttaatttctgtaacttaagatcattctaagaacctttagttatctatgttttcatttatttaagattcatttttaattatattgtagacttgtattacatttctatctattacattcaaatttttcagatttcttcctgtgtgaatcattctgggaattctacaactcttaaactggccacctgtttagtttttgatttaaaattgttgaaggtagtatcctagatttagcaccgcctactggcttctcatggaaaaaatgtattttttcattcgccaagcgacccacagggatttagatcaatttaattgtgcagatcttttcaactgcttactaagcgagaaggagggaaaaaaaagtttctattttgtaatgagagagggtttccaaggtaaaggtggggactgagggaaataagacccacaaattaaattggcattggatcactatctgacctcaaacattgtactatctaaactgtgacaaagaaataatcacaaaatgaaaacctgttaaattttcaagaactttttatgggataataaaatgtgggtattgtttaaaatcttggattactaaattaatttttcaatgtctatctcagtcttgatataaagaaagaaagttctagttggaattctgtcttgagtgtgtggtctgttgaagaatatttaaatgaataacttttcatcattgaagattaacagttaattatttttcatatttattttttatggtcataatcaagtaacaccctgatttttttcttaacatgcatcaaatagccacaccgtggtggtgtatatacaagggggaaaagttccaaacataaaattataaagacacatccttagccataatagatgtgttacctttcttaaaaatgataattggtttattttctctaatttatatgaaagtctagtggttaaaagagctactataataatacaaataaatgatgccttaagaatatacaaattgttaattagaaaaataatttgatatgctaaaattttcttcctaattaaaagaaatgtgaaatatttggatagctgttccttaaatgcaatattgacttattttaagagccagtagtaagtatatagaaattccagtgagaagtataggtctgttgcgtttttgcaactctaccccagtaaaagtgtggtcatgttttgtttactgtttactgatagtgtaagcaactaattaagcagggcattcattgatataactctacatttcaagtcttcaaaaagctccattatggaagtagaagagaagtgaagtgggtatgtaagattgtttgaatagtaaggacgaatttgagaaaaatatttcaattacaattgatttttctctctgacttttgaaacttttatttttattttagttgtttatttttattttttctttccaacttttagtttcaaggggtacatgtacagttttgttacatggctaaattacatgtcacaggggtttgctgtacagatagttttatcggccatgaaatctttatttttaaatgatgattagctgagactttaaaaatagttatttctttacttcttttatcatactgtcattatgaaaactctgtgttttgctatgaaaacctgaagtaatgattaattttattcttcaaatttttatggacttccagaaagtaaataataacatgtttaaaaaggtccttattgatctgcagttattgttattattctcttattactgttactatctactacttccagtgacctgtacgaatgcttgtaaagatgccatttccataattcagtttgattctttgatttaataaatttctcttcagtaattggcaggcaacataaactttcattttattggcaataacaacagtttgttttgctaaatcatgattttgaaaacaatattcaataacatgtaagtaatatctgatttctgaatgtatcaatagcaagttacactgttaacaagtttacataattatacttgtcatcacccttccttttattattaaattttgatgtgcagactgcatagatataacacagctattgccaactttagtagttttgcttatcctcattgcttttagattttcaataatacattgggaattttgttttcttttgttagacttatgttaaatatcaaacttaccttgtggaaaattaactttgtgtttttctaaattcttccttacgtttaaaaagatttttgtttgctagttttgaattatcctgctatttttctgggactgagtcctggaaaatagaggcattggtttaatgtctttttctatccatttgtagccacagagatggcagttggaggacttgagttagtatttaggatttacattttctgggctgtccttgcagactcctcagctgggggtcaagactctaagagttatttatttgaccatgtaaaaatctaaatagagaggaaaattatggagtagaacgtggaagtcttgcactggtcttctgaaagatacaatagcatgcatcactaagtgctcttatattacaaaatactagagattttctgtgcataaatatgtttggcaaaattccatttaactcactaatatgctttttgcttgaattctttcccaaacttcagagtgggaattgattgcattcatacataatccatgtgtttagagaaaatgtttatacacattttgatagccatatgctaaataataagaggagcaacacatttctgagtcatttcggaaattattaacaggtgggagtaaggaacggctattttttcattaaatcaagatgagagggaaagaaattgatgtgtcaaatgaatgcaattccatttgtacttcccttccgtgattagataatagtattattttatatgttggaggaaactgagacttggagctcagagctccataggtggtaaagggaaatttgacatgtaggaagtcttaactgacgactcatgttttttttttttttcctacacagatatgcttcatttgtggagatgatttttttgtttcttttgtttttcctaatataaaacaactgttatgtatttattcttgatacattacttaagatgtctgtagtttggcaagttttcaacagggagtgctttccactagtgagtgctttgagcagaaacaaaagaatattgccccacacagatactcttaactggtcctgaaaggacctttctgtgaccatgtcatcacacatctcttcaagacgggttttctgaagagagccaatgcatggcatcacatttgtgagttaccactgttgctctgtggttgggtcagaagagacggttctctgtccttagttgctttgcagagagcctgggaaacacattcagcatttacttactgagtacaaaatgtaatctctactcttggagcttttgcagtgtgatgtggaaaattagtcttttgtgcaaggaaagctgaacagctaattctttcataacacagagctctgtaaatataggtgtcttgtctgtctaccaacatctcaccatcaacatcataacacctcacaattttactgttacacatatttgtatgtgacatttatcaagctcattttatgttagtaacataaaacacatataagtgtaacatattatttgaggattctgtgtttaattgcctcttcagatgtgcaagaatgtcttccatcattagtttccttggaacttgaaaaagtgaatactttcaatgcagaatgggaaacataaactatagtggaaacagtgtgaatgcacatgatgagatggatttttaaagacttggtcataagtcctcacgttcataaaatcagtggatttagaggtcaaagtatagggagggttaaatgctgcctttgaattttggaatctggatatcttgaaaacaggtggtataaaacaaaacaagagaaagtagtatctgtaggagagccttatttggttggaggtgggaaaatgattcaattttgaacatagtaatttgaagttctgacattaacttctggattaaatgaccaatgtgcaatggaaattcaggtctagagctgggaagcacacttaaggctagaaggagatatgacagtatcatctacattaaaactctttaagtgggaataagtcctgcacaggtagaaatttgggaacatctgcttttttttttgagtgaatgtaaaaggggctgataaagggcagaaaaatagagttaggatgatagccactgaagctcagaaaaagtatgtggggtgtgtgtgtgtgtatgtaagtattgttcaacagagctaatgctgcataggctcaaaagaagataagacctgagataaaagctttgtaatctgtcattaaaatccatgaatttttgaaataaactaaatgaatgtgattgatgatcctcaatatgatgtggcagcgtcataaagagggctgttgttcccaggattgtatgtgtcgtgtgtgtgtgtgattgtgtgtgtgtgtgtgtgtgtgtgtgtgtgtacagtgataacatgatctaaataggaagaccagtaggaagtttttcctgaaactagctaaattgatttgaaatttatatttatatgcaaaaatagcagagaatattctgagaaagaagagagggctaacctgttacataataaaatacactataaagctttaaaaataaatatatttactagctatgtctactgaaaaatcttcaaagcaatgtctttcaggaagcaatgagcccttctagtgcacaaagcatggcttcttaatatcattccccattcaagaggacaagagccctttagtcttccttaacctagaattggctgattctaagtctgggcagaaaaaacacaagatgagcctgggacaactcactgcagaaagtaaggaaatggtcaaagacaaataaggctgtatcattgtaaacaagtgctagcttgaagggccttccagttgtgcaatttaaatcagtttgaatttcaagagtgaatataacaaattgtaaacgttgagtaaagtaaaatccatgagtgcataatgatactctaaataaatatataaaaaagaaaaatgacaattaataattaaattgagataattaaatgattagcctgcctttcttagttgatgagggacagctttttacaaaataatgtgaattaagtgtaagaaatgtaagaattagaaaattactatttgtaactctcagtgaagtaagtgattcagtcaaagatgatcaacaagtgataaaataatcaattaaaattattttgatgaataacatattctcatagtgctcaagtattaattgcatctgcaagtcatcgttttaagtgactgaatgatttaacccaacatcaccaatagacaacctgacactatgagcctcctgacgagatgccatataaaggctatagtgccatttgtgaaatattgttgctagaatgtctaacctgaatctaataaaacctggttagatttaacttccagtttatagaaaaattcagagaaaggaccagttaaactaaaccatgaggaaataatgagacaaatgcataaggtgaggtattccacattgaagatacataccagccctgtggcctagacttgtaaaatgtcagtgccactgtgggaggacttttccagattaaaaaggactaaagacaaacaaatgcagtgcttgaagatttattttatttcactttttaaaaatgtggtctataaaaagtcaaattttggtagaattgggaaatttttcatatgggctagaaaacagatgatattagcagatgagtgctgaattatttgggataaatgcagtgatacatgaaactgaattttctttttttttttctttctttttttgagacaaagtcttgctctgttgcctaggctagagtgcagtgacacgatttcggctcactgcaacctccgcttaccatgttcaagcaattccccttcctcagcctcctgaatagctaagattacaggcgtgtgccaacatgcccagttattttttgtatatttagtagagacagagtttcaccatgttgaccaggctggtcttgagctcctgacctcgtgatctgcctgccttggcctcccaaactgctggaatcaccgtgcccagcccgcaactgaatttcttatgagtcatcaaaggagtgagggagggagtgtgtgtgtgtgtgtgtgtgggggggggggttgtgtacgtgtatatgtaaaataatcatttgttaaccaactttaaatcagggagtgcttatgctggttttattgtgttattctttctagtattccatctatttgaattttttttcgtaaggaaagttgaatagtctattagttgccattgagaaaaaaatatgtttattgaggctaaatagaagcagaagtccaattgcccatgtttaaggtcatctgggatcttgaagatatggagacaaaaaaaatgaagtttaatgttaaattgtgggaatgaaatattactcatcgaagtaatattattgaaggaaggatatttttaaagccacagtaaggaaaatatgaatgcatctttatgtttttcaggatggaatccccttgcaggaagaggtggaggtataatagaaaggaaaataatttttcagggtcaatttcagaatgttctaagaaggttggtgtgattagtagtagcgcaaggagatgctggttacgtctcagaagaggaagagaattgaatcagttcattagttaaactaagtaactcattatttatttaacagatatttcttgagcattttctttgtaagtactgtgctggaggatgaggattctgtggtaaataaaactgataacaatgctgactgcaaagagtttgccatttaatggtgacttcagtcttctcagataattgtaaatgaggtcctaggttgaaattaactggtatggagataggagctaggggagtgtagtagggaataagcatgaaatatagaaagattctagagctgtaatgaggaacttggcaaaattagcatttgttgtcactttagtcaacacagttacatcacttctctaggaacacttagcctgtaatctgaatgggttaaggaaacagttgaggattacttggttagagactagaaaggcatccactttgtgtaaaacaaagtgaggagctttccagaggtagtggatatgaagatataaataaatctgggctgagaaagagagcaagggcagctctacgagatgaacagaataagaactggtaagatttgaaagcctgaagagcaggatgaaaatgaatagcagactcactaattttaatagaatgagagtagtgcaaggatggataggtttggtcagaaaagactattgtatttctagcgtttgacagtggaacatcgtcaaatggtgaataaattttagagtatggtaaagcatgtggctaagaaaggaagacactgctgattttgagaagttaagatattgtgaggtgaagctgagtattaaaagtgtaattttgaaaacgtgatttaaaaaacctgtaacaggatgacaagtgaggaggtggaaaggaaaactataaatgtatcaaaagtatcagtgatatttttagagctttacaatcaactaagaccaaaacagatttttttttttcatttgtgacttctaggactttagtcctttctttggaacattttgaaggaagctatagatatgtaatgtgtttgtgtatcttgcttacatttgaaaagaattttcagttactacagaaataaattctgcagtggatacagcaatgcaaccctttgtaaggaagtctcttttcaaaaccaaggaaatgaatataggatcctataattaagtataacagtgaatgattcagattgaaaagaaagctatggagtatttgttaatacatttttattaacatcagaagtccagatagcaggtatatagctatatttactgctagttctgttgctgctgctctgttgagatctcattctatttatgaatcaacattctggaccagactgactgagaaatgcttagtcagatagagcctcatctttgcaacactaggagagtatattaccatagataataatatttaggagaaaagagaggatcagacagttgacttgttaaatgtcttcttgctattaaatggctgagtaaagatctgaacccaggagtttttggcttcacaacttgaatgtggactactgtattttgttcaacagatggaaaaaaggagatactttgattggtacagcaataggtcagcaacatttgtccaataaaatagacacgctcacataattaatgccctcacaatagctccctctgcacagcatgttaaaaacacacaatgcttacatttagaactgtagtgcaattgattctgattctagcccctcttttcagagtcttccataatgtctcttctgtgggcataatgggtgagaatttcaacaattgtttgtatatttagacaatatttgtcggggatctattatatgtaagtcactgtatttgggtcaacatggtgtgaaaccccatccatctctactaaaaatacaaaaattagctgggtgtggtggcatgcgcctgtagtcccagctactcaggaggctaaggaaggagaattgtttgaacctgggaggcagaggttgcagtgagccaagatcgcaccattgcactccagcccagcgacagagcgagactccatctcaaaaaaataaaaacataagtttttaaaaatcagaaaacattggtcttaccctcctgaatagacagttttcaggaaaaggaaatgctttatgtgaaaagtgacaatgcataaagttatgactattaagaaaagtaaagatgattgcttgtagttctttgggttattaaggcacttgaacaaactagcatgcaatttctttctcccctttctagtgacttggtgagtcctcaggttgggagattatgtattactctcgttccattgtattccaaagccaggaatgtatgacagtgtagagaagaggtgtgtagacaaaaaagtaaagggggccaagtgagaggaacaacagcaacaaaaagatttagagcaaattgtctggaaaaaaaactggaagatgaaagtaaatggtgaaattttgaggaaaataggagagagtcagggtagaggtacaattaacatgagtttgcacctttgtatttatccttattttatgctttaatatgaagtctattgttcaggagagtgaagtttatcctggaatatattgagattactcaaaacttcaaataaacttattagaaactgttaagtactataaaatatataaaatgaatttagaaaatatctatgcttttagattttttacaatggctctaatgatatagctttattgataatttaaagtagattagtgaaccaatagtatgaaaatattttgttttattctgaacccatttcatcatgtatgcaatctttttatttcataattgctggatctttttccctgttctagtcctcccactggacagtggtacaacttaaaagaaaaagggaagcgtggaagaggggagaaaggaaatggaagagaaagaaggaggtcaacaatagccatgaacaagctttctctagatcactgttcaaaagaaacgatgcaagtcatgcaagccagccacatatgtaactgtaaattttctaaaagacatattaaaaaagttaaaaagtgaaacagctgaaattaattttcataaagattttatgtagctcagtgtatcaaaaattattttaacatgtaaccaatataaaattacttttaaaatattctgttttttgtgctaagtctttgatatctagtttgtattgtatacttaacagcacagaacagccacatttcaggagctcacaggccagtggctatcacatagaacagtgcaaatatagagtgttcatagaggcttcagggctatgtcatgttttcaaactccttttggcatttgttccttatcggagattatccaagatagattttttaaatactctctgatcatttcaatttcagctttcactttttattaaatcctaaatagaaatccattgaagttcatatttgccaaaaagttatcccaaaatatggtcccattgactaagaaatattaaatttatcttgatacttattgttcttcaggagcaagatggccacttttactaaatttgctctttcagtctactcatttgttatttggccctggaggtaaggaaataatgcaattgtcagaaattggtaacatcttcataggataggcttctatattagtggtatttgcctaacacctaatttaatgagaactatccatggccttgcagagaatcactcattattttaaaaacagaatgatatacttaacatgtaaatttgctaacagatttaacaccaattgaataccaacttagtttcagaagttatttgaaaacataatagaaaatcctgtatctagttatctgtttcctgcattttcgaagtccataaatgtggaaaatcaagaggcttatatactgtgaaaccccgcaatctacacagcctcattttcttccccacattcttttcttcttatcagaccagtttcttctgagtctcacatgttttctaatatggagttaaagacatgtttacccatttttaggtcctgactttcatacaaagaagataatcctacaacttctaaccttccatttttacatcctatttacatttttgagatgaatggtgataataaagatattaacaaccaccaaaacaaccaacacttatttagtatttagcatgtatcaggtgttgtcctccaaaccattgctttatttttctacttccccttgatctccatccattgagctccagaagatgagactatctaagtatgaaacttattttggggccgggcgcggtggctcacgcctgtaatccgagctctcagggaggcaagaggcgggaggatagcttgagcccaggagttcgagactgcctgggcaatatagcgagaccccattctccagaaaaaggaaaaaaaaaaaaagacaaaaaaaataagcgaaacttattttggattatttatcaatacctgaaattttatttcactcttttttgtttgtttgttttcttgtttgatgccttcttctcccattaggcgatagctttatgacaatacagtttatcttaatgatgatttccagtacctagacagtacctggcacacaggaagcactcaataaacctttttgaattaattaattagtgaagtagttcctcactgatgttttactgcacttgaactcttttctagatattttcaatatctatgtacacactctttagtaggatgtaggtagaaactgaaaagaaaagatttttgaggaactttcactacaattcatgacaattatctctaaaaatgtgaaaaggaaaacataatttctccagcatgaaggagaaaggacgtaactgctaagagcatatgtgtactgaaatgataatttgtcttaacagttattctacatttgtagagggctttatcattcaaacatattcatatacattttaattttattctcactgcttcatttctgaatgttgaaatttatttgtatttatttattaattttttattttgtgggtacatgataggtgtatctatttatgaggtccatgagatgttttgatacaggccggcaatgcataacaatcacatcatggaaaatgtgatatccatcccctcaagcatttaccctttgtgttacaaacaatccaatgataccctttggcattatttaaacatgtgcaattaaattattattgattatagtcaccttgttgtgctatcaaatactaggtcttattcagtcattccattttttgtacctattaatcatccccacctccctgccacccttcccagcctttagtaatcatgcttccactccctatctccatgagtttggggacgtttggatccccagaataagtaagaatatgcaacattgatctttctgtgcctatcttacttcgtttaacataatggcctccagttccatccatgttgttgcaaatgacaggaactcattcttttctgtgtctgaatagtactccattgtgaagtagatagtatgttttctttatccatttatctgttgatggacactttggttgcttccaaatcttggctgttgtgaacagtgctgcaacataggagtgcagctatctctttgatatactaatcttctttcttttgggtatatactccagagtgggatttcgggattatgtggtagctttgtttttagtttttttgaggaacctccaaaccgttttccatagtggttgtactaatttacattcccaccaacagtatacaagggttcccttttctccatatcctcgccaacatttgttattgcctggcttttggatgtaagtcattttacctgggatgagatgatatctcattgtcttttcgatgtgcatttctctgtgcattactctgatgatcggtgatgatcggtgaccttttcatatgcctgttttcttcttttgagaaatgtctattcaaatattttgtccattttaaaaatcagattattagattccttcctatagagttgtttgagctccttataaattctggttattaatcttttgtcagatgggcaatttgcaattttcttccaatctatgagttgtctcctcactttgttgattgtttcctttgctatgcagaagctttttaacttgatgtgatcccatttgtccatttttgctttaatttgttatgctcgtaggatattactcaataattttttgcccagaccaatgtcctggagagtttccccaatactttgttgtagtagtttcatagtttgaggtcttagatttaagcctgtaatccatattcatttgatttttgtatatggcatgagatggttgtctagtttcattcttctgcatatgggtatccagttttcccagcaccatttattaaagaaactgtcttttccccaatgcatgttcttggcacctttgtcgaaaatgcgttcactctaggtgtgtgaatttatttctgagttctctatgctgttccaaatgttgaaatttaatctcagaggtgaagtgactcagtctgcttacctagtaaatgtcatggaaagaacttatctctgccaattgcattggaaggtaatagtgtagcctgggagttctgtagatcctctaatttaattttagtcagctatttggaatagtttgaaaatcccagtacttattatgtaattttgggtgcttcttattacatttatgataagcaattcaaaatattatatattcttatgattcaacctgaaaccaaagttttctgcttttactcgtttgagcttctgtaacagtattagtgtagcatgagattctaatggttatcatgaacagttaaactgttaccatttacaaatacttaattatattgataagaattttcgaaatacagtacactaaacaaaataaatacattggatgctgagactgatataggatagcagtgatgatcagtggactccagatacaaagctttgtgttcatcaaagcaaacgtcatttcaggtattgattaactttaaaatagagtttcacaaatgtaaattaaaaagtaattttaagatagaagttactacttatatctaatttaggatattttatatagattttcattaaaaggaagtgtcctaagactaaatacattttaaaatcatttccttcatgcagtttttgctaagaattttaactatttgcaaataagagtatcttaaaataattttaactgttaactaaaccacaacagttttgacatttgttgcttgaaaagtgtagatacttttctatctatattaattaaagcttgaacaaataggattaatatttatttaaaagatgatcttggtgatgtattttaacagtttcttgggctattttgcaaatagtttgtgagtgtaaaattaaaaggcttgaaaatgcattcctacttttaatggggggatgggatgacaattgtgtttttaaggttgaataatcactggtttatggcacttaactcttttactagttcacaaactatgagtatattgtttacattaatttaagcaatgcattatgttcacattatttcatgaatgttttagtgtagttatccaacaaatatttcatgaaaattcatttttttatccttctgtgtgtcacaaggcattatataatgtataagaatggagcttacagtgcagaaggagctgatggtgataaatttcacaagtaaaaataaagttcagggttaagatagtatcttattctctattaaatcagaggattaaccttcctatgcatttccagctacaaaatgtgacccatgatgaggtgagtgaagtcaaatcagcttttcaagactatatgtaaaataacatgaatagaaagaaatacttcaaatttatagaatgttaatctgtatagtctttgaggttaaattgatttagtatctttgactaaaacttatgaatcagtgagaatttgatggggaaatatgagcatgtaatttcgatccatcatctatctttatttgttggtttagagctaagcatatgtcagtattcccagtataggtctttcaaggtatgtctctgtatgtaagggtaatataaccttgtgagtatgagtatgagtgtgagtgtgtgtggagaaatcaattgcttattaatagctttaggaaatggtattagttatttagttgcctaattgggggagtagttttcattcattttgcttttcttttttttttttcaagacagagtctcactgtcatccagtctggagtgcagtgtggcatgatcatggctcattgtaatcttgaactcctgagcataagggatcctcttgctttagcctctctagtagctggggctgcaggtgtgtgccaccatgaccagctgattttttatcttattttttgtagagacagagtttcactatgttgctcaggttagtctcgaactcctgacctcaagcgattctcccacctcagcctcccaaagcactggtataaaaagtgtgaaccactgttcgcagctagcatatttatttgatactatgtctctttgtccctaaaagataaatgatatgtattacatttaagtaaattatattatgtcatagatttcctttttttatatccaaccctcacaacaggtgttaggattttaatggttatacagcattccattgtaataatgtactttgtcatgccccattgtgaatattttagttggttcttttttcactttcttttcattgctattttgaataatgagtatttccatacactttttgtggttattttactgtaatattgcagttttgtatgcacttttattttatatgaatttatagacttaatttatatttttggtttaaaaaaaaaaaataaagcctagctcttcacctagtcttcatctaaaggactttaccttcttacctaacactggtagagaaactggctgggttagatttacttaaagatgatataaaacatataaaatcatgtataagtattatatgatctattgaagggattttttttttttttttttttttttgagacaagtcttgctctgtcgcctaggctggagtgtagcggtgcaatcttggctcactgcaacctccgcctcccgggttcaagcaattctctgcctcagcctcccgagtggctgggattacaggtgcccaccaccacgcccagctaatttttttgtatttttagtagagacggggtttcactatcttggccaggctggtcttgaattcctgactttgtgatccacccaccttggcctcccaaagtgctgggattacaggcgtgagccaccgtgcccagccctgaagggatttttagaagtaatttttatgtatctttcatggtgactttagactctaaccactaggaattatgctacaaaattgcattttgtacagtattttcctggtgtaggcatgacattttgaacatttactttaaaaacttgctaaatgtattttttcattaaatttaaaatactataatgatttcttaatattttcagtacgtacatgtatattagcttttgagtacaaatagtaacacatttttagtaatttatcattcataggtgaaaattgcttgaaacccataacataaaaacagaattacacaggaacggagtagagagatcagtccctcatgtagttgtaaattatttctagccacacaacaaaagaatgttagttattcgcaaaggaaaaagaatggaaatgagaactgtgcttatgacattatcactcaagtggtttgggtttcttacttaccataaggagagtgtttgataatgtggagcctttctagggaaaaggagatgtaaagtacattctccttttgagtcctgcagagttgccaggatgactagtttgttgaaaagaaccatttggtgtccttccttcttttctttctttcttttttttttttcttctcacttgagtgaatcactatagaattctggaaagtacaggaagaaaatgataaattttcccagcagatttttctaaactaatcttaatggaacttttcaagtgcttttatttaatttacccatgtgttaagtggggtgttctcccatcatgttgttcatagtgatagtaaaaagtggtgctgcttaaaatatattctgtagcctgttggtttctgttctgaaacaagaattgagatttccacaacaattttacagaataatttcatgtttcattatatgtctttgtgttttctccctcacttttctagtaatatattttcattgtattctgtaaaatactggtttgtggttgattggaaatggaaaatgagcttctcaagtgcaatatagatagcttgagaagttcaggtacagaacacacactgcatttacacagttttagtttttcctagattatatgcttcttaaagataggtattgtgaaattcagtcatttatttattctcatattctggcattcattcaataatgctattgacatagtgttagtcactgatgccctggatgaaaaaaacatcatcccattctcaatggactcaaaatatccagagagtatctcactatgatactctcttatagtgcttatagattaagtaaacattcctggaattgaatgtacttctttaaatgtatgtgtgtgtgtgtatgtgtaatgtatatcatatatactcagtgtataagtttttttgttttttaagcccgtggcattctgtgtaaattgcctaaatttcaaagttaatcatcacatataaataatactgaattattcctatagtttaagaattctgaataagaacacagaaatatcatgtagagattgatagtctcagtagtttacccaaaagatctgaataaatattggaatgatcttttaacaggttgactctagctcagaaaaaaaaaatgagaggaagagcaccacaaaaatatatctttttatcattggattaaaatatctagaaaaacactgataaataaaatctataaataatattctgccgttgtcttaaaatttaaaaaatggggaataaggtattttttctttcttacaaagactacacatattttgacccaatctgtttcatgttgaatggaaacaaacttgcatcataactgtgcatgtcattactgcctgctggttctaccagtatgcttttgcatattcttgatgaacaacaatattacctaaatcaagtcaccctgctttgtgttcatctgtttggtttttcttgttgttgtttctacaaaaatgttgtctcaccatactatgttccccaaagtactgctgtgatactttgctcctttctaatatttggtgaattcctaaatgtatctactttgtgcatgccatatgttcaactgctgtctccaatttcattataaagcttatgtatttatataatcattccaaaaataattcactctgaagacataatttcagtaagcagagagtgttcagcattactaagttaaataatatataacacttatttgaattcttactgtgggctaggcatacaaagtatgtgtattttttctcaaacagtcctcagagctttattgtttttattcctattttatagatgataaactggaggctcactgggcctatgcttcttgcccaggatgacagggctagtaactagcagagctaaaacttaagcccaggtctgattctgaaatcttctaactctgacccactagattattctcatctcattttatatgctaggttaactaggatttgattatttacaaatatggccctttcgttttatatacattgttatattttctgcctaataaaacatatgttgttacttccaaatatcttcaaaacccatggccacaggtactgttctcgatatgcaattactgaatatttacaaatgtggctccagtcagctaaagagaaaaatgtaatgatttccagggtccacccctctaatagctgttgtctttagtttttcaaggtcaaataaatgaatcgtgatgaggaaggccacgtgtctagaaaccaactgcatgaaacccttttctgttcaggatttaagcagtgatctatttaagtttgaattagacaggattccaaaaggtattataacctgaaaatattacacagcccccctctaacacatataccacatatgcaaagggaaagccactgtagctattttactcggaagttttatcttttcaatattctttgacttctaatgcaagtatgttacttgaaggaataaatatagtgtatatttgggtctgaatattagcactagttatcaataaagagcacaagtgggaaatccatgatgtcaagtaatctatctttgtaaatctaccttaacaacctagtctgagaaggtgataaaagtagcatcataaattcccatcagtttagcaaataaatgctgaacattgtgttagtttactagggcttccataacaaagtagcagagactgggtggtttaaacagcagaaccttaactttctcatagttctggaggctggatggccaagatcaaggtgttgccaggtttgattcttctgaggcctgtctccttggcttgcagatggccacatttttgttgtgtcctcacttggcctttcctgtgggtgcatgcctccctgttttctcaatctcctcttcttaacatatgtgtacaccagtcttattggattaaggcccacccataagacctcattttacttttattacctctttaaaggccctttctccaaatgcagacatattctggagtactgagggttaggacttcaacacatgacctttgtaggggatacaattcagttcataacatgtatgaattattcttctaagcactgtgggaaatactaagagtatagatcacagttctggttttcaagtagtttaccattctatgtgggaccaagtaaaatagccacagcttgagtgcatgggtgatctggaggtaacttcagccttcctcgtggtacctaaagtcaggtgacctcatttgagtagctgggaaagtgttctttgctcagtcactcaaaagctccttattttaagagggaacttttcttattagaaaatgtaattatttcatcaaggctatatacacgagacactgaaaaaacagtttagtgagagcatatgattaaggactgaattagtgctaaaagtaaattcaattagaggacaatatgaattccgtttttcaagtgagaggtatgaggtgtctctagaaacagtaattgatgatgcactttgaggaatagttaggaatgaagagaaagattttagaactatctgagtggaggtgatatgtgatagttgaaatgaaaatggatttctctgggaataaggaattgtgggcagcaaagagattgtggcgcgacatttaatcatgaggcatgctgaacatgagtgagtcaaaggaaggcacaccagtgaggaagttgaaagttgtgtagctttatgaaaactgaggcagagattatcatgcaccaaagccccatccttgaatagacatttctcaaaagaagaaatgcaaatggccaaaggtatatgaaaaatgctcaatgttacataatcatcaggaaatgcagatcaaaaccacaatgagatatcacctcacctattaagataactatagcaaaaagaccaaaaagataagtgctggccagagtgtggagaaaagggaactcttgtgtgcttttagtgagaatgtagattagtacagccattatagaaaacagtatggagattacccaaaaaattaaaaatagaactttcatatgatccaacaatcccactttgggaattcaaaggaaattaaaccagtatctcaaagagatatctgtacttccacattcattgcagcattatttacaatagccaaaatatggaaacaacctaagtgtccatcaatggatgaataaagaaaatgttatatatataacattatatatatgaagtatgttatatattatgctgtatataatatacattgttatatatcaatgaaatattattcagccttagaaaaagaaggaaatcttggcatgtgagacaccatggatgaacctggagggcattatgctgtgtgaaagtaaccaagcacagagacacaaatactacattatattacttatatgtataatctaaaaaagtcaaagctggaagcagagagtagaatcatggttgcttgggaatgggaatggacaaaatggggagatgttggtcaaaggtacagtgtttcagttatgatgggtgaataagtttggaagatctaatatactcagcacagtgattatagttaataatactgtatcagatacttgaaatttgctaagacagcaggtcttaaatatattcaccaacccccaccccccaggaaactgtgtgaggtaatgggtattttaattaccttgactgtgataatcatttcataatgtgtgtgtgtgtgtgtgtgtgtatatatatatatatatatagaaacattgcattgtacactatacatgtatacaatttttatgtgtcatacctcgattagggaaaaaaagtttcatcaaagggaaattagggaaaaaagtttcatcaaagtagaaattgcagttcgctctttgaagaagttagaaatgcatttaacttgttagggggttattaggagggaagatctttagctgcagagttctattagcaatagtaaagaacggatcaaagccaccgtttttctgtcaaaaatttgagttttcttcatgggctgtttggtacacatatcggattatgatactctataagtaacacaagattgatcggctatatgaagctcttttctgtagagtattaaattgtgaaatcagtaataaaagtctgtgtgttaaaaatcgttagcacagaaacaaaaattttagtgtttgaaattttttaatttcattgacaaactaccatttttctctttaaatccgatttttctttgtgtctaagtatatcggatgtactggcagattagaaacattatcatgagtaatccttctcccctcaaaatatgattggtaccttttttagacctactctcagcttcactgtgtctggtaatttttttttaactaatcagtaaatagccctactgttaggtctgtgatggttcttaatgccctcggaaggagcgtaagctttctgggagggttttaagcttctcaagaatagagaaacttggaagggcctgggagctggcaggcaggtgacctgcctataattcctgccctgccttttgagctcatcccacacttttcttgcttgagcctcagtttcctcatctatatatcatctatagaaatgatgccaaattttttaccctaattaataaaatgattgacagaaccacttaggctagtgttactcaaatgcattattataattacttcctatttaaaatgtttaagtttaaaaatttgggaagttttaaatcaggggtcacaaacaaagcggaaactttccttttgtgatataagagacttctttaactcaggtacctgggagtagcagctctgtctaggaagccagggtaaaatagatgaataaggaaggagacattttagctggaagactgtattggctgcatgaggctctcatccctttgggagttaggcgaaggctgtactttagttttaaattggagaggctttgtatatgtacacatgcatacacacatttaataataataaaaacatttaaaaagatttaacaaatattgcataaacatcccactcctccaccaaaaaaaaaaaaaaaaaaagaaaagaaaagaaaaactatgcatgcgagatattacaagaagcctatttttaggaggtattgtcttgctgatattccctgatgtccaacagatgcatgtgcaattttcaaagcattgctgccggttgaacaaaacataagtgctggttttttgtaacctccctttctgtggccactttgtggccccggttatgaaagctttttagttttactttgatgtgccgtaaaaaacacaaatttagaatcagacatatctagactcagatactagctttgcatcctacactctaaaagcttccttttgttggaaagaaaatggggatgggaacatctaactctaattgttattgtgagtgtcaccttttataaactgagccactacagggcaatattttcaataaatgatggcttcttttttgtaactcagtggcccttatgccaaatttagaattacctgggagttttaaaaaattttagtactctgattgaagaccctagacttaggttcacctgagcctaggatggagctggaaatctatgtgttagaagtccctcagtttgttttacagtgctatcaggtgggaaccagtgctgtaataccatcagataaatgaaaaacatgacaaagtagatttggcattcaagtatagtgttctaacacctcttcatccccaactacatgtgtatgtgtacatgtgtgggtgtgttccaatacaatgactatttctgaataggtagctatcattatttgctcaggatactgcttctatgtatttttcatttcgtatttactcctctttggctgacaacctatgtagtgtgattatgaattaatgtagctacttttctcatatggaaaactcacacaaaggcaaaagtagttattaaagaggactagtgacagcatcactggaattaaatgtgtgcctctgaagctgattgctttggattgacagtacacagctcaaggtagatattctgatgtttttgaaatgcaccctacttctttatatgctgtctagtcttgtggcttcagaattacacaagcttaataataaatatgcatatatatatgtgtgtatgtgtatatatatatgtatattcttaattacttttcaaattatttaaattaattttaccgagcctctgtattgacagctgataaatctttaaatcctgtatttaatattttaataaataatgtttaatacattatagatttctcaaattggattttttttttctaagcaactccttatatcaccacaggaccagtagtgctagtaccagcacgagttgcttctcacttaattagtgggtcattcataaaaacaatacttcattggcttaaaaaaaaagctattgtgatgtaataaatatgtacaggcgcttattcaagagtcaaaatagaaataaagtataaatcgcctgctcttctggatcattccctctaccagtgcggaaaattcaggaatgttcataatatacagtgttttattttatacattggcacaatccatgctgtaaggtcacgagccacggaaagcttattgtatagtttgctgaacattttttattatattttattttcaccaacttaatttttcagcaaggctctatgccattcatgcttgtacaagaggcaaatacacatggattattcatttcactctgtttccataaattgcatcatttagcatcagtgtcatgtcatagctagctctgtgtacctagtgtgtgctctcggcattgatgtatgaatgactagcataatctccctattgcttatataattatagtgaataataatgcagttttctataatgtttaaatattggctagtttcttaatacttttttattattttatgatcaccaataaaaaacatcgccaattcctgaataccaactgtgtgcagatattgtgtggtcactgtctttatataatccctgaaagatcagtgtgatccccattttacagatggaactgaaaaattaggtcacttgctcatatctgtcatcaagtggcagagcagagatttgaaaatatatatctctgactgtacctgacctctttcttgcatacctttctcgtacatcatcataactcctaccacaagattgctgttacttaaagatcataagaattagagttcctgaagccccttagttaatactttaacaactggtcttcatttgaaatgcacaactactagctttccactcgcagcttggactggggcctagaatggtctattgaatgtttggttgtttaaatgactgcagcaacttgcccatcttctccatcaagctactgaatagtaatgtaattagatccagcacttagattttgcttcctcccataatattttttatcatttggtgattagattacaatgtcaatgattagcatgtagtttccccaatctaagcagtaagaagctctctgttctatgtttgaaaatggctgtaaggttaatccactaactgcatgtaccttgatccaaaattatatactgatgaatggtgatgaattccatgaaattcaggaaactgccttgttggctgacagcaagatgtgttatgattttatatagctgtgtataaatgtttgcagtcaatcagaaccatgggaaaacagatttagaattatagaaaatacatgaacctggaaaattaaccctagggaaaaatctgtggagacataataataatagtaataataataaaacattatcaaaaatttatttggtacttgtatactgccaagcaatattataagcacattgcacgaattgtatcgcctttaatagttacaataaccaaggaagaaattgaggcataaggaaggtaagtccaaggtcacagaacagaaaattcactattgcaactcaggcagttttagttcaaattttgtgttcttaacaattgtgaattctgcctcttagctcttctgagtataaaatggatgaaaatgcagttgagtataagatgcagatttaatttacataaagtttcatagcagaggttaataattctgaatatacattttgtgtaaaacatattttctatgaattacatcactgtagtgttttttgacaaataaatggaaattccatttattttacactgtatatttttaacataaaagtggtattctagctttctcccttaccataaattatattatcatttatttacctacgtttgtattttcaaaatcatgcttaatagttgataccgtcctcatgacgccttcattttttttctggggagatatgattttctcagtgtttattttaaaaaattattcatagagacatgtaataagtaacatgaaatcaccagcaagtgtatcccaggcttaaaatgagaacacacattgatctctgaagacacaaagcacaaaggttattgcttcatctaaattttgatgaaataatttcagaattcaggaaacaagacttgataggaatatctggagctgtaggtgaagtacaggcagtataagtgaggtaaagcaaatgtgagcaatgtataaatagaaatctttccattgaaaaacaagactgataatttcaatatttccctaaaaatatgctctatgagtttatgaatatatacttgaaaaagatcagtattctcttaggcatgcttttcttcaattacctttgcatgtctgaaacaagctgttttattggcagtttttatcttaaaaaaatttttaagaagatttagataaataacagaaatgacagttcagtcataaataagtaatacaataaaaagttatctccttacataaatgtaccaaacaaatgagattttttgaatcattagaaattattctttataacatgcctaatgaattatcattgttctctttttttacattctggaaaattctcagagtatatagatacaatagataactgtcttacttactgtatgaaaatagaaattttcagctgggcatggtggctcatgcctgtaatcccagcactttgggaggccgaggcgggcgggtcacctgaggtcaggagttcgagaccagcctgaccaacgtggtgaaaccccatctgtactaaaagtacaaaaattagctaggcatggtggcaactgcctgtagtcccagctactcgggaggctgaggcaggagaattgcttgaacccgggagacagaggttgcagtgagccgagatccctcaacgccattgcactccagcctgggcaacagagcaagactccatctcaacaacaacaaataaatgaataaatttttaaaaagcaaaaaagaaagtagagaatagaaattttctgcaaatagtaaaagtttgttttatgtttaattattttgaaaacatgcatcacattttatttttaaaattcttatcttttaaaatatattgtatttggaatagattagcttttcttctcaaaaggaaattgtgtgtgtgtatatatgtgtctctttttggttcaagatgaaagtaatcacaacactaacacaaaatacatgctacagaatatgtgttacataaatcccactttgaaaacaaatccctgaaatgaatttcatgtatttccattaattacagagaagtattacaatgacatatttatatttcggttctgtcctaagaatatatgttcgaatgctcaattgacatacatacatattggaagttatgtatgcaataacgatcaatctatgtattgtgaattccctcaatgtgccttattactataagagtgacatttcaatgatacattttattgaactttttcattgatattattggaatttgaatgaagaaaatgtgaacagagtttaaggattattaaagttcctctaattttatttctaaagtattagcacattatttggttttatctttagctaattttctctgctatggctgtggttcattattgttatcaattgccacaacctgtatctagtactttaggccaattatttatagaatatacttaattaggtcaaattaccttaggttgttaggttgttaccttgggtggaaaagataagacaaggtaattaggcagcttgtaagtgaactctgagtaatgaaaattgataagttgcatataaggaattggtatcatttcatatacatataataagaaatagaattgtggattttcttatggtcaaactatttctgataattagatggatttatatagcctgggatggaatgagtctgtgatttatcaaatgagtctttatgctttatcaaatttaaataaactaagtagagaatatataatatttgcatatatattcatatttggcataaataaaattacatatttactaaaaattctatttacctaaatacttctaaaatgtgcaataatgacttattttgcccttttagttatatgttaaatttttcaaatactgtgagaggcaatttaatatcatttactgtaatatccttgataacattaatatacctaactggcaagagttagttgagacatttttactgaattgtatattaaccctcttcagtgctactcgaagtgtagtctattcactatatcactgtcatgttaccagtgtctgttacagatttgttgggagacagaaaataggaattagcatttaagaccatttatgccaaacaacagagtaatttttacctattgcgtttaataaatattttggatttttttgtgtgttacattttgtatcatttttctagtaattaacttttattttttttttaatttttatatatttatttaatttttgagacggagtctcactctgtcacccaggctggagttcagtggcatgatctccgctcactgcaagctccacctcctgggttcatgccattctcctgcctcagcctcccgagtacctgggactacaggcacccgccactgtgcccggctaattttttgtatttttagtagagatggggttttgaggggaaaggagaagcctggtccttcctcagagttttacaagaaaaaacactgatttatctgattcatgattcaaaaagttcaatactacaaccaaaatatagtacacattttaatatcatcattgtaacaggaaaaaactgtcatatttgagtaaatgtcatagccataatgatttttgacatataaaatgcaaaaattggcattatgattcaaatatggaaacattttattgaaatggccatcagcactaaaatgtgttctttctgtttataaagaaaatattttataccttaccatttattgattctgaataatgtaaaaattcttatatttaaaagtttattcatttaaaagcaatgtattatgcattatatttatatatggatataaatgcatatctattcataaatatacatttatttatgcataaggtttttttttttaatcccaggccatattttttaaattgacctcctctgcaatttacatcttcatttttctatctgtagctgcttctctctttcctgccaatttacttccttgtcatattaacagtagcttgttaatcttaaattcataagccagtcaatactttattttctaattcggaggtttggttggctttagtgatttctgggtcacactgcctatactaattgatctgtctgtaaagtgcacaaagaagaacacagaaagaggatctttaaagaacattaaataaatgatactttttgataagtaatgcgtacgcatggcaaacaacaacgaatgctacaaaaagggataaaataaaatgtgtgtctcccttctcatcactgtacatactccctggaagaaactatggccagctacttttatgagaaaatataatattctcaaaatttatagtcccagagtaacatttgacaataaatgataacttcagtaaacaatgccacattttgcacttatcatatattaaggcacatgacctcttttcagtatgctgtgacccagggctgtaattatctctgttgtacagataagaaaacagctttatagattgaagattttgcagggatttcagatcctaattttgagacttgacatatacagatatttctgctatgatgtatacatttcaaatgttttgcaaaattatacactaaaattttgaaggttaacagaaaaaaatggacattcagttataccaccataagcctatgtagcaagatcatgaagaaatataatattattttaataaaagtctcagcagagttaagagatgtaacatttttaatagggaagttataagagacaacctttaaaaattttttagaaatacattttattgtgtatacttaaggtatgcaacaagatgttatgggctatgtatagttagtaaaatatttactacagtgagcaaattaacatattcatcatctcacatagtttctctgttttgtgtgcgtgtggcaagaatagctaaaactcagtcatttagcagaggtccctgatgcagactcttcacttcttgggaaatattaagtaagtgtccaccaatgctatccaacagaattttcttcactgagggaaatgttctgtatctgctatttagtacagtagtcacatgtggctaatgatcacttgaaatgtgactactgtgactaaaaaatggaattttaaattttatttaattttaatctatttacatttaaacagctacatatggccagtggctaccaaattggaaatagcaggtgtaaaccaattgatttccactttgtgctgacatcatttccctatttgctcatccatatgagctaattcacgtgctagatagaggtggtgtataaccagtatgctctgttcctttcctgagataaaattggaactagcttacatctatatgctgctagcatagatcaactttgtaatgacaacacaaagggttataataggttataacccttttaaatagaagcctgctcatccctgaacacagcttagcctctgagcttgtgcaaactttctgtatcattaatatgtaaatcttaccctcagtaggtaagctctttcaaaactgtgatccacttagtatgtccttatttccctgtgaataatcttaccagacaagcacattttgcattttaatttgctgtgtgagtttagtttctagaaactactaagccatttaatgtcaatatgttttattagtcaaaaagaatgattatgatttccaaaataaaaattgtctagcaaatacatattaaaatgaattttgtaaacatatattaaaatattttaaatacactcaatattaaatatatttgaactatattatttttcattttgtatgtgcacctagactatcttaaataaaatagccgtcagaagaggatgacaagttgtgcaatgttaaaaagctggagtgtatttaacactacaaggttagacactatagtgttacacagaaaggaaaataattatgaattaaagttggaaacgtaaggtttttataccactcatatatacgattttttaaaggcttgtgggacatggtccatatgtagtgggaattctcaaatccacctgaaaagcagaatgcatgaagatttacaatagatcatccttggaattactttgtctcactacctgttttctcattaaaatggttgcctttaatatgatctgcataactaggctgtaaaatgatgattgaagataaaactaggagcctaatagaatttcccacaaactagttctcctcattgacccaatagttttaagtattgttttaagatgttttcttttttaaaaacatacatgtgaaatggctattatcaagctcattaacatatcctctacctcacatacttacatttttgtggtgagaacatttaagattttttttcttagcattttcaagtgatttgaaactatttttacaatatgttttaacatattttctgaaaaaatataaagtctttagaagagatattctagaacattttacttcaccatttgtggaaactatggatgagtggcagccattgttggcaagtagagagactagtcatagaaaatttatttaagccaatttccaagttaatataggtgaaattatgataggatttaagtctttgtagagagtaagtggaagaagtaaccttatataattgcagagaaactatcagggccagttacactatcccagcagaaatattgcccaagtgatgtcttgcagaatgatgacttcctatatatcatcaagctgaagatgccattgacaataagatacaccattattttcttaaaaggaaaaatgctgtcagttcaactgtgacatgccttcaattgcaaaatatggcctgtgttcagagctgttaaaatgtgataaatatgtccttaaaattacatgaaatagggtaatttttttcacacagattactctggtgcaatattttttgtaaataatgcagactgatatcaggaaaatccttcattctgtacaggtcagaactccagtgaggtttcactccctctgaagagtgtttctaactccaacactgattggaattaggtgcctgtcctgtgagctcctacaacacctgtacacagctccactgaagcttacctcaacagtcagtttattgattttctgtacctaccacaggatttccaaagccctgagggcatatgataaccctttaaaaaattgtacgatagtgcccagcgtgtggttggtgctgaatgactcccatgaaggaacaaatggatggataatacacagaaggggtgctgatgtagtgatgtagtagccacaatgccaaattaagtttttccttttaaactcttccaaagactaacttcccacatctgaatcatgtttcagagacattttcaagttatcctaaaagctataaaatttagtgccctcttggataatgtgatgcagaactaaaacctgaaggtagttacagtgaactaaaataaaaaaatacgtacaagaaaagttgtgattgtgtactgatatggttatgctttgtgtccccacccaaatttcatcttgaattataatccccataatccccacgtgtcaaggaagagacctggtggaggtaaatggattatgaggcggttttctccaggctgttcttgtgatagtgagttctcacaagaactgatggttttataaatgttcggtagttcctcttgcattcattctccttcctccctccttgtgaaggtgccttgcttccccttcttcttctgccatgattgtaagtttcctgaggcctccctagccatgctgaactgtgagtcaattaaatcttttccatttataagttacccagtcttgagcagttcattatagcagtgtgaaaattgactaatatatgtattaataatttatacattttgtttttgtgtgcgtgtgtaatgatccacttgcctttttcactcacacttcgtattaagtgtaacttaaaaataaataagacatgtctgtgtgtgtgtgtgagtgtgtctttaacaaaatgaaaaggaaatcatatttctttccagagaaatggatgagaatgcagggtgcaacatagcataactgagtaaaaggaaattaaaaaagaaattataatattaaaaattattgggtaataataattttgactgggtctaacaggatagtaggacctataaggtaaggaaatgaagatattggaagcagaaaattactgcttttcccctcttaaaaggtaatgataacagaagacgtatagatagatagatagatagttagaaatgaatcaataataaaagattggacaaacattcttctgatgccttgtgatgtaaaactgaagaaaattgagtcctttatattttgtccatcacaacactaacagtttgattttttagatgcctgatgtccctaatttagtcatgtcaatgaatgttctactagggtactcagcaaagttttgccatcctgagttgcgtaatttggatatggtcaaccagtgcttcataccaagatagctaattgtgtgtggtaatatagtgctcactcctctctttaaaattttgtattactaagttatgagattaatgctgctacagttgtaaacaattatgggatcttaagttctttaagactacataaaggtatttgtactatttttatatattcaataacttgctttgtcatatatgtaagcatatatttttgaataattttgcttgacataacatgcatgaatttgctgtgaattaaaggccagtccttatatacatggtgaaatatggtatatttttgtctctggtaaacccacaactgggaagcagataatattcttgtccagtaacactaacttttgggaaacatagtttgtcctagaaatgattgacatagggctcatggttttaaatacttttattgaagattatggtaaatgataataaatcaagaaaaaacataaccaatttccaaatgtcttcctgatttttacatcagaacataatttttatgtacatataataaccatttgaaacaacttttgaattagccaatattttatttcccccaggtgatgaaagtagacacttttatgagtttcttttgcagtgagtttcatgcaattaagtcaaacaagaacaatttttgtaaaccacagactggaaaaattaaatggaagtagtacataaatgattaagagtgcattattaccataagtaaaattgttcatttcctttacttcgttaaaatttttatcatatatatttactttattaatataaactatactatcttagtaaacctcaccaaactataaatcattaaaaaatttttaccaatatatttatatcatgtagtattagaatgtgtcttgctgaacactttataggaacactattttcaacacattcaggtgaggtaagatataattttcttgtatttcctcctaatgatatggttgactgtaaaagaacaataatcactattgtctcaaagtaaataggctttgagactcattaaccaccttagttttgcttcagctattaatctgagaaggcatttattactttgcatattacagtccgatagagaatatcagttaattaattccagtgggagattttggtatcatcataaacaacattttaaaaaataagctaatcttataagaaaatggaaagcgggtgtgtgtgtgtgtgtgcatgtgcgtgcaaagagaaagaactgcaagtaatactgttttcacattcatggaagagacaagtagttatagctcagaaattcacagaactggaggtgacaggatacactttgatacgaagtcagcatatcagcatagtatgacagttaactgtgtaagctctggggaaatcttgggttcagatacatgctttattgatcattagctgttagaccttatgcaaattacttctcttttctaaatctggggtttgtcaacataaactggaataaaaatagtaccccaaaaagagtgtttaaaaaattaaggtactgtatgtcaaatattcacagtaatgctaaataaatcttggctgttattattagatactaggagtccacgtgatataaatgtcttcttcccaatcatatcatgacacatagggaaatctaaaattaaagtgagaaaaacttaatatctcttatgtttcagtatccctatacttggatgtaggttcactggaataaaaatggaatggaaatatctattctgtattcttggaattctggtgtggtctgtctttctagagtctgctagtctaattttttaacacaaagcagacagttgctgtgttttatgcataatcttaagtatttatttttgtgtaattataatttattttaaatatctatctttgtgtttaggcttagtatgactgttttaaatattctgaggtagatggatactgtgcctatgatattgggcaagtaaaattagcattgcttaatcacctatatcatggctgcattaatatcggctccttcatgagctgatattaatttccaaaatagtgcattgtgaaagatgagtggtatgcagaggtaaattactattatgcttgcaataattaaagaaaataaattaaaaattgattgcaagtgtaagttgaaattaatccatatagactaatagtttatccatataaaccaatttattgaaccaattatttattgaacacctgtcacattcaattttctatgttacatctatgctgtgttaacacactaattttatttatgtagaaatacatatttagcaactggagataccgacacaaaccagatatagttttgagcctgaattagatttcaaaatggtggatgccataacagaagtacaacagtgagtcatggaagcccagaaatggatctacctgatcacagacttctaggagggttttcttaaggctctgatgattaaattagagtggagaatatgcagaatactttatcccaccttgggagatgaggaaaagacggcacatgactgcctgtaccattgaaatttataagtaacactattctatgggattaggaaaacctcactgaaagggtgtattaagtcactttggccaatagtaatctggttcttgctgcatgcaaagaccttaaggatttgtgtaccattgagaactaacctcagcttcttatgtaacaagcagaggtgaaggagtgggggaaaaatgctataagaagatcgagtctttggttatgagatgagagtggtgtgattggtcttgacaaatatactctgttcaaataaattctgaaaaggtagccttgtaggaatccaagtaccagaggagctgttattgtagtgctactgcctgccacatctatcttggataatttctccatttagagaatatggtgtcttcagaatttaagtgggaatttgggggccaggtagaggaaatgagtcttcttatcttgcttccctttctctctccctttgccctgcctttcctttcctttcctttcctttcctttcctttcctttcctttcctttcctttcctttcctttcctttcctttctttccttcctcccttcccttcccttcccttcccttcccttcccttccattcctcccttcccttcccttcccttcccttcccttcccttccttctttccttcatgtctcttttaaatgtctagaatttaatattgaatgctatttgggtgaatgggttatattgggagggtcttaataggctcttttgtctccacctcatctgactagttcagactgatcacctggcatgatatgtaagtcaaataaaagcatttgcctttttggtggcacttagggatgacagggaacgatgggcaaggaccatggtagaagtttggaatattcactataagaaaagggagatggaggtgagcaatgatatgcagaaagaatgccaaatagcagggtgttgcaccatgaaccctgattgacccatgagttggttattgccttaatctacacaatgcagcattttctctagtagctctcagaacagagtatttggttggaaggaagtttgagattccaggttgtaatcatgggattctgaggttctaaagttgaatgattttaagctgcacagatgctgcaacatcttgtcctgtacaactttttaagttttgtgggaagtggcacatagtaagtgatcagtaaatatttctgaatgagtaaatgaatgtgtgaagatcattaaagtcaacatgatcaagaaaatgtgagaccagagtgttatgaattaaattattccaatatgtcaatagaagttgagatgaaaaggaatcagatacccaacactcaggcattacttagatatcccaaatccttatggccagtagcttactggatatcttcacttgagtatgtgtaggtatcttaagtttaccctaacttagttagaaattctgattctcatcttttccaatccttctgtttctctaataccacccttatacatagataaaaatggtccctaccgttggcactgtgcttactgtgacttctttcagctatggctcactttttggggcaaaatggtcatatgctcactgcaaggcaatattttcgtccacatcagaaccaagctctaagtatcctgagtctaagagttactttcccaaatggcccattttccacttttggctctgtacagctctcaaccccaggttcattctcaaaaaggtggatggtgtcactagtgtgcataccttgaggctcactaagtgaatatttgcaccggtgggagactggacagaactggatatttaaattggagtgtccaaatgaatgtgagtgagggtactggctgagaaggatatagcaaggtatgaaaaataaagggtttaggctgggggccaagggccagtgttctctgtgcacagagaacacagagaatttttcctgcacaaaattccaaggaatttgaaaattatatatttaagctaagtataaagtttattaccaggtgtttttatgaatgtagaatgatacaacatattatttaatggattattaacttcattattactttttttttttttgacacaaagttgcactctgttacccaggctgaaatgcagtggcatgatctcggctcaccacaacctctacctcctgggttcaagcaattctcctgcctcagcctcctgagtagctgggactacaggcgtgtgccaccaaccccagctaatttttgtattttcagtagagacagggtttcaccatattggctaggctggtctcgaacttctgacctcgtgctctgcctgccttggcctcccaaagggctgggattacaggcatgagccactgcacccggccacttcattaatacttttaaaacacttaagcacatgttgaacttcatttggaaccaagccttgggacccacagatattatggatgagtctaccttcctctaaactttgctgtctcagttgatgacatcaccatccatccagttgctcaagatagatagttagaagttatccttaattcttctctttgccttgctcttattttctgatacagaagccttaagattctggtataaaatgtgtgttgaaattttatgtatttcttcctatatccattgccaccaccctaggccaagtcatgtcatttctagcttagattagttgaaatagtctccttagctggactttcatgtttacaagctctaatccattctctacatagcagttagaagtcatccttccaaaacgcaaatcagatcatgtcacaagctggcttagtccttcagcagattttcattacccttagaacaatatccagattctttgcagtggcttacaaggccctggctgacttggctcctgcttatctctccaaccttgtcttgtttcctcttgatgattacatttcagtcacacagtctttctcggttttcaaaaaaagctttatttgtgcccagaatattggctatttctctctctgcatgaaatttctttcctcagctcttttcactactggttttgtcacctttttgatgtctgagattttattccatctactaacagaagctttatttggcctcaaacttgtgtgactgcccccactcctgatttccaccttcacggtgtcctctttatttcctgtgttacacttagcacagtctcgaatgtgtgtgcttgtttatatgactgctcatctagaatgagtactgcatgaagacagaaactatgtatctctttatttctattgtattattatcactcagacccatgcctgacacatttgtagaaccaatatgctttgtgatgaatgaatgactgagaagaaatgagaagtaggttatttagtgagtttaatagaaggagtggagcagctgatcattatgggtagagcaggagttcccaatccctggctgtggaccagtactggtctgtggcctattaggaaccaggtcacacagcagggggtgagctgccagctagggaactttactgccttagctccatctcctgtcagatcagcagtggcattagattctcataggagcgtgaaccctattgtcaactgtgcatgcaacggatctaggttgcatgcttcttatgagaatctaatgcctgatgatctgaggtggaacagttttatcctgaaaccatccccatctataccccactaaacccctccctgccatccatggaaaaattgtctttcacaaaattggtccctggtgccaaaaaggttggagatcgctggtgtagagtatatcaaaactatgtatttcttttttggttgtttgtttttgttttgttttgttttttgaaatggagctttactcttgttgcccaggctggagggcagtggtgcaatctcagctcatcgcaacttccgcctcctggattcgagtgattctcctgcctctgagtgattctcctgcctcagcctcccgagtagctgggattacagtgtatatacatatatgaaataaatggtggctgggaagcaatatgacttaaaaggagataatttacatctacatctactaccctttcaattgtacttagctgaagacttctttagaaaagttcaaattttttttgaaaagcagtagtagagtgtgtttgaaaaatagagtttatcattgaagttaagttctaatttctctatacggtgtttaagaacaattttcaaaattaaaaatccagttggattgtgaccaagatttagtgacctccttccaggacaggatttttggagtgtggatcacattgcaatatgttgctatcaatatctgttagttgatctcagctgatgtgttattagtgaattaatggagtggactagagtaccttgcatgataggttaggtattgtttcatggaatttgatccagttgtgtgtatgtacatgtttatatttttttctgtggtaggcttccagaaaaaattgtatttcttttttttttttttttttttttgaggcagagtctcactctgtggcctagactggagtgcaatggcatgatttcatctcactgaaacctccatctcccgggttcaaacgattttcctgcctcagcctcctgagtagctggaactacaggtgcagccaccacacctgggtaatttttgtatttttagtagagacggggttttaccatgttggccacactggtcttgaactcctgacctcatgatccacccgcctcggtctctcaaagtgctgggattataggcgtgagccaccacgtctggcacaaaaaaaatgtatttcttaaaaaggctctaataaaaaacatttgaaagccactgttctaggtgataatgattgtaagatctttgtgtatagttcttgctagctcagtcttattaatagtttcattgagagagaattcaacaggtatttgtttgtaagtactaacaaaaaattgtacattcaatacttatcaaacaaaagttacatgatcttattcttccactattaaatttttattttatttttaaattttgattttttggcatttcacctgcaagtctttttgtcttattagagtcacactatgtgatggtattttttctttatccacaatctcccctgactcccctgttactattatggaataatgtaaagttaagaattaattatgattacagtagttatgggtaattaggtactatgaatcaaatcttagaaatcactttcattattgtaatagtgcctcagaaaacaatttttcctctttgactttttaaattgttaatactatcataaatggcatttatgtattcatttaccaaatattgatcaaaaactactttgtgtctaccatcagaatttaaaagacaccttcctagatcatagagaaggcttactgacatggcacatacagaatggtaaacagatagctacattacacaatgagataagtgcttcaataacaatatagagctgtaagggagtgaattgaagagatactcccctattcttaaatgttcagtgaaattcctttgtcccaaagtgctagttaaacgaagacataaagaatagtctagcaaaaaaaaaaaaaaaaaaaaaatgtgattgtggtagttaatgttccagtcagagaaaatagcatagtatgggagatgagggtggaggagggctatgaaatacagtcgcaagaataagccaagttaaataatttaagctccatcctgggtatatagactttcaagtgtgtgagagagcacatacaaaattactaccatagaagaattttgatggcacttttaattcaagtacacttgaccataggtatctgaggtagtactagattcttgaaaagagagctaatccaagacataaagggtatcaactgataaaaatcctgcaacttttgtatgcagttggaaatggtaagaataccagcatttagaagagaatctccaaaattggcagatagaggaaaacacttctatatgtcttaggatagtagggaagagtgcatcatttgctatataaatggaaatgttcatctaagctgcattttgtatgcacactctgtattggtctggtctcataatgctatgaagaaatacctgagtctgggtaattcataaagaaaagaggtttaattaactcacagatctgcatggcttgggaggcctcaggacacctacggtcatggcagaaggcacctattcacagggtggcaggagagagaatgagcgctgagtgaagggggaagccccttgtaaaaccatcagatctccggaaagctcactcactatcatgagaacagtacggtggaaactgtccccatgatacaattatctccacttggtcccacccttgacacatgggtattattacaattcaaggtgagatttgggtgggaacagagagccaaactatatcacatccccacattcaagatgcatgtaagcacttctgcaccattgccatactcaggctccagctttttatggaatttcatctctggctattcattcatccattcattcatacgtgcatacatacctaaatgcatttagtcaattaatcaatcagccattttggtggccgaaatttataaggcaagtaatacttttagtttctttgatagacaccatgatcagaaacatagtctctttcttaaagggaaaataggaagtcttctgagtcataacagatgcatacataaatttctctgagtcttcataagaaacacaagcaagatttcacagaggcagtggaatttgaactgagtcttgagaaataagcaatatctgaacatgtagaatgcaaaataaaggataagcaagtgctaatgcccagagggtaatacatattaaataaccaataaccaattgctacttgtgtttcttacactagaagacaacttggaactatttatcccaaatattaatttccagtttggggtcctgagacagtaacttcaaaacagtcgacattaacttccagtcctttttttcattccagcctataataataatttgtgtagctgcccacatctctcactaaatgttaagataactctggtttaaaatataaataattgaagaataattagatattttgagattaagaaagaggatggaacttacagaggaaagataaattatagttagaagtaaccttgaggtacttcttgcccaatttctcattttacatatgaaaatataaattatgtgacatcccaaggttgggcacaattgtagtggcagagctgagactggaactcacagttcctgacttgcagtgattttctccccatgataaatctgattttgaaatataggataagaagattgcttgtagaattaaaacctgagaacttgagtgtaatataagtgaaatagaaaattgctaaaataatatttacacataattttacttggatatcactcctaattagtttgagaagtaggtaggacataaataacaaataaatgaagtaatgtatactcaaataaacaaagcttaatctaatatagtcctcatatatagggttaattgttgaaaatccactagtgccaatagactgtatataagtatagaaatagcttcaaattcctgatttctaaaaatatatatgtgatatttcacaaaaattattttatggtagctaatataattaaggaaatgtgtatttcattccataagttaaatattttatgaaattctcaaaacaatgtatacatggagagttgcaaccaaccctaaaaataaatattaataaatattgcaggagaatttttgaggatgatacaaatttattcagttaatatggatgacaaaaataaacaaaataacatgattaaacagaactttctggaaatttagtatactaatgaatgttataaatatcctgtgaataatgtgaacaggagcaaattttggtatttaaaaacctatttatttacattagttaaaatatgaattagttgtataataacttactctctagttattctccttagaattcttacaaatcctgaagaaatggagctttaagtttttcgactttcataccagtatagttactactatggacactacttgttactactatttactactaatggctctcatttttgagcacatttttatgccaagcattgtgctaagtcctttctctacattttctcacttaattctaataatattcttgcaagtttgttattatcacccacattttacagatgaggaaacagcgtctcatggggaataaggaaatgattcaagtcaagcaatcattaaatagcgcagttggtacttaggcctaggcctctctgatttcaaagcccatgctcttgacttccatgctacaccacctctgttcagttgccacatatgtacggagcctctagacactaacactcttttggatattagggatgccaagaacaaaagaacagcttcagcctttccagactttctccagaagagaagacatttaactaaacaattgcaatggaatcttacagttgctgtggcagtaaggcataagaacatagtcagctcatcaaagaagtcgtatcctttctacttacaaattccaaggaaaggctttttctaagaagtgatgcttgagctgagactagaagataaagaaatgttggatggatgagagaatgaatagttgtccagatttgagaaaagactaagaaccatgacacggcatggggaaaagtgtagttttcaaattgactgaagtgagaaatacagctagagaaaaaggcacatgtattagcaaatattgtatgacttttattcacattaatcacatataagaaaggttacaatatattccatagttattgagatactgttgatgaccttatagtactgaaaaaatggccatgtttgttctctgtgttcactctgaacgtaaagcgcaatgccatgaaaggggccacactgggaagaagaaaaccagtaaggagaatgtaaacatgactcccggtgagggctggagggcctttttaaagattttactttttctgtttttaaaacatatttcttgggttagatgaacctaagaaaatatatggagttctgtttatttcttacatactttaagttacatgtttacatctgcaaatatctctgtagttgttgggttatcattgtccatcaaactctttcaaagtagtcattacatccttttcaagtgcacatctattgaatagttaccatataccaggccctgtccatgagaagatagttaaatatctaggattctgggtaagactgctcttcctgttcagaaaagttcagtacagatcaggaaactgagaaacaaatataacaatgtgggatttgtcaaagatatctgatatataggtatttaataaataataaaggtgacatttaggatcatcatggaaaaggcagattattccaaaaaaaggctttaataaagccagctaatcatttgggggaaaaaaggtctggtcagtactccgccctttacaccaatataaatttcggatgaatgggatatttaattatgaaaactgaaaataacccaaaatttgggtgacttaccaacccaaaatttggctgacttagaatgtggggggattttcagtaaattataccaaagacagaaatccataaggaaaagacaaatttgactatataaaaacttccaacttctctgctatgaaataacatatacatggtggaagaaaaataactgtgaaagttgtgttcaacacaagtgagagatgaaaggttactatacacaataaaatattaaaatgtattcagacttgctaataatctaaaaagtagaaataaaatgataatgagatatcattttagcctatccaattcaaaactattttttaaaagtaaaggatacaaaatttcagttagataggaggaagaagctaaagagacctattgtataacatggtgattatagtttataacaatatattatattcttaaaaaatgcaaagacagtgggcattaagtgttctcaccacaaaaatggtaactacctgaggtaatgcctatgactgtaatctgactaactagatttagtcattccacatgtaaatatacttaaaaacaaaacttcatgttgttttgaagagagacggtaggcatatatgtgttgtataacaattttatctgtcagttaaaaaagctatataatatgaatgtgtgattatattatattaatatcctataaagtgatcatattataactgtgtggaattataatgatgtcatattttaataatataataaaacagccattaaaagtggtatagtaatattcctgaatatggaagaaacctttcgcatactcaagataaaatttctttctttcctacatttgcattttaaaatttgtattttctttttttctttttttaaagacagggtcttgctttgccatccagactagaatgtggtggtgcaaaatcatagttcactgtaacctcaaacccctgggctcaaacgatccacctgccttagcctcccaaacagctaagactgcagatgtgcaccaccacacccaaataatttttattgtttttttgtagagatgaggtctcactgcattgcccaggttggtgtcaaactcctagccttgagacatcttcccgacttgggctcccaaagctctgggattacagagtcgcattcatcctatatttacattttatatgtaatgcatttttatattcagagaatacaaaaacttccattttgtaggaaaaaaatctgatgcatttggtggagacattttattactatggcagatctgggttctaggtatacccataacattgtgtcactagtgtgagggagctagactaactcccaccccaaagcacctcactcattccagctttggtctgctttaggtctggtgctgagtagacttggaattaatccttgccttttaaatttgagatagcagaaagcaaggactagtactgcttcttagtcaccactctgccacctccattcttccaaccgttcaaactcaaaaccctggagttttgggtgaactttccttttctttgtcttagccaacatcagtactcaccaagtcctactcattcttgcctccattctttttccttcacttggaccaacattatcatattctggggtctcatgggtattgataatgcaataactttctagttggtcttgtttccctctgtctttttccctttaatttatcctaacattgctacttaaattcttgagaatagcatgtttcatcttagtcattttctattaccttttggatggtgatttcctttctttccttacttcagatgaaaactgtgaaacttgtagatggccaactattgttctaaggatgtgcagtgagcttttcagtctcatttgtctgtagtatcctgatgcacctttgattgtcttgccttcctttcttacttgttggcatctcttttacctatttatctttttgtatctctctgtggaatgaagtataaacataaatatcataaggaaaagccagataactccaataattttcagtgtattaggcatttttggaaaaaaatccagagttaaattgtttatacactttcaagagtctagtcactgctaatttctcctctttgctcatcatttcttagctttggcagattggcccatttgttcatttgtcttttgacccaaataaaaatggtatcttttgtagaaagctctgtaaaggatacctttatatatgtattttcttattctctgttataaaatgacatgcttctttttcacatcttcaacagaaataacataatcttgcaagacttcttcaacctgaatccttgagcttaaactgatgaccaggatacaatgtgatataaggattaagtacttgatctttaatgttaagataggaatttattttaaaaagcatgtttcataactgattcagctgggtgacttggggaaagttacttaagcattttaagctcgagtttccttctctggaaagtgcaaccatttttgagctattttccttcatcggaatgtcctttcctttctgtccatctgcccaccttttaaacattttgaacatcttaaaatcaattttctgagaggacatgcaactttacttcattaaagtatttactaaattgcaaaattttatttatttatttatttttttttttttgagatggagtctcgctctgtagcccaggctggagtgcaatggcacaatctcagctcaccacaacctctgcctcccaggttcaagtgattctcctgcctcagcctcccaaacagctgggactacaggtgggcgcgaccatgcccggctaatttttgtatttttagtagagacggagtttcactaaattggccaggctggtctggaacttctgaccttgtgatctgcccgcctcagcctcccaaagtgctgggattacagacgtgagccaccgcgccgggcctaattgcaaaattttagaaatagaaatgttttgctttgttctaagtagcattttccattttgtttattatgaatattttatgacaattgttattcaaagtttgcattcttcagagtttctttttatttaattataatgtgaaaattaattgacaagtgcaattttattttcattttaagaatttgtagcaaaatacacaaatattcagatgaagttgaaatacaggctaagaagtcagttagacaaactgatttggggcaactgaaccactttagacatagatattcattatcagcttcccctcttccacaataagatttgaaatatgccccttttacttcatgtaccaattatatttcagattgccaattatggctccttgaaatatgataagaatttgtattaaaccatttcttgttgctgtaatttgtagtcaatttgatgttggcatggccagaagataacctcagaatgtcctgcaagattttgatgtgtaagttatataaatcatagaagaagaaatccagaattggaatcttgaatattaacagtttaccttagcagagatgctaaaacctcaacacagcattggatagttagtaatatttttagtacatactatgttactaattcaaagagggtgaaactacattgatatgagttgctaaatattatccaatgcatttctttttctttttctttttcttttttttttttttttttgagacagagtctcatgctgttgccaggctggagtgcagtggtgcgatctcggctcactgcagtctccaactccctggttcaagcgattctcctgcctcagcctcccgagtagctgggattataggcacgtgccaccacacccagctaatttttgtatttttagtagagacagggtttcaccatgttggccaggatggtcttgatctcctgacctcataatccacccaccttggcctcccaaagtgctgggattacagatattaccaacatgattccagttcattaaagctgttctcgtggctgtgtttcatttttattaggacattagatagtttaattatatgacatccagtataatcaacttgagtaagatagtttgcaacgtatatattacattttataaaatggactaaaggcatatttggaaagatgagaacaccatatttatcaacaagtttttgcatctgcccagtgatataaagtaactcaggatcacaaagcaacaatatacataaattacagtaatcaaaatttatgttaagcacaggcagtgaattgtgtaagaataaagtatttttcatcagctgaacagttaccaagaatttagattcacagccttggctaaatgacccttccccacaggaagggttctgtggggttcctttattgccattcagtggtgcttgcttgagtagtttgaatctgcccatatgataggcaccttttttattgtataatgatcctggccaagtcatgcgattgggttgccaccttatgtctctagtaaagcaagacactaggatttgtgctgaaaggaaaagagatgcagaaagggcacactggaacttaaagattgctctgtgtgtgccagacacagacattgtaagggctgtggctttcccatcactcactatacttttccaatcaatatcgtcgtgaggtgactgcagtgatattatttcactgtgtcaaaaaatgaagtgacacctaataaaaatgcaaaggaaaaagctggaaaccaaaagaaaatggtttcatgcttcaaacacaggtagaatataataaaattatgggagatgatgtgtacttcaataaaagtttattaagctgaaagaaataatatggtgtagtataatttacttaattagcacctaattagtaagtaaatgtatttggttcttagatggtgaaccatctaggttcctgtaggataatgatggctgtcaaaatttgatctctccaaatatcctacagaaaaatcaacaaggagagtaaataaaactcttttcaagcaagcttacagaataactagcagaccaagaatactgcacattttaagatacttcttaatgggaaataagttacaggaaacctacacagccagttccaaagcccatgctggaaccagtgtaggcagagagagaagtgaaccagggagtgcagcaggattctcttggtggctgggcataaataagatcactcccaagagggagaagtactgagaacagctctggcagctggtggatgagaccactgtgtactagagaatcctaaggaagaatcttaaaggtatgcagagcagaagtgacagtcttgggtatgcactgcctcagcgggagattctcttagaggctgagaggtgaagggaataaaataagcagttggtagaaatttgaggtattaaagaaaggaatgagtatctgaaaatcatatgacttaccactccctttctggaaataatttttttaaatacattttattacaccgaaaaaacaaagttctattgacaacaacaacaataaaattcaaattcttctttcctagacagaccaattttcttgttattgaagaaaaccctcagataatttaaaataaatagaggaacatcaggctgtattcaaacaccattactataagaagaaaacaaaaagtaagtcttttttaatctgatgattatgattcccaaatacaacccacaactcagaagaaatattattaagcatttgcatatgtgaaagaacatttcagattgaaaatttaaaaactgaggagatgaattaaagaaaagctgaaggatgtggcataagagttgataaaatcaggaaattgaagagaaaggtacaccaaaagaggccaaagattttttttaaaatgaaagtaattggaaatcagctattaaaatatgaatctaaaaaaaagaagaaaaaagtgcaaaaacaaaacaaaagaaaaaaaacactaaaaaatttaaaaacataaaatgtgaatatataagaagaaattaataaccgtaatgttaagctgaattgcttgtaaatcatttaataagcataaaatattttgtagaatgacccacactttctccttcataaaaatataatggtctattatcagaggtgaggtacacatttgttttcagacagtacgacattcattaatgaattaaaaattgggaaatatttataaaatatttctttgatgatgtccagaaattgatcgtatacatattatgagggaaattattttgttgtaaatattttcattgcatgatatctgtccatacatatatatgtatatagatttttttttctccgaagactcaaatcttcttgagggaagactttgttctttatttatatttatatttccagaacatttcatgatgccacatgcatcctaggtgcacggttaaattaacatttgctgcctgaactgtagcatatatcaaccagctactacttaccttataactgcgatattcatatttttagtagagagaaacttgttattttattatgtcttgaaattcatggtgaacctggtgagtaagatcagagagggcgttgactgagcttggcagagaagcaagggggaagataggaaaagtgatgaaaagtcaagccctttgaaggctgtagtggtagggtatgagagaggagagggaaattttagagcttcttccatcaagcttagtaggagtcagcacatccatgtgggcacagagtgacagcaattcagaaaacaggcatggtggtggctgctcacactcagtttgtgacttccagatctgtaattaatataatgaattggacatagtctagttttatgacaatctatagcatgcatcttgtttcttgttacgagtttacaagttgtggctcagaattagtggttctactgtggaccatggggctttacctaggctgacaaggaggtaaagacatcttataccatgttaggcaccataatgacctgagatgtgcagcagctttctgttataggtgctgatgaactatgcttcaaaatggcttgaggctacataaccacattgctagtttttctcctcttgatgtatggtttgaccattccatggttagtaggtatacagaaaatgccttaaacattatgatgtttttattatagagaacagaagaaactctcaccaactgaacacttacatagcttataattcatccatggacaactcaaataaaacataacttgataaatataattgagtcccctcatgcattgaataaatttgggtcattttctaattctatcagaaccaggaaatgtaacaaaatccaactgtaatatgcttaagtagaaaaatatacctcagttaataatttaaaagagctgcatgtgtttatacaatgcctagccgttacatgtctcagaccattaaatctctatggcattatcacagtagttacctcatttccattgtacagatgaggaaactgagacataggttaatagcttactcaaaatcactcagatagtagctgccagggtttacattaagacagcgtggctcggtggggcgtggtggctcacgcctgtagtcctagcactttgggaggctgaggcgggcaggtcatctgagatcaggagttccagaccaccccagccaacatggtgaaatgctgtctctactaaaaatacaaaaattagccagacgtggtggtgtgtgcctgtaatctcagctacccaggaggatgaagcaggagaatcgctggaatctgggaggcagaggctactgtgaagccgagatcgcgccactgcactccagcctgggcacagagtgagactccatctcaaataaataaataaaaataaataaaaataaaaataaaagacagtctggctgtagtgtgtgtgccaaagtactgcagcacatttggtactttctacttaaaattgatttacacagtaaaagtgacagaccaacaatagaaagccaatgttttaattcattgtggaagaatcagtgatagcaatgactaaatttttaaatattatttgtcactgtttgacaatattattgtagacacactaaatttatatattttctaaaccagaattgagacaaatgagtaataaaaacttcccacagtctgtacatttagataaaacaggtaaaaaattaaaaagcaattatacttttgatgttattgttttttaaaaattaaataatgttttctagaaaattgttctatttaaaattctctttagctttgatccttccaaaattccaattaatgtcaattgaggtattgctgattttgaactcttcacttcttgagatctagaatatcgaaagtctggcctctttcttgcaatcagttctaatcagcagatatttattgaatgcctattaagtgcaacactgttactaagaaataaatatcttcaaataacatgcattcttgtagggaactttcattcttcaagatgatagaagaaatgtcacaaggtgaaatatgtgaattcatttccacatgaataaaacagacaggatgtactatggcatttctgaaggagaggggtctttatacttcagcattatggataaaaaaagttctcatggaaagaccaacttgaattaggcatttctaagaactttttaaccagtaactttaaaacactttccagctaagttgtagacttttgattttaacagacaggaatagaaaagatgtgataaaaagctcaaatttgagaatgaactatatcccagtaacagcattgagtgttgacaaaaagatgtgttcttttaaaaatcaaagcaatagatacacatagcttcagaataaaataatggcaataggtttataaacagagtcagcagacacctacctcattccctacctcccttggtattaacagggaaaaattctattaaatattaattttaatatttagctgtgtgtattaaaataatacagatatactgtcatttctaaatatatatacttatatatatttattttggacatgatctgttgattttttgttatagtacttactttgctcacttaaaaaaacatacacatacacacgtgtacatgagtgcctgtgcacacacacaagtacctcccctccatatatttctccaacaaattcattctgataagtttatggtgaggtgtattgtcagtattattgccgttattcccatgtgtctttttttctttctctatatagtctctgcttcctcctggtttgattatcctgcttgtttctattggactttctttttcatgttggaatacctgataatccctggttacgttctccattaagagtaaagcactgaaaagctctgtgtgcttggtgtggcggctggagaatgaagagagaaagtgataggctttccagctgctgagtgtgatcagtgaattggactaaaatctgtatggagggcctggcgcggtggctcatgcctgtaatcccagcactttgggaggctgaggcaggcagatcacgaggtcaagagttcaagaccagcctggctgatatggtgaaaccctatctctattaaaaatatgaaaaaactagccgggcttgggggtgcgtgcctgtagtcccagctactcaggaggctgaggcaggagaatcacttgaatccaggaagtggaggttgccatgaaccaagattgtgccactgcactccagcctggacaatagagggagactgtgtctcaaaaaaaaaaaaaaaaaaatctgtatggaggaggtcttacaaatattagtaaccacactttttgttttttttcttcaacttttcagttttggggtacatgtgcaggatatgcaagtgtgttacataggtaaacatgggccatggtggtttgttgcacagataaacccatcacctagacattaagcccagcatctactggttattcttcctgatgccctccttcctccctcccacacccccaacaggccctagtgtgtgttgttccccccatgtgtccatgtgttctcatcgttcagctcccacttacaagtgagaacatacagtgtttggatttctgtttttgcattagtttgctgaagataatggcttccagttccatccatgtccctgcaacagacacggtcttattccttttaatggctgcatagtattccatagtgcatatgtaccacattttctttatccagtctgtcattgttgggcatttgggttgattccatatttttgctattgtaaatagtgctgcagtatacatgtgtcattataatagaatgatttctattcatttgggtatatacccaataacagaattgctgtgtcagattggtatttctgcctctaaatctttgaggaattgctacagtgtcttccacaatggttgaactaatttacattcccaccaacagtgtaaaagcattcctatttcttcacaaccttgccagcacctgttgtttcttcagtttttaataattgtcattctgactgctgtgagatattttgattttgatttgcatttctctaatgatcagtgatgttgaggtttttttatatgtttgttggctgcatgaatgtcttcttttgagaagtatctgttcatgcgctttgcccactttttgatggggttgtttgttttttacttgtaaatttgtttaagttccttgttgactctggacattaggcttttttcagatggatttgatagattgcaaaaattttctcccattctgtaggttgtctgttcactcttaagatcatttcttttgctgtgcagaagctctttagtttaattagattccatttgtcaatttttgctcttgttacaattgcttttgacattttcatgatgaaatttttgcctgtgctatgttctgaatactgttgtctaagttttcttctagggttttcatagtcttgggttttacatttatgtctttaatccatcttgagttaacttttatataaggtgtaaggaaggggtccggtttcaattttatgcatatggctatccagttctcccagcaccatatattaaacagggaattctttccccattgctgaagatcagatggtttagatgtgaagtcttatttctgagttatctacctgttccattggtctatgtgtctgtttttgtaccaataccatgctgtttggttactgtagccttgtatagtttgaagttgggtagcatgatgcctccagcgtgtttttgttgttgttgttgttgtttcttatgattgacttggctatccaggctgtttttttgttctgtatgaatttgaaagtagttttttctaattctgtgaagaatgtcaatggtagtttaaagtgaataacattgaatctataaattacttagggcagtatggccattttagcaatattgatttttcctatccatgagcatggaatatttttccgtttgtttctgttctctctcacactttttttttttttttttttttgaggtctatcagtcagcttttcagagtggaacaatgtagttttcaatctgggaggtatgcatctctctactcatgttctggaagctagatgagaagaaacagcagagttaaatatgtagacatcagttaattactcactttcccaccctccatatgcatttattcatgttttaatttgcattgtgctttgctgtgccgagtttcctccaatccatgatctctcagattttctttttcaagagaatacccttctagctgggctggttagtcacagtgtagtggcatgaaagatcattacctggcttcacagagttggaatcttgcactataagttaggagtctgggaggatataagtcaggaggacatgcaccctctctttggcatttccctttgaagtcagacttagtcagttgctattattctaagacctttccatcaatgtaaatgaatataggtttcttacttgttcttgtctttctcctcttcattttttctatgtggcttagtaaattattttttttctttactaccatttagtggctttggggcaggggcaggagattaatcatgcatattcaattaaatagaagcaactatgtatcttattaatatgattaatatgattgctattccctataaattttccagtaatcctatgacattatcccatttagtggatgagtatattaagattcagctaaggttaagtgacttaccaaactgggtttgactcaaagatacagaaacataagaatacagaattcttaacattttaattaaggacaaaagtttagtattcttttcccttagataatatcttccaaataattttgatataccaagcaaacagtgtacatgaggttatacaacattccattatttccctttttacatttatctgaatacatcaccaaagtttctgaacaacctgagtagtcagaattgtaccacaggaaaagagtcttcttccttccagttttcaatgtcactttatgtcacatttctttaagctattctgaggtacaaaccattccactttttgcccactgtactgtcttacatctgctgcactatttctttttgtcaggacagcacctcatttccaggtcttagttgtctttgttgttaacccaattacctcaaaaactgcttcaaacaaaaatgatcatttattatctttcacattttgtggattacaaattcagacacatcacagtttctgtggatctgctgggagaatgaaaggtcaggagcttgaattatcagaggtttccttcacttatatctgaaggtggattcttgctgttagttgggacttgtgaagatggtgaagggtctgagattttgccagatatgtaaactatcatacatgctggcagaagacacaagattcctgagtcagagacaaaagactttattaattaaggcatagaagggagagtgattttcaagttcacgcaattacccttgttcttaagtcctacaaggggaacatggagtgactcaggtggatactgcacatatagtatatatgcttcatagatgagcaaccttgagcttggaaaatatcaatctttgcaatgggctggaagtgaacttccttgaactttgcactgaagggcaacatgatcctctgactggtcagtaaacaaatctacccttgctctagagagggacgctgtttctgtcttccagggttctctggtatgcaaaattctcggaaaggtaatctggaacaattgtctctgctagcaagatgtgcagaaacacaaaagactcattgagaagtttctcctcataaaatgaaaggaggacaatggactttaaacaataattggcagcttctgaagtgtcttttaggacagattcatatgaacaaataattttaccagattgtaaaaaatgtagaggaatttggactccttagattggtggtccaaatgaaaggctgataaattctgcttgggggccttgattcagagaagacttcaaatagaaaatgcttgaaaggagcaaattagataataaggaaatctttacatactctattgctgttcttattgttgttgtcattagctgtttaagcgtatgcatatgacttatcacatctaagatgcttgaatagttttggatagcatatattcataagaacatttgttaacattaaagtaaacttctagcctggagaagggtagactcaggggtatgcatgatagcatgtttaaataatctgaaggaatgctgtagggtgggtggagtgacaggtttaaactgctccagaatacagaatcaggatcaatgaataaaggttatgagaaggctgatttaccctcactacaaagaagaacctttcaataattaaagcacagcctgggaggaatcttaattgacaaagagaaagtgcagctttgaaagcaaatgcagagagagcttcacagaaaagagagcatggaaaaatcaagccctgaataatgtaatatcatgtgttggtattcagaagccaaaggaagatggtaaaatggtagcagtgacagtggtcctgggagagagatgttctttggataatttcataattgggtaattatgccaagaacacatgtgtacccccaagaggtagacaacagcaccagtgaagacagatggagctgacttagagtgagcttttcccttccttcctcaccctgcctcattctctctctttccttccctttattacttttcccccactttcacgatataaatatctactttgtgtcagacactatgctcagacctaaggctatagtagtgaatagaaactgtttttaccttcaagaaacttacaagttagtaagagaaacaaaacaaatatatgacaacaaatcataataatttgcaagggagattttcaaggaagaaacttacaagggacaaccaaattagattgaaagactagaaaagcttccctgaagaagtgatatttaagctgagatgtaattccaagtaagaattttccaggtatagaaagaagggattgctatggaaaatatgataggaaagaccttctcacaataagaaactgccagaaggccaatgtggttggaaaaaagcgcctgtggataaatgatctgagaagagactggagacttaagcaggatcctaaagcagaactgggcttctgcttagaggactgattggtgatgaggaggtgtatagagggctgaccctccaggaggctgttgccacagtccaggtgtggtatgtaccaaatacctggatgtggaggaggagagacatgggtggatgcttttccacaccaataagtaaaacaactgaccaatctccaagcaaaaaaaaagtgatcatccatcagtattattttctaattgccatcaaatgtctatgaccctcagaaagcatgatggttaacaatacagactttggagtgagattggctatgtccagatcctagcttttgtatttactagttgcatgaacttgtgcagtctggccttcagtgcatatacctgtaacataagctgcatagacatgtctgttttatagggttagtgaaattatccaaatggcgattatccaaatcacgatggtgatttatggaaagacatcacaggcaaagtatacaagtttctttaaagaagttaacaagaactgaactgggtagaaatggttgtacaaagccagaagctttccacattattcctattagaggagcaaatatcccatgccattcaagtatgtcaaatgtgccctagcatttattggaccattaggtttttcttggtgtttctttatcattcttctgtgatgtcttaaacccttttggtttgttttaatatttatgtatttcttaagaggtacatgtaactggtaggcacactgccaacacattactgaatttttctcaaggttaccataccaagtgtattatcctttagcaggccaaatattaggttttcttgaagtttattcctgcaagtttgtgcaacaatttaatgacacattttaaatttaaaaaaaaaaaagaaaaaaaaacttggtgcaaacctggaaatttgtaaatatagaataggacgcaggctttaattactagtgaattgttaaataaatctgtttggtttagttttggttattctaaattctattctaaaaagaatttcttgtattattttccaagagcttataataaagtaccccttcaagtgtaataatacagacacgtctaatcgaagtgagccagctcaccatctgctcacagttctgctacttaagcagtgataacactaaaaacagtctgccagagtttcagttatgcaaataaaataaatggtgggactcagactatcctagctttgcattaatttgtgtgtcttcagaatgacaccaaagtagaaacagttcttctgtgtattatgtcaaaggaatatattttataaaagctctctgtcaagtggaaaattagtttcaagatataaacagtttttgtgcttaagtttactaaactaataaattttaatcatgataattacaacaataatatacataaataaggtacgtacagcttattcctcctttaatttgcttaggggagggctttatgtacctgagaggaaaaaataggaggattaccaatttatatgcttggtaccaaaatatgtgattaaatttagttggctacatcaggccatcatgagatatctctttaggatgctcataaataaattggccaggtgtaggcttacagcctgaacaacatttcagggggcttatgggagtaaatagaagtaaagattagtcagtagtagtcctattcagcaactttatcaaacctggaccaaataatctcctgataggcaaacaatgccgtgtctttcccaagggatagcacttgatgtgtccctcttagtacacctaagagctctttgtggtcagaattcatacatcattaatgattgttctaatattgtttccacaaaatggtaacagcagtaatttgatgctgtcttttgttgcaaatatagtctgcttttgcgtaatccttagtcatcttgtattctccaccaaaactttctctcctgcttttagatttacattgtgaggctgtagatggagaaaacattcttcctctcactcttctttcttgttatctgttctgatgctattggacattttgggttgagaatctatcatattgaatgttggcatgaaatctgtgcattattcaaactcatatttaactcatatttatatgcttccaaaatgaaagcatataagtagcagcagtttcattttgtggaaggatttacattttccttttgagttacagaatataaggaagaaaatcaacaaagtcttcagagacttgatgttttaaaggtagcttgaaatacctcaaacataaattatccagcttgattatgtcaagaaaaaaagaaagaaatatcactttgtagtcatggttctctttttatatatttgtttattttgtagtcatggaacgagcatttcttgaacaaaagtagttattcattatgataaaagggtcaatattattttaaaaagaactgtgttggcaatattgaggcagcgtaaaacaatattggaattatttaaaatattgaaaaatacaaaggagatgatattcaagaaaccctaacgtcacaaaattgggtaaggaattaaaggaagattgcctggaacttgataaattaaattaaaaagttgttatttatgttgttcctttttcctactataatttcactgtatttagccaggcacagtcagctaacctgttagattgctgtaaaatttgcaagacaaaacttgtacaagagtttagataaatgtttagacctgacctatctgagttctacatcattgagaagaaaacatagtataaccctcatttaaaatctctcctttaagatagtccagcaacttatatccataagcaattaaaatttgtaactttatcaaaccatttttgaaataagtgattcttttaactttatttttacaattctacaattttaaaagccaaaacacaattacttgagggaagtgataaaggtgaatgaggaatcctatagtcttgaaactgaaaaatagttgagtacatattttctctgcactttatggaagactaaactgaattctagaaaatcagaagatgcctctagattgttttcaagccaagaccacatgggcatcttgatgtcttagagagtatatattctactgcactatactacatgtagaagattctaagtccattgaaaaaaattaccagggagagaaaatataaaataaataatagtacctggagttaatgtattgttaattttgagttcaaaggttttttttttcctatatgcacataaccaagctattaataataaaataacaagaagatataaaaaggtgatttttttttagtaagtaaagtattttgaaaaatgttccaaaatttataaaaatattggtatgggatttctaattttattcgtgtttcagattaatttattacaatatccagtgtcctgctttattaaacagctgagacaatacagaaaggaaaactagaaattaaattatctatttatgccttttaattttagggaaacagaggcttcatagcactcaaaaaatttattatggccgtcaaacagcggttcacaatagtgttctaaaatttaaaaaaatctttttgaacttcacattacaatgagcaactgagcagatggtactaagaaaagcttcaggtgtgtcttcctcttttatacatattttgtttaatttatattgaaatgcagtccagagatgttatgtttcgtttttattttattttatttttattttttttgagacagagttttgctcccattgcccaggctggagtgcagtggcatgatctcagctcactgcaacctctgcctcctgggttcaagcgattcttctgcctcagcctcctgagtagctgggattacaagtgtccaccacccagagacataatggccatttttgatattgttatggacaaaactttgattggtatattaattataggcaatttcaagatagaagtatagaattatgtgaatttttgcttagaagaaaatgaaagcaaataacacatacatgctgctgaattgcttcaaaaaattatatgcaaaaattgacgctgtagtcaatgctggttttccttagtatgaaaaaggtgacttttcagtctatcatgtactttcttggagacttttactaaagatttatctgcaaattaatggaaaaatagggtgtaatgaataaaaaaagagaaccaaacagccccattttcactccctcaacctttggctagaaagtaagtattctaaaagttatactttggaaccatatctcctgggttgatcttctactcagttttagcatgtcagttgatttttattccttcttgcacagttatttgttcccaattcttcaatattaaataggttcttaaaattcgaaaaggagtaatggtgaaacagtgtttccaaaacacaacatgacaggtaaggagttctaagaaacatttacaagttatttttgactgagaatgccttttttacttcctacactcttgtataaatgtagatggggaaggcattattattttctttacataattaagaaaaccgaagcagataacatattaaatgatggcttttgcagcatcaaggttgtgaaatgtagacctcagaggaggactcagaaattctgctgtccagatcaagtttccattctatttctgcaaagatactgtcttgggatacagaaacaaagttgttagtatatttattataaattttgataggaatttactttcattgtcaaatagtaaatatgctgactcttacataataaaattgtctccttgacaccacttttgaattacggtcattttctggcagtgcaaactgttattttttttttgaaagaagcaagttctatctaattttagagtctagagtctatttagactgatactaaacaaacacacccattaaaaaacattccactttgtctgaaattgatatatttgtccttgagtgtacatttcgccttacctttgtatgacattttcttttatggtgtttttgaaaactgcatatagttgatttttattcacaatctgaaaatatttgtattttaataagggcattaatccattgacttttactgtcacagctgataggctgttatatttgctgttttgattcgtgccttttgttttttgtgtgtattattacatttgtttttttcttttaatatgtggaatttattttcatttctttttttttctctaatgattggggggaagttttagaaagatttattttccttttcaaattctcctggtagttccattttagttttttgtttgtttgtttctttacttaatacttgaacctatatttctctattaatgttaatgaggatattatatcaacttaatgtatattaaatgggggaatctgtactctttacttcccctatgcccttaactcacttgtttcacaggttttgttgatatatccttatataacatggaaccgttatatttttatctttgagtccaaaatttttacaattacattttgtggtgcaccctatttgtgacaaacattgagagaaacctccgcattttcactgttttcaacatagtctaccaacacttaataaactaggtcttccctattactatcatttattttatttataggtagccagtgctcattttttgatatatttttcagagttacatgaagatattatatcagaaatcaaattattttgcttcagacacaaattaaatattaattagttataaaattctccataaactagaggttaaagaaaactcacaaacgcctacacggtacaagctggaaatgtaaattgtgaaatatgcctaatgtaagatcataggtaaagtctatagcatgatgcaaaggcgcagacctattctgaaggcattcatattcaactatgtatttttaagcttggatagaaaaaagaaatgacaacaggccatttagggtcacagatagctagcgttcctgtagacattgcttgcgtgatctttatcatttagtggtgaagagaagtctgaggcaagtgtgattcctggtgcacatgacctgcttttctctacctgacttttttcattatcctcaaagaactagaaaaaaatccctgaaataggcctaactgttgatggtttttaattaagttgatgtataattgataaccccttcagttttgaaggttagcattccaaataaattatttaatttttgaatgttgtgtctgtgccatgtgttctgctgttttctttaagaacatcaatatcctatgtttcatttgcttccacatagctttatttccttgcataatgtgagagtcttctcatttgtaatttatattgtaggtttagttttctacataaggactttgtgtatggcttctgattttgtttttgccattgtacttatgttgactaaaactacttctttaacagcctgtgccctttatttgatatatacatacctttcaaccaatattactgcccttcttataaatatgcgtttgtgtgtatgtgtctgtgtgtagttctgcagtttttttttttttttttttttttttttttttgagacagaatctcgctctgttgcccaggctggaatgcagtggtgcgatctcagctcacttcaacctccaccttccgggttcaagctattctcctgcctcagcttccctagtagctgagattataggtgtgtgccaccacgccaggctaatttttgtatttttttttttttttttagtagagatgggttttcaccatgttggccaggatggtctacatctcccaatctcgtgatccgcctgcctcagcctctcaaagtgctaggattacaggcgtgagccactgcacctggccctgtagtctcattttactttatttactgttgaatgaagaggactttccatgtctgttatttgaatagtaattgattgagaaaggttctaattgtcctgctcttcaacccccggggtgctgttacagttcttgtatcagaccttaaaatagaaaagaagttgacaggtaaacattcacatcatcctttttggatcttgtttttgcataggtataggtctcttgaattaggaaatctctcagttacctctgtctgtctaggtagagtagaatttatgcttggataatttaaaacagtatttcttcctctgacactgttgatacagaaaagcactctcacagtttttcattgcttcatccttgcctactgccaatctcttattccaacatgtgacatactattgcctctccacttcagctcaatccatattgtctatctggaaactggtgttgctgaatagctgaaaatattatttctcatatttttgtaaataggttgacaaatgcatcatgatatgttcagcactgtactggttttagcactgtaaatctcaagtcctggggaccgccacagttttaggcaaaccaaataattgtccactttataagcaaccataaaatataaacttcccagagattgtaacttctagtagaccatgttccttttacctcattactaacattatttgcctttttaatatcaacactagctaagttaattttatcttctgttgtatatatttttaaaaagcagtaaactattttttgctttaaagatataagattaaattataatattaaatgtacttgttcaaattgttggtaccactctaactgaagcaattctgaaacttggctagcctgccctcaaataatgtagtcagagaagtacaaatggaaggaaagtaaagatgaaattttgtctccttggctagctgttctataaaagtctgtgggatctgcaagccctgtgatcagtgaaacccttgtgcctttgacactgggacatgtcatggtaggaggggtgagtaaattttcctttacttggatttagcttgagtatctttcctgagggctccaattgcctttggcttgtgaaaattttcctgagttctacaaattaatatgtgggaatgccaaagtttgtgtgtgtgggagtgagggtggtgtcaaatggaatgaaaaagtgaagatgtaatagttcgttttcacactgctataaagaactacccaagactgggtaatttatgaaaaaaaaaaaaaagaggtttaattgactcacagctcaccatggctggggaagcttcaggaaacttagaatcatggctgaagacgaacggggaacaagggaccttcttcacaaggtggcaggaagaatgatgaatgcaggaggaactaccaaacaatcataaaaccatcagatgtcgtgagtgagctcttatgacaacacgaacagcatgggggaaactgcttccatgatccaattatctccacctcgtctctcccttgacatctgggcattatggggattatggggttacaatcaaaatgagattttgggttgggacacagccaaaccatatcagaagggtaagtcagtttcgtatcacaaaatgatatgtgcttaaactgaaagtcttaattatttaaaaaaacttatttcagtaaatatttgcagaataatttgtatatgtaagctactatgctagaatgtgtaggacataaaaatttagatatagactctgcctttacagaactttcttatagtaagagttaccaaacccactgcaaagtctgaaatgtcatgtaaaagtaatttgaaagtgctgaaaaaatatagattatttttgattggtgaagatcatggaaaaattagttaagataatattaaaagatatattgaatttaaattgacagaatttggggaaacatctcaaacccttagaataatatgtgaactgggtaagttcaggatgtatttggaaattcaaaagaacctgttttaactggtgcttcagatcattgatggaagttagtgcaaatttttctggaaagtttggtcaggaccagtgggtgcagagatttgaaatccagatttaagagtctgacattttttttaatcacttgaactttttcacggagaaactgtgccctgtttatctttctattcatcaaacattgccgcagaataaacactcaataaatatttgtgcaaaaataaattactaatgacataatagctgcacatctgaaatgactgtgtctgtgtttacatgcacttatgtagagttttccccggaaaatttatttacatttttcaaaaccaattatatggaaatgaatgaatgaatgagatattgcatataatttcactgtagactaaattagaagatattttttcccttttataaccaggagcataactaaggataccacttagcaaaattattatgattatgagtaaggtttcatttaaaaatattttgaaaggcatagacagagtatcatgaaataatctgggtgattgtaaaataaacaatttgcacaattacaggtccaccgaaggccagagctgcaaagggtatgtctgattgctggtgaagggtataattatctctgaggttgggaagggttatatgtgctggcttgtttgccaacatctgtcagctgtttctgtgtaccacattttctgttctagttttgagtcttaatataaagtcttcaaatattcctggcaagagtagagttatgtatatgcaaaaatatattcaggtttgtctcttaacatatgttcttacacagagaataacatttctactttctgaacaacatttttaattttctagcagaaacctgtattttgctacctattttcattaattcaagttgtgttcttatatcgaatagcaggtaaggggcttcctatgtaccaactgagagtgatttacattaaaagacattccagacataaaatcatttctgaaggttatacttcctgtcctgaggacttttagagtaattttggcactacttgatgtccttatcttggctgtatccttaaaatagtaggctctcatgcagctgtggtagagcaagtgaactggacttaggtaacagaaatttgtctgaatcagggcaatgttatttattgactttgtaactttcaacaaatgagttaacctctttgtgtctcaattcacttttcttattctaagggccttaaatgaattaacttatttaattctcagacaactctagggaatggtaccacaacggtcatgctcactttctaaattaggaaactgaagtagaaagaggttaagtaatttacccagacaggtgaatgcaagcataagaattgaatcgggcttctgtcccctgatccataactttacccacgttcttctgtgtctcgctaatattatctattttattattttgaggattaaatgagataatttctggccatggcagatatttattatattggtttaatatacttattaaacaaatataaccacgatataaatataatatattcattaaaccaatataaaatattaaaccaagattttatattggtttaataaatatactgataagatatttattattttggatatttattagtttttttactcttgagtataaactttggagaattcgagattttttttaaagttaatttttttacaacaaaaattattcttgataaacttgctgagaaaaagattgcgtgaatcatctggtcagtaaatgcaattagaaaatgttcaggtggttggtagagccccactttcagcatgaattgctttatagagcattaggtcacagattattgaatcttataattacagaagaaaatttatgcaggatttcattgtttttgactacttaaattccagttaccactggctatgcctggagttgaagggtcatacttaagagcaaagacactttgacaaaatgaagacccacttaattacttaatgggactgcaaaataccaggtgcagccataaaatgctaaaagttcatagcaggaaaaccttttggtgttacaaattttcatcaacatcgtcatggagatattaacatatgccttctaaaaccaggtcagaaattacatcatgcctggtttgtggccagttgttggcaggctaggagtaactctagagcgttaggcaacagacacttgtcatactcaaagcatcttttctctgtgtgattgcataagctatctaactggaaaggtacgactcctgaagctgcattggcttggttttcccagtgaaaatttaaaataggcaaaaatgtttgctacaaacatcagtttgtggatatttaaaacttatttgctatttaaagaacaaattattttgtgaaaaaaagaactgtcatttctagatgagactatttggataaaactgcctttaagcaagttggatagtaacaggaaaatatttcagggacaaatagaaataaaaaaggagttttggactactgaatttagagttcttgttgggtatctacacgaaaattctagaagatatctagacatacagttcttgaacttggaaacagcttatttggtgtctgaagcctgggggccgaagtagccacatgtacgtagtgttgtttatcaggtgttcaataaggtggaggattgtggtggtggggtttacttgtggtcctcttcctttatctgtttgtctcatcagtaatttagatgagcacagataacatgggtgagtttctcaggatttcaaatatcataaaaatgcgtggcataattaatatatgacaaaatcagaattcagtaaattttgactagaatcagtgtcaacaaagtgaaaatttaaaggaatagatattaaattctacatttacattgaaacagtaaatacagtcctgcagaaagattagtgaagccacactttaaagtgcttagttgaagatgaactaggtgttcttttgattacttttttttttctcacaagtggcttctacaactcctcctccttgcccaaataaacaagttgcagtatttgattgtatcaaaaaaaggcattctttctataatttatgtctgggactttgcatattgtttctaattctcattcttaagattgtaatacagtcagagaaattacagtagttttaatggttggaaagtagattatttgctgtaaagatgatatatagatgttttaagaatttttttaccagggtgatattgggtgcatataattcaacgattgttactgtattgcctttccccacagtcactttttaacattttcccgcaaactcattcacatcattgtctttgaaagttcaggtctagagatacctcctctgtgaggacttccttaatattcccaggtgtgaaccaatccctcttttgtgttctctttgtgtttctgttctatctttattgttttaggacttaccatattgaaagacattaatttattgatacttgcgtctgtctcctctagactgcaagggatgtgagaactcagacctcatcttactaacatgttatttatgtctgtggcctaagtcttagctcatttctgacaatatgcttttgtaccaaattgaactgggggcataatagaaatgttccatcgttctctggaggaaagaaatagggccagagggcagaagtgacaaggacacagattatttaagctcattactaataattagagctgtctgaaaatgaaatgacccgcctttacaatgtaggtcaagcacaaggtgaatgataatgcagaagaaatgttgcatagcctgacctctaaattcccctccaacttctgtattccatgccttacatttttctcttgtgttattaactaccctcacaggtagtcttcaaaagcactttcatatatgttatctcatttatttgaacaaatttcctgtgatgtatgtagggacaggtattatcattctaattgttcagtaaaatgaggcataaagaagttaagcgacttgaacagggatactcagcattaaatgtgagaccagaatacaatcttcctcatggcagtttagtaatttttttagatgaactatctgaaattatcaagtttgcacattttgggggacatagtgattcaaatattcattaaataatatgtttttcctgattatgcttgtatacagccttgtgtttttgtgatcaaactactgtttatctttttatcccacctttaattttcatacttactgatgattctcaacagccagaaaaacaacagaaaagtgtataatataaaacttagtgcctaaaaaaagcagtgataacatgctgtgtgtttcagcagtctggttgtgtgatggaagctcatgaatacacacactgcgttccctttcaggatccccaagaacggagaccaggctgttgcaatttgctcatctgatttagcagggatatctgagttcactgtattccctggaaaggctaaagatacagaagagtcattctggcttgcattaaaaactgactgtgtattttattttattatggtctatctgggtctggtctggcagctatacaagaaggattgcacttacaagttagatatttcctgaagaagagttaagaccatgtgagaaaagttaaccgattatttctgatacttttttctgtaaaagaaaccacattagccccagaaacatgcaatttacccatgaaacaaagctgcacatgtgcctccagaacctaaaataaaagttggaagaaaaaaatagaaactgccttaaaatttagtggcttaacacactggcaattattttttctcatgatgatgtgtatttattgttcctgtcccaggaacaagaccacttagagtggtctcaggtgtgatcgctcatgcagctacaagtcagctggtggtcgggctgtggtgtcagctgaagccccttagttctcctctatgtggcctgctcagacagctagtttgtgccaagttctcagagagagaacatggaagctgccagcctgattaaggctcagactctgaagtacaggaatgtcactttagtcacgttctcttgatcacagcaagtcaagtcactagcccagctcaaattaaagaggagaagttgccttttgaagagaggagcaatatgcatgaaagggataaggagaattgatggtggccactgttggtgaccatagttgcatgtagcctattaccatgacctactaggaaaacagtaacattcagaaagatgtgagttctggaatagcattgctaattttcaagatcatagaaccagttacctaaaaatcatatgaatggtgtttctcctctatatgttgattaaaagccctaaaacaccaaatttcttggagtaaaccaatttgtgattaattctgttgttacagttatgctttactatttatgtagcaatttttgtaattttgagtgtgataaacattttctgataagtggcagatgacaattttgggatcttgaatttttatgatctatatatttattgtttaaccgtttttgctgccttaagatacttaattatgtttaaatatggtttgtcccactaactttgtgtaactacagtagttatttacaggtttttttttttataatttactctttgattaattcctaagttttattcaggtggaattaatttttaagattcctttaaaaatatctgatttagttataaattatctcagcaaaatcatgaattgcatttgcttttaccacttcttatcaatattgatagagtttggctgtgtcgccacaaaaatctcatctttaattgtagttcccataatccccacgtgtggtggaagggaccaggtggagataatagaatcatgggggcggtttctcccatcctttcctccttatagtaagttctgaggagatctggtggttttacaatggacttctcccttttgcactgcacttctccttgcatctaccatatgaagaaggacatgtttgcttccccttctgccatgattatatgtttcctaaggcctccccagccctgcaaaaccgtgagtcaattaaacctctttccttacccagtctcaggccgttctttatagcagcatgagaatggactgatataaatatttaacaaatgttcagttttttttctatagaacactattttgaaatctgaatatatggctttcaatatgaatccaaatcatctgagcttgcttttattaattttaccttgatttattcattttctagacaatcaatgcatgcaaattttatttttaatatgttttattactttatttgtgatatggaattagaatagcaatcttagtgtttttaagatgtatatcttaaaaactttaagctgcatttttgaagttcatcacattaattcagatttcataatttaaaaaaataaaattcactattgctcaattgccttgcaatagacttcacataataaagacacttgacagaggaaattttgtgtcatcacttattaaactcaaagttatataaaaaatgttcttctacatcactaccatactcagaatattctcatggcaataaattcagctctgttctgttgatagaaatttgtatgacaccagtgaatgtggagtcatggttccagaacagggatttttgatatgttttctgttggtagatgttattaattttagtgtttaaagcctagtcctctgatttaacatttcattctggcaactgtgttatttcacgagtggaaaaatatagtgcactttttttaaaatcatggtttttatatgcataagagtgtttgttctgattcacaatggaaactcaaaataacatttcaagtttccttatgtgcaaagactatttacaaatctaaactgaaaacagacaatctttcaatgtgttatcaaaatgtttatagtttctttttctggagatgccaaatgataattattgaataaaattctaatctgttgagcatttctgtaaataaaaagtgaataaaactatgatttgttgttttttataaatgttttataatgaatgataatacatttacatataatttaacaaattgtcctatcctgttctgtaaaataactggcctgaattacttttatagacttttgatacatagaaataatgtttttacattcttaggtgaattatatagaatattctgcaactagagttgtccaacctgttggtgatctattaatgggtcatgaaatcaactttgttggttaaacttggcattaccaaaaaggaatcaaattgactaaaatagatcagagtgaagaatagtagaatacataggtgtgcagtaaagagtagattttatttcatgaagattttgtttcacttttatacatctatgtgtggttggtcactgtaaaatatgcctctagctaagggtaatggtcaaatcaattggaaaggtacctgttgagaagtgtctctagttttttaataacaagattaaatttcattattgaactaagtctagtgtttctagctgtaatttgatcagccacagactgttttaaaatatactatcctgacttctccaaaatgcaatatatcaatgtagcaaaattccacttataccttatgaatatatgcaaataaaataaagattagctattattaattgggaaaagtgtgaaattttggtcttcaaagttctaagtaaatatttgcctcctgtattaaatgctttctttgatactaaaatgcctgggactcatgtattgatttacctcaaatttctcagtttattactcataaccatagaacagttgtctgtcatacttgaagtattttgacagaaaacttcccatgtgtaagagttaatgtgttgacttacacaacaggaagtgttacaacattaaaaaatagcaagtttctattacttgtatgttgtgacatgacaagttactttcagaatgaggtgaagtataatgtataaaaaatctatatagtaaaaatgcaaattccctcattctgaatgcaatttaaataattattgtggttaaaaatctgtagttgttaaccaaaggttaatctattaggttagtattgaagacggattttttattttttatttttcatttttatttttagtgctggggtacatgtgcaggatgtgcaggtttgttacataggttaacgtgtgccataatggtttgctgcacctatgaacccatcacctcaggtattaagctcagcatctattagctatttctcctaatactctatccttccccgacctcaccccgacacaacaggcccaagtgtgggttgttcctctccctgtgtccatgtgatctcattgttcatctcccacttataagtgagaacatgtggtgtttggttttctattcctgcattagtttgttgaggataatggcttccagcttcatccatgtccctgcaaaggacatgatctcattcttttttatggttgcatagtattccatggtatatatgtaccacattttctttatccattctatcattgatgggcatttgggttgattccttgtccttgctattgtgaatagtgctgcagtgaacatatgcatgcatgtatctttgtaatagaatgatttatattcctttgggtatgtatccaataatggaattgctgggtcagatagtatttctggtgctaggtccttgaggaattgccacattatcttccaaaatggttgaactaatttacactcccactaacagtgtaaaagcattcctatttctccaccacctcaccagcatctgttgtttcttggctttttaataatggccattctgactggtgtgagatggtgtctcattgtggtttttatttgtatttctctaatgatcagtgatgttgagcttttttcatatgtttcgtggttgcatgaatgtcacttgagatgtgtctgtgtccgttgcccactttttaatggttttttttttttttttttgtaaatttgtttgagttccttgtagattctggatattaggcctttgttgcataaatagatttcaaagattttctcctactctgttagttgtctgttcactctgatgatagtttctttggctgtgcagaagctctttagtttaattagattttttaaattcttagtaattgatcagtcatataattgtaccttggtttagtatactgctgaaacaccaaaggtatgattctctcttcaagagactaacattttaattgaggagataaaattaaaactcatgcaatatgtgagctcttgaaatcaacaatgactgatgtttatatttataactcttatatcttcagtagtttctttaacaaaacctcagtattgttgaatgaatggattattgaatgaattgatttacatgatgtaggaaaactgtggtaatgtctaaaatttaacatgtagttagagaatgaaggagctaatatgatctcaagttgttagaaaaagtattaaaggcagtcagattagatctgaatgctaatgactagtctgatgtgttctagattagggggaactgcataagcaaaagtgctgtcatgagctagatgtgcttgtaaagcctgccctaatctgcctcttttctttttctagagaaagataatctttttcatagtccttgttggtgtacacatattaacagccccctaaagttgtctgtaccctaatcctcagaacctgtgaatgccaccttacatacaaaaggtaatttgaagatctgattaaggatatggacgttgagatgggtaaattatcctggactacacaggtgggctcagatgaatcacatgagtccttaatgtagataatctttccagttgtggccagaaagagatactatgacagagggaagaacaattccaactgtgagagatacccaacctgccgttactggctttctagatgcaggaaagggccctgaggcaaggaatggtgggtggcatctaaaagctgggacaggccctcagctgacagccaggaaggagacagggacctcagtgctacacccagatggaagtgaatcctaccagtaacctgatgattaaggaaagtggtgcttctctagagccacccgaaaggaacacagccatgtgaaactgattttagcctgatgaaaccaatgtcagactgtgatatacagaactgtaaaataaaaaacttggattgtttaaaacactaaatttgtggttaatttgcaatagcagcatataccccatcacagtgatggttcaggcagctgataactctgtgattggtttgatagtaccatcctttacctaatcgttcctgaatctgtcactcaccaccttctatacacaaacctataattttttatcaagatgagatattgcaatatttgagtagttccaattctcatattcatccctttctttcctttcctgtacccacagtcctaatcctgggctcatcacatcttgacttgctaagtacatgagcctccttttaaataaattttttaaaactccttttgaacttgttgcttcccaagtcaagaactttaaatgattccttgacgttaatagcctcctctgtggtatagctttcaaggtactctgcagcctggtttcaacttacatttattatgtctcatatctcagtatatttctacagaaatcatcttacctagccaacttggctccttcagaattccccaaatatacctcttggttttttgccagtgtgatttttttttttgcctgtctcattcctctcaccttcaatgtatttacttcctggcatactttgcgaattcaaaccctagttctcttttgtttagtgtctttcaaattagcaaaagttttgcccctggaatagattatgctcctattatcttaataacaatgaaaaggaaacttcagagctccaagagaatgagaccaatgaaatcatgtttcctttcttccctatgaaatgtaatgtcagatagtatttcgatttttccaaaatcattttcctgtttagtcctgaaggcaggaatctgcaaatatcaaactatcctagacttcacagctgggtcagacagatcaggctagccctctggcaaggggtgttttgaccctttgtttttcattacttttcctagacagagattgagagttcctggtgaaatcaaattacaacctcagtaggtaaatgccagtcctttaaattgatgtgagaatcacgcctgtaatcccagcactttgggaggccgaggcgggcggatcacgaggtcaggagatcgagaccatccgggctaacacggtgaaaccccgtctctactaaaaatacaaaaaattagccgggcgtggtagcgggcgcctgtagtcccagctactcgggaggctgaggcaggagaatggcgtgaacccgggaggcggagcttgcagtgagccgagatcgcgccactgcactccagcctgggcgacagagcgagactccgtctcaaaaaaaaaaaaaaaaaaaaaaattgatgtgagaaacaaagggatacctatctccctgatgagtattcagggacttatactgagagagcgtataaacatgaggacttaagcagcggatgtgctcattattcactcccagagcagatctgcaggaatcttaacaggaaagggcagagtgatcttgcttggcagtcttgctaaaggaaaatgaccaaaatctattcttttcctctttcaaataagaaagaaaaattatttcatagtgatctatgagttttaggatgcctttattttcctgagaatccctcaaaatatccacttcaaatattaaacattttgatcccgattgtaaactccagaagcctctaacacctgaagcatgcattgatgaacttaaccgtgaattggctgatgagactcatgatctttcattcttatttaaattatatattgtgttttaattattacctccttttgttacatttccttaagcaaattataagttctttgatggtaggaccttatccttattttttgctgtattcataacggtgcacacagaactatcactcaaataatgtttactaaatatttacctcaagtcaagcacgcttctgcctatgttacgccatgtcttgcctatgttaagttctttttctcctgcctggaataccatttaaaactatctgctaccaagaaagccacaccctttcagcagacccagagaactacagccaaaaaaacaaactgtttattagttgaatattttacagacgtctctgcgctggatccaataccttataaaatccttgattggtctaaaatagtttaaagtttgggcacaagaattgagaggtgtttttttgttgttgttgtttttaaagcagagtttatataaatcctatcactgcaattgaaatcaaagcagagagaattccaagaactttgactatgctagattcagtatcaggcagtctaggctaccctatcatttgttttattttactgaatgcttgctaaaatgactatcagtgttaaaacattaaacttgctccacttgttcaggtcattaaagaataggtaataaacaatatggttgatatgaagaatagaggaaaactactttgaatatccctgagaataaaataaacaatttgtgatggctgggagctgtacagctaatcctatatgacatgaagctatcagaaataggttacatcttttttagcaaatggcttcacaaggttgagactcaacgagacagtcagacacagtgagaggttcttgaaacagtttcagtcataaaccagtgacaacattccgtatatttataggggccatttagagggccattagctgacttctgcccttttcagtcatacctgcatacttgaaatcacctccatgagagacttcacttttaaaactcattggcaatttaatatgtaatatgtaggttcaattctagtgttttcaggaaatagagtaagctcagtctaaagtcaaatcaagtcaaatcacataataaatagtaatattaataagaaagagtaataattgcattattgtgtagtttattgtattacttggaatttctgtttcaccaaaacacagaaatacctcttttacaaattagttaagatacgcggaactacattatagtatagctaccattttcaatattaattggaggtacaaatggagacagaggtcattttagggttactcctttctactgagagtgattgttttatctagtccattcaagcaatttctataacaaagtattaatagctgccatgtgctgtagccttctgaagtaagtgagaaaactgcatgggtcttttggtatcccgtatttaataaatgttcattctttggaatataagttcccataaggcaagggaagcatatcatatatgagaaagaattttaaaagcttgaatgttatgcgataatctactagcatatacagtcaaattaagggtatttttaaaagtcactataacatgcccactactaaatatgatagatctagaagataaaagagtactgagtagtaagtactgagcataaatggtgaaatcacattgcatttacagatgtaataaacttctagtgttgcttcttttcaggtaatgagcttgtaattcattatttttctaaatattttaggtctttcaagagcaatacctcttattttacactattgaaattatataattaatatgggaaagaatgactccactgcataatgatactagaattatagtggtgaatatagattaaattaccaactaattaatttgaaatttatggactggtggccactagtgccatggcacactgaatgctttagtaagcaattgcattattcaacagaagtcttagtgggagtgattgacaaatgtgggatgcaggtctcctattatgaatacagattatgaatcagaggtagaatttttatcttgtgaatgattatatcttgtgaaatatattatttgttgtctgatttaaacctactttgttttggctctctgttctttcagtttcaattccattatctattttaagttctttaggaattataaaccacatgctgtcaatgacaggaaaacactgcccattaagtttaatgaatcattcagactgattttcaatggctgagaaatatcaaagtggcttcagtaatgtatgtaatgtgtagaaaatctaagtataattcttaagaaagatcatcaactctgagtgtttgtgatataatactgtatgtatggttaatattttttctgtttttataaatatttcctaggagaaataggttctaatattgtggatcataggaaaaaaatccaaatatattattagaaaatgtatttaaaactaatactatagaagtttagttgaaactcattatttgattattaatattttaaaattatagtagaaatgtttatctttaacatttccaaaattttaaagagtaaattagggtaaagaactagtttctgattgtataattttactgttggaatgcctcaattatagtagacatctccttattgttcataataacactgctgtggacaaaagccacaagcagaatgttggcatcatgtgagcagtactgcatgaaggtaggattgagtgctcaccagcaacggattaagtcattacagcccagttcttaacaaatccaaagaacaaattgtcttttacacctgcacataccaggaccacctctaagatgtgcattgtgatcaatgacaggaaagtaaaaacaagtcactctgtgggaaggaagaaggagcacaaataatggtcaagggacgtggtgatggtggaacgcattataagatacaagcttcaaaggtgctccttgaaaggtttttgataacacacacaagacaaaggcaaatatagattagaacagagtttaagatgcatttgtaaacaaagatcttcaaagtaattattcaggaaaaagggggagaatactgacagaagagctgtaaggagattcttatgtccaaaggagtgcaacatgaggaaacttctggcttgaggtttcgattaaccagtgacatgaaattcgtgtgtgtgtgtgtgtgtgtgtgtgtgtgtatgtatgtataattttcacatatctttctataaaacattattacacagtgtactgtcctaaggatgacactgtgacactataatatttatactgcatgttttattccacactttttattcctactttctaatattaaaaatgaggaagtgaaataaatttcttacacatttcttaaaattttgccaataggtaagtaaatgttaaaaatttaaaattaattttgttctgagtctaacaagttatagtgaatagatgaacttagtggtagattaagggatctcatgggatattccagtgtcagcataaatcattagaagtcagaggagtcaaatggaatcccatgtgcaataacatctaaaagacatgaattcaggaactaaaattatgaaattcttaaaacgtagagaatatttgtaatctgcaaattatggatttttttaaggacaagaaggtgtaaaaatggcaaatagaactttatcaaattaaaaatatttgctctttacaagataccaccaagaaaataaaaacaagctagagtgaaatgaaacattttcaaaatgtgtatctgataacagacatttaaaaaaaaaacaggtgaagaggaattgccactaaaatacaaaaagacaacacaatttaaaaatgggaaaaatatttgaatagacctaacaaaaatatacaaatggcaaacaagcacataaagtatactcaacatcattaggcattaggaaatacacatattaaattcacaatgagttacaactacaaacccatgaaaattgctaaaattgaataccaagtataggtgagtatgtggggaaactaggaccctcatgcagtattggggatagtttgcatctagtagccactttagaaaatagttgtgtgtgtgtgtgtgtgtgtgtgttttaacattctatccagcagttacatttctagtatctaggtaagataaatgaaaacacatgtgcacacaagcatcttataggtaaattgaataaacctaaatgaccatcatcttgtgaatgggtgaataaatatggtgtatccatatgatggactactacccagcagtaaatggaatgaatcactgacacatgcgacaacatgaatgatctcaaaagtattatgccaaacagaaggtgctagacacaaaagactacatagtacactattccacttacatggaagttttagaaaaggcaaagctatagggacagaaagcagatctgtgctgggaggaggagtggggaaaggctgcaaatgggcataatgcaatttggggagttatgaaataattttaaaattgcattgtgataattattgcacaactatataatggtactaaaattgaattgtgtgcttaaaatagatgaattttctggtagtaaattaccttagtagagctttaaacaattattaggctaccaccataatgagattctaagattattttctgtttttagtaggaaaagtgtgtacatgtttttttggttctttgttttgttttatttttgtttttttggagatggagtttcactattgttgcccaggctgtagtgcaatggcttgatctcagctcactgcaacctccacctcccaggttcaagcgattctcctgcctcagcctcctgagtagctgggaaaacaggcgcccaccactatgcccagctaattttttgtatttttagtagagatggggtttcatcatgttggccaggctggtctcgaactcctgacctcaggtgatccacccacctgagtctcccaaagtgctgggattacaggcgtaagccaccgcacctggccaagtgtgtacatgtttaattgaaagagagacattgaaaggaaaagcatccatctggagagaaaactagcaggctgctgctacctgcaagatttcagaaagtggcattttttaacttggtaaacttactgtgatggaatatctggctgagaaacttgactttgtcagcaggatgacaaatatcattgtcacatgggccaggatactagcatacatgtaataattttagtactgataacagaactatatagcaagtaaaatggcaatttcatttatcagtcataatgaaataccttggtatattttaggtaatagcaatggcaaagtcaagaatgtcagcctgtatgaatggctcataaaatacataaaaattagcactttgcttgataagttcagactcacaactagggcagttaattagaaaaagttgacattttctggaaccaggatacaataggatggtttcttcattccacagcaaggatagtgtttttccatgtctaaccatccccctcagagaaattatataaacatagacatagatacatgtatagagatgtagagatgtagacatagtgatatacatttgctagattgattccttttattctagcaattattcagcctacttagatggatttgcatttgtcagcactgaaaatttatgttgatcataacgttttatagtcagaggacaagtttactgctttttctattagttatctattactacacaatcaaagctcagcacttgaaaacaccaaccacttattgtcttacagtttctatagatcagacatccagagtctaagtgcttctaactcagggcctcttacaaggctgcaattaaatcatctcagggctctagtgggagagcatcaactgccaagctcacccatgtgtggctgttggcaggcctcaggtcctctctggctttgggccaggtactcgccacatgggcctctccgtagggaagctcactacatggcagctggtttccctcagagcaagtaaccagagaacaagtgaaggcacttagatggaagccacagtctttttgtaagttaaactcagaagtaaactgttacccctgccacatacttttcaacagagaagggtcattaaatccccattcagggatataggattacacaaggacatgatacaaggaggtggagtcatcataccatctcagccatcttcaaggatgcgtacatgtctgtctttatatgttttgggagaggcttcattttagctcttagtattacttgacatgtcatccctggtgaaaatacgtagttcctacaaagaaagtctgaattaaatatagatgtaagactccattgttaacaattgaagggcaagagcctttttattaaaaatcaggcaatataatgataaaggcaggaggaaatatattttgtctcaaggggaggaatgagaagtacagggttgcttgaatagcattaagaatcatgctcccgtgtaaattgttactgtctgttttctcacttagcatcaatctagatggagacagaagaaaactagaaaccatataaaacatgtattttatgcctcgcttgtccactgcgttcttcttttcttttttctcattttaaaactcatacccacttttaaattaaattggcaaaaaacacatttttttcattaaccttttgtgatgcccccaaactctggggtcatgattatatgcctagaataacattttacttgaatgtaaaagtgaaatgtgaactttaaaaaaccatagtacttaaatgtggtagcgctggtggtggtgatgcatatgtgtgcctcagtttaggaagctattgataaatgttacaagtctagcaaaatgcctttactttcatcccttaatatgtttctaatgtatttgatttactattatctttgttcttcttttccatttaatgacttttattaaacacaataatcaagagataaaatacactaatattcgctctggttaacttcaggaagctgagctgtgtattctgagtatagagtactcagcataatcagtacacagtgccctgaaactaagttattcattcttaggtaatgtacctaagaagaaagaataatgctttcatctttaaagtaaaagtagaagcacaaatttttgcgcctgagtcttttttgggcaataaagcaaatcaaaaacatttaaataaataccagaggtgacattaataaaactgttgctgacaccataagagactgctcctttggtgttggcatttttgtgtaattcaggaattgtatctctataagtcatgaaaatctaattcaaataagcacaggcaaaattgttgttttattgaaagtctcctatattacgaagagaagattaaaaactaaagctgtataaatgtctagaactctgccaaaactctgtcatctcttcttatggtagtttttttgccatatggcatctgaaagagacagtcttcaaagatctgtaacttagagctctaccatcagagtgaaaaaatcccagagttatattctgatttgtcaggtttgggtcacatttctactctggaaacaatcagctgaggccagagagtcaagatactgtgactgaccatatttgcatctggtgttcctcttgtaccaatcaactacagccagcatgtagtgcaatacacaaacatcaaagttacaaatcatcttcttttggtctctaagcttaatatattttccttattttttagactttttgatagagaattctattacaagtataacaaacacagactcagttctctgtgcttgcattagagccattgtcatctctaaacctctaatgtttttgaaatcttagcttgctattttttgagtattttgtgcatgtatattaaatgtaatctaacttgttggtatatttcataactgcactgagaagtaggaattatacatgaatttgctgccaatattaaattcggaattcatattacaagcaacttacatttgtaaaatcagtactaacttttttgttactgcatttttaaattgacagataaaattatgtattatgtacagcatgatgttttgaaatatatatatatatatatattatgaaatggctaaatctagctaatgcacatagttaccactttcatggtgagaacccaacatccactgatcatttttcaagacagtatattgttattatctatagtcataattttctgcaatagatccattgaatttattctttctatcaaatcgaaattcaatattctttgaccatcatcttctcaatatgccagcctgcccaacgcctggtaaccaacatgctactttctactcggtgagatcaactctattagactcagttgaatatttatttcttttacaaggatagcctttggaaagatgaaatagccaatctagtcagtatttaaaattttcttagcaagatctttacaaatgtcatgcttgaaatgagttaaccagaagtcagtagccttgagacattttttgtttttatattctataatgcaaaaattaaatttactttggcaaactaatttttaaaaaaaatatatcattcatctaaccagtctgcactcggtggcatataaaacatcacattgcttttttattatgcttttattcttaaaacataacatgttaactgtacttttgccatctatacatattattgatgtatgtattataacctctgaagtcaaactccattggtaatacattgttttattttttgtttgtttcttaataatctatggtgttttgaaaagaagagctttggagactgactgaatctgagctctgacacttattagctaatacgaatgtggtcatgattctactgtttttgaatcctaaattatcaaatactgaaatgtgttattgggaaggaaaagtgctctagcatctgtaaggcacctttatggacacctttatggaacctaatgtggctcagcaaatgggatttccctcccctgtctttactgaacctcacttccagtaatctttattattttgcattttacaaaacattttcttctaattcctgctttttgaaccatataacatcttcctgcggtaagaaagaaagctgttatctccattttgcaattaatcaaactgagaagcaaagttgaaaataggagacataaagtatacttctggaaagtttattgagaggcatcagaactaggcctgctatagtcatcctattgactcagtccttgtgtccttataagcagataacagtgagatgaaaaggaatttaagaagaatccctgagaacaaggaggagatgagtgctaaatgaggtttgatatttgacatttaagttggactaaatttggaattgctctagtcattcttcagggacaggaaagagttgtattgtgactgaagaataaaacaaaactaatatttgttaatctagaaaagtttagacttttcaatgaaacatttacaatgactaggttacaattttatgtgaaaacatattgtcatcattctgtcttcatgtcagggataatcaaaaaataaacagataattttttccctaagaaaagcaatgctgatgtaaggtgaagaaagcacgcagctgccattgcacaaggtttgatgctcatctctgtatatttttatatctctactgtgtctttgccttatacctttaatattaatgtagcatttactgtattagtctgttctcatgctgataataatgacatacctgaaactgggtaatttatgaaagaaagaggtttaatggtcttacagttccacatggcttgggaggcctcacagtcatggtggtaggcaaaggagaagcaaaggcacattgtggcaggcaacaggccttgtgcaggggagctcccatttataaaaccatcagatcttgtgagacttattcactaccatgagaacagtatgggggaaactgcccccatgattgaattatctccacctggtgcttcacacatggggcttattataattaaaggtgagatttgggtggggacacagccaaaccatatcattctgcccccagcccctcccaaatcttatatcctcacatttcaaaaccaatcatgccttcccaacagtcccccaaagtcttaactcatttcagcattaactcaaaagtccacagtccaaagtcacatctgagacaaggcaagtcccttctgcctatgagcctgtaaaattaaaaacaagttagttacttcctagattcagtgggggtacaggcattggataaatacacctattttaaatgggagaaattggccacaacacagggattacaggcctcatgccaagtcagaaatccagcagggcaatcaaatcttaaagatccaaaatgatctcctttgactgcatgtctcacatctagggcatgctgatgcaagaggtgcattcccacagcattgggcagctccacccctgtggccttgcaggatacagcctcgctcctggctgctttcatgggctggcattgagtgtctgtggcttttccaggtgcacagtgcaagctgccagtggatttacaattctggggtctggaggatggtggccatcttctcacagctccactaggcagtgccccagagggcaccctgttggagggctccaaccccacattccctttcacacggccctagcagaggttctccatgaagaccctgcccctgcagcaaacttctgcctagacatacaggagtttccatacatcctctgaaatctaggcagaggttcccaaacatcaattattgacttctgtgcacctgcaggctcaacaccatgtgtaaaccagggcttggggcttgcaccctctgagcaatggcctgagctgtacatcggccccttttagccacagctagagctgaagagtctggggtacagggtgccatgtcccaaagctgcatcaagtggggtccctgggcctggcccaataaaccatttttcctcctaggcctccaggcctgtgatgggaggagctgccatgaaggtctgtggagacatttcccccattatcttggtgcttaacatttggttcctcgttaattatgcaaatttctgcagctggcttgaatttctccctagaaaatgggtttttcctttctattgcattgtcaggtgcccagtttccaaaattccatgccttgctttctcttgaaggctttgccatgtagaaatttcttctaccagataccctaaatcgtctctctcaagttcaaagttccacaaacctctagggcaggggcaaaatgctgccagtccctttgcatagcaagagtggcttttacttgtcagtgtcagttcctaacaaattgttcatctccacctgagaccacctcaacctggacttcattgtccatatcactatcagcattttggtcaaagccattcaacaagtctctaggaagttacaaactttcccacatcttcctgtcctcttctgagccctccaagtggtttcaacctctgcctgttacccagttccaaagttatttccatgttttcaggtatctttatagtagcacctcactcctggtaccaatttactgtattagtctgtcctcaggctgttaataaagacacagacaagactgggtaatttataaaggaaagaggtttaatggactcacagtcccacatggctggggatggtggaaggcaaaggagaagcaaaagcatggcttacatggcagcaggcaagagagcatgtgcaggggaactccatttataaaaccgtcagatgtcatgagaacttactaccacaagaacagtatgggggaaactgtccccatgactcaattaacatcacctggcaacacccttgacatgtagggattattacaattcaaggtgagatttgggtggggacacagccgaaccatatcacttactatgtttgggatgttcctccaagttctgtggtttctgcagccaacaagataggtaagtttgatgtccatattaaagagtttttattcaaaattggacagatatatttatgagattcagaaagcaggaaatttcaggtagaggtaagtgttatgaaagaaaataaaaatgaagtgtattaatcttctattgctattactggctcaaagtttctaatagaaagtttctagtaaaagttctaatattagaacaaattcattatcttacatttctggagtccagaagtctaaagtcaaggtgttagtagagctatgttatttgtggaggctttggaggagcatccactttcttgctttttttcagattctagaggccctcccctcaattttttggtttatagctttttcctagtatcactacaacctcttatttctgtcaccatatctttttaccactgatttttaccttcttgcctccctcttacagggactcttgtgcttatacttgtggcccactcagctaatccaggataatttcctacctcattctcataagaatcctaaatctcatttgcagtgtatatttcactaaacaagataacatatttacaggttcttggggtgaggatgtggatatcttagttgggcagagtttttcagcctactgagtgaatatagataacagaataatcttgagtggacagggcattgtcagattggatgttcatggttggtttatttgaagtagtaacagttcagctgaggtagaaatgctgaaagaactgctataatggctttctctgaaaagaattatcagtacctatgagatgatacagtctactgattccatgtgactataccattaaaatcatgtctcaattatgaatatacagtggtatatttcaatttgcccttgaaagcttttgacagcaaaatacttacattaaatttcagcaacttgtgatatctttaaagtatctagatgagaactctagaagtttctcataggttagaaaacaatataccaaaatttctacatggaaaaatattaatttacagatatttttaaaatttcattgaaagggaagatataatatatccacctactttcctaaaacgactaaataaacagtatgttaccaatttttattttatttacaaagtttaaacaaaattagtttatatttctaatttagggagttgaaaaatttcagacagaggtattattagaaacttagtaatatatttttatttctggatttaacaccacacacagagtacatcaccataccataataaaggtcaacaaaaaactcaaagaccctgactttatctttgcagcaattattttgccttaagtacatcatagcttagctttgaattcatagtacccaacaaagtacatatatgtctctacatatacatatataacacatatataaatatatataatatacatatatatgtatacatattttaactggaagatggttaaactcttcccacccattaatgattagtccgtgtgaaaatacatttttgggtaggagataatattttttattattccatgaagtaaaaatatgaagagtattcaaactgactctcttgcttatttattttccacatttaaaactctgtgatgttgtgagcctgtgttttcacacttcagtttgcatagggaggaggtgcattatcaccaggatagatgcttgtgtgaatgagcagtccaagctgatagctatgcagcactttcattagcactggaaagtggtgttagcatgactatacagaggtttttctttggcttgactcctagcttgctttttgattttgattctggattgaagactcaatttgtggtgggacatctaagtggagcaatttcctaaaatcacttgggatactggaatatctctggatgcctaaatatctctgggtaattttagatacatgaacaaacatgaggttatttttaatgttgattttattatatcagttttgctaagtatcatcacttggaaggaaaattgagatggagtattttatatctcctcacttatcaacactaagatgctttgttcgaattttttttctcaaaatggataaaagatgtaaggttttacaacatatgaatgaaagaatttaatgctggaagctaaatataactacacagagtgtcctctcttgagcatatggcactgttcattcacctgactcttgccctaccctcctttccagaattatcttcttctaattccagtatgtgaattattaaacatgtttgggaaaactcagcagaagctagtcttccccagatatccatccccaaacttttctttttccttctttaatctactcacctgaaagtaataagaaaaattgtatgtgtatgtgtgtgtgcacgcatgtatatatgtaatctccaagtgtatgtgtgtgtgcacccatgtatatatgtaatctctaagtgtatgtgtgtgtgtgtatatatatatttacacacacatacacatatatacacatgcacacatactctttcccttcacggccaatgactccccatttcattttgaacttatgcctgaattctaccatgatctaatccctgcctgcttttcacacttcatgttgatgctactcttctatttgtactctatgatttagccattaatgtgccctttcagttatctgagcatgtgaagtttgctgctgcctaaagaaatagtacatgatagtctctgtggaaatctcttgcccctcctctgtatttgcctgtcctgttgtccatgagtctttgccttaagatgtacaagctcaaagagacttttctgtcctgggaattttctctaagtgacttccttcttttattctctatcactataggtattatctgacatatatttacatgtagcgttgaaaaattataattttgtgtatgtatttgtttagttaattatagtccctctttctcactagattgtaagttccaccaggtcaggggtccttattacttttgttctccagtatttatccagtgcttagtggtatggctggcacatagtaattgctaaaggatatttggatgaatttttgagtaaataaaacaatatttctatttttatttctctctgttctatattgtcattcctttcaaagtgtgaaccttctgaactactgggagtaaaaaggcaggaggaggtagggatgaggggtggttcataattttaaggctctttctttagctgcacaaagacccagccaaaattttgcaaggtcctgtttattcatttgttctgcccttttgttgaggttttgggattattcagaggagaatgctatgttgataattgaggagcagatatctaagcaagaattaaaacgtgtgtacatatatatgtgtgtatatatatgtatctatatatgtgtatgcgtgtgtgtgtgtgtgtgtgtgtgtgtgtgtgtatacatatatataatttagatctataaaatcagttgagtatatatgtataggtcacccagtctttttgggctagaccaaaccaaatgttggaacttgacaaaatagaagagcgcgttcaactaagtggattgtctgtatctttcctggttggaatacaagtaggacactgctcctccctgttttaatggcattatgataagataatccacatggaaatatagtaaacaataattagaataattataataattagaaatgtagtcattccagctagctcctttttaagaaaagaacaaagtataatgaaggaatttgaaaagcatttgtaccataaagaataacataatgatatgtgaaacttaagtgatgtataagagttgttatgtataaatgttgagttatgtataatgttgagttatgtataaaagaattatgtgtaaaagagttaacctgagtttgctattgcataggcttcctgggcattgctgacctgttgtctttcttttgctttagtcaagtcattgtgggcaaaaatcatatgtttgcacatccatggagtctttctgctctgtttctcagcatcactacctagaaagagccatcaaaggaaaaaaggcaaaagctctctttcacattaaaagatagtcccatgaggagaaaatgatttcccttgttccctctttcttcctgtgatgctggttttaggctataatcctggagaggtagcatccatctggggaccgtcatgtaattaacatggggaagaaatcccaacatgatgctgtaattaagtaaaagagactaggtccttatttagtcactgaaggaatcccagaaccaaacaccattttagtgatcaaaaacattcctatggttctggccacatttagttgggttttctattatttgcacccaaaataatcttttacagattttttgcctttaatatcacccaatagattggcttacccaagagaaattgcaggaggggcagtcagggtgggaaggtagcatatctaagggattcagaattttctgggaggtggagacttggaatatatttatcacataattctcacagtcagtgaaatggctgattcccagaagtgaatacatatcctagtggaattataaaaggtattggttatatgtattaaatggaaccttacattagaccagtaaaaaaaaatgaaagctattgtagaacagtaaattaaggaaataaattaaaataggatactgactataatacaaactataattttgttgtaaagactaaagaaaagatagagcaacaaatcaaataggcggacatagttgaaatagttgacaaagtagtctttagagaattattcctgtattatgataaactctggacaaagaaaatattgcgatgagatgcggtctcattcaatgacagacatactgcatttccttaccccagattacaaggtgtgaaaatatttagtaacactgttttctttcaattttccattatatagaaggttagttattttcagaaagtcaagcagtaatgcagaaaattgctcggtttgaaagactgttttttagcttcaaaagtcatctgtagttcagcattagagaaatgtatgatgttaggctatataaaattcatttttattctcataatagtgacattggtgttttgttaaacaaactagcacacttctagctaagtaatgaaatctttagattctgaaataagtcacttagaaacacataaggaccagttatgtagctttcaattttttcttgtttacaaatgttttcaccacttcataacagggttgttcaaggaaagagcagttttcactggaaaggattcatagaccattggcagtgctttaaccttatcacagtcaggctgggcatctcctagagatttttggattaaaggaactcatgaagtcattaattggaaagagacacaggttaaaattcatttggcagtgatacttcatatactcagtaatagcagaagatggttagggccaagctctttctaactagtattttttccattatcttaaaatatgtactttgaattatattaattacagtgaaggatataataactaggaaacctaaaattagtgtcatttctaatgctgaaagcatattaaacatgaggtctgcttggatgtctatttaaactacaatattcaagtgaatttctttctgtggaaaaaatgtgaaatgaaaaggaggggtgagttgaagagaggacaagaagggagaaatgagaggagagaattatgattgtatatgatgttggaaggccaaggcctaataagttcatttttttcattcaagcacattaatgcagtcctcatgagattatggatgctgcgctaatgccaaacacggctccgtgtcatcactcttataagctagtagctctaacaaaacctgtaatacttaaaataactataaagatgcatttcagtgctacaatcccaaaatattcttactagagttcaaagatctaaaaagtcatttaagtatatattctagagtatagaaaatatattttgacatttgagagttatcactcaagtaaaaataagtaatatatagagggctaattattagtgataattgttagtaagatatgcacatcttccaattttttaagatactaagcctaaggacaaacatattaatgggagaagaataattttaaaattatatagtgtgatggatggttataaatgctatggaacatggaagggggatcaggagtacagggatggtggagcgggggcattatcgttctaaataaggttgtgacttagccaataacatttgataaaggtttggaggaggtgagagaagagttatagggatatcttgggaagaagatacttcgctcaaggaatagcaagtgtaaaggttctggggtaaaagcatgcctaacatgttggaggaatagaaaggaggttggtgtaactaatgaggagtaagcaagggagaacagccaaaggaagtgaggtcagactgaacaatacagaaaattgtagtcagtagtgaggactttgccttttactaagtgagagtggaagtcattggaggattttgagtagaggaataacatgatttgatttatagtttagaaggacctctgggtgttttgttgatggacgccttagggagatcactgaggaggctattatagtaagaaacgtgagaaattttggtggtttagatcacccagatcacagtgacagcagagggtggtgacaaatgatcagattgtagatacacattgacagtttaactggtggggtttgctgatgattgagtttatggtatgagagaaagagtgaagccaaggatgacttgaatgttttttttgagacctcgtgatctgcccgcctcggcctcccaaagtgctgggattacaggcatgagccactgcgcctggccgaatgtttttaatttacacaactgaaagatgcatcagttggtacagctatgtctttttctctggtcatgtttggtttgtgcaagcggaaataagaatatggtgagagttagatgtaaccaagattgatcttttattcatgtgggtacaatgaggcaagagaatgttagggagtggagtatatatgcaaagagctatcatttttgttaccgaactgaacttgggtccatttgtctggtgcagcaaagctaaacattcacatgaggattgcagcaagagaaagtgtgacatttattgcagagcacctcgcaaggagaatctgggagctcgtgcttaaaacccaaattcttggatggcttgtagataaggaggtttaaaggcaggaaggcagaggttataggtaaagtcataaatcaatacatggagactatatattggtatgatctagaaaggtgggacatcttgaagccagagcccacaggtcataagtggattaaaagattttctgatttgtgatttgttaaggaagcaaagctttttctaaaacgttgagattgacagaaaaaaatgttagttctggcctctgggtgtgacttcctcaggcccttcagaagaggccatttagagcaaagaatggcagtcagggttcagtcatcagatcctccttatctgaggtctacatgccaacaaatccatttggtgggggtcccggtttctggaaaacaacttagggatgtaaattaagatgttatctttagctttgatagaggaccaaacttcttgtgactctgactttcttggctactgttttaagctactgttactttcttgcttatcagtactttcttgctcatttacttctcaggaccagtgaggtgcctggaatttcctttggaggaactcaagattttattttattttatttccatgcttgggagtaggggtcagggagtaggcctctaagagggatctccattccatctcattatgataggctaaacaatttaatttggataataaaatggtgagggtgagttgaggatagtagtggatgagatatggaaactaagtgctcaggaaactactgggctaggttattaggaagatcattgaaatcgtcaaaatcacaaaaagttacagttgggctaggttattaggaagatcattgaaatcgtcaaaatcacaaaaagttacagttagtttgggaaagaatgaagtcatgatctgaaatcctcaaggaaggaggggaattgagtggcagttggtagaagaataaaatgaagaagggtcatgggtggcatcttgtttgttacatgagaatcgaaagaggagagtgtagggagaatagaaggaaatggtctggaagtggcaaacagaaacaacccattgtttcgaaggccatgggggaaaaaaaagccccttaatagggctataagaaaaccattatcctctgtggacacatgggagtaagatgatgatagaaatattcaaagagagtgtgtaaaataattttgctgataatttgatgattaattctagaagatccaatcgtttcaggaattggagaatggttagaaatggggtcatttgggggatgtagaaagatataaaatattttcattgaggttgagatataactttggagtctagggcactcttgatggctgaagaacaaacaatcctcatttgtcctggttctgtgattactgagatcaaagcatgttactatcaaatctcagtcatcacagagctgtgcaaagaaagaactataagtattctgaaataaatggaatgagattgatccagctctagtgaataaataaagcccacaggctgagtgtcaggctggaagtcaggccagtgtggaaacagagctgagcatcggaggacttatgcagaggaccaggagtattggttacagaggtggttctcctgtttttttttgttttgtttttgtttttgttttgttttttttctgtgccttagaaatgtctggttgctttcaaaaatcccgacacccaggccacatccgcaggaatcagcattttaaaaaattccctaagttgattccaatgggcagccaatttgagtgccactgtgctacagtatctcttaatcctatcatatgcaaatcattgaaaatatctgtcatgtcatcattgccgattttctcttcttcagttgtatctattcaaactgtgacagggcctcatttttcaatggcttagcttgttatttaagtagttgcagaacatcacattcatcaattacatgaaattctgtgtggaaagtttttaatgtcatgttgtatcttttttctgcatttttagttgcatcttttttctgcatttttagttgcatattattgttctattaaattgtattgcccagtttgaaataataattcactaacagatgttaaccccatgaatgagaagagatgcaagatattttcatcttacagtttctttgcttttctacctaaaaacctgtatgtagagatttgtaaaaggaaagatatattttttctctgtacattttatttgctttacaatatttatactttaagtaattagtataattagatatttaaaaattcttttttgctatcgtaaataatgcattaatgaatacaataatatataccgttttatgctgtagaagtacatattgcactgaacaaagttgaatggcaaagaagattttatttaaagctatcacaataggagagagaaagaccaaaatgtagtctgaacttgactgtgccaaaacaaagggtgggaagacttttaagcgctggggtgagctggagaccagaggccatcagtgtttgctaattagcttcacccaaaggaaaaataaatgttctcttattgttgtgacaggaggtagtttcataattaaagcaaggctccagcagaagttaggcttccagcatcccacaaaattgggaaacagcagcactatctcccttgatgtttacatttgaaagagatggctgccaggtccttgagaaagagattcctgggttgtaaaactggcaagaggcttttaaaaatatttacataagggcataggaaaaatttactattgcaagttttttaaagtaaagaaaaaaatgctgtaagaaaagggaaatcagggcctagtcagaaggaagcaggtacggagtttttccaagctgaggagaaccctaaggtctttttgatcaatgcttatttctcattatataagaggagttgtaaatggctaggtgagtgcaagaatgttttaaaaccagttgatttgtattgggaaattgcgttcagaatattttttttttatttatctcccactagtagagtatgaggatttccattttgctatgtgtgtgccaacatgagattgttaaagaaactctttccagattttatgtttatttggacaaatgtttaaatgaagaatgaaatatctcacttccaattaccagtgaaattaaactttaaaagatatattttttgttcttttgtaattctttttccaggacttgccattttgtaaagttttctacatttttttatactgtttatattatttttaaagacaactgtagtattattctgcttactggttcagaaacaagagaaaatctgtattgtaccaagagctaatgaaacctgggtatttgttttttccctggaaatttcacacttttgtttccactagattccttagttttgaataaaagcaactggggtaggagactgtctggtttgaggatgttttcttattttggcttcaggccaaaggaattgctatatcttagtttaataaaatattagacgctgataccactgttgcatagagacaatcactgcttgttggagaaaggaaagtaaatattttactgtatacatcaaatgataagcaaaactatcatgaaggaaagacaaaacttctttcatgtggcatcccagcctctctcccagcaacaaccacccacctacaacacagcacaccaaggtccatatcttccatgttttaattgttacattaaatattcttggttgtggcactttgatagtcacctcttgttttcatgcgcgtctgtgtgaagagaccaccaaacaggctttgtgtgagcaacatggctgtttatttcacctgggtgcaggcgggctgagtccgaaaatagagtcagcaaagggagataagggtggggccgttttataggatttgggtaggtaaaggaaaattacagtcaaagggggtttgttctctggcgggcaggagtggggggtcacaaggtgctcagtgggggtgctttttgagccaggatgagccaggaaaaggactttcacaaggtaatgtcatcagttaaggcaaggaccgcccatttacacttcttttgtggtggaatgtcatcagttaaggtggggcagggcatattcacttcttttgtgattcttcagttacttcaggccatctgggcgtatacctgcaagtcacaggggatgccatggcttggcttgggctcagaggcctgacacttgtttacatactttggcctttttaagtccccctatctttatatgttcattaaattctgaaagcttcagtgtttctcagtaacaaccataaatcattggagaaaagtagtatattgaaattactgtaatacttttgatatgtataatacttttgatatctttcagatctctaatacttttgatatctttctataatacttttgatatctttcagatctcttttccatatctattacttttatctcttttcaagtaatgaattgattgcgtattctaaaataaacactattctatactgttgaaatactgaaatgaaaccctacaagctcattgtaagggaacaagcttaaaagtatgtaatttcagtgaagtatattggaacataggcttcataaaaggtataaaaagaagtaagggaaaagaggacggtgagactaaagtttactgagtgatttctaactgccaagccctgagagaaatccagtcttatttaaaaaagaagcactattggctgaaagacttgtgagaaacactgttttgtttttagttttgcccacttagaatttgccataggatctggcacataatgcttagtaaaaaggtacagaagttgggaaagctagtgacatttgatctagttttaaaagatgtgtagaataaatgggcatttagaaaatcttaaaaattctttgtacaatatatgttgtcaataattttatggttatcaaaaatatcagttgaattatattttctctaggaaatattaatggtcaaaagtttaacttttaaaacattgcttaaaaacttaagccaacatattaatgactggtgagtaccatgactttattcctgatgagaataattaaagctagttaaatattatgtatattgattataaaaatgtgcttactatagatataattgtcatccagtttcaagagagcttattgtttgaatgggaggtcttgtattttttaaaaaagactgttttgatcttgaattataaccaataaaatggcattacgttcatgcagagcctcaatgaagataattaagaataaatagtggtttctgataaactgttagtgaagagaagatatctcacatttcccattgttcaaatttaagaagctaaataataaaaaataatatattcatatatataatctaaatatacaaagattatatatattatataatacatgcattaggaatatatattagctatatatggaatctatatgtggaacatacatatatatgtactactcagaaaaataatgttacaggttgttttggtataaaaagtcaggcttgctgaaacaagaaaaatagataactgaattttggatataataaaatgtggagaaacaaataagaagaagaaggtgaagcagtgagaaaagtttcaatgcttggagaatagtttgtgaatcttaacctttatcataaaaggtgaggaggtaggtatgtgcaatagatatccatttatattcttagcagtttgcaatctgatttaccccaaacctgcaaattccagttacaagtgcatactattctattctcctcatatttctgtgttgaaatttttgtctcacagattttctttaacctacgttagattattaacagagtacacacagatcacttataaaagggaggggagaaatgccaggggcgtgtgaaccagagcaactccctcttaaataggagtggggtaaaatgaggctgaaacctactgggctgcattcccagatggttaaggtattctaagtcacaggatgagataggaggtcaacacaaaatacaggtcataaagaccttgctggataaaacaagttgcagtaaagaagctggccaaaacccaccaaaaccaaactggcgacgagagtgaccgctggtcatcctcactgctacactctcaccagcgccatgacagtttacaaatgccatagcaatgtcagaaagttactttatatggtctaaaaaggggagacatgaataatcctccccttgtttagcatatcatcaataaataaccataaaaatgggcagccagcaaacctcagaactgctctgtctatggagtagccattcttttattcctttactttcttaataaacttgctttcactttgcactgcgtacttgccctgaattctttctcacatcacatttcttttggtctcaatctccagtgaaataactcctcacacatttcttactttccacatcatgcttccaccttctgaatataggtagtgctaatgaattccttttaaacattacttcagtattacatttgaatatgtaacattcaaattacataatatggtaatggaaaacgtggatggcagaaatgaaaaggaactactactaagtttaactacttttttaagtttaaaactcaaagcagagaataactaaataccaacagactgagcaataggggaaatttttcaaaataggaagaaaaagagagcgagagaaagaacaactccaattgttagtcctattaattaacgttcatatgactacaatggtagaaccatcgatcccttagatgttggttgcctagatgttcccaaatcctctggtcctgagggattattcttctttaataaataagtaaaattcatgttggtttccatcctaatgattatagaaaagccagcatttccctcacatcatctataggaacacttgggatctacatttctacacatcacctcttggcctgatttcacatggtcattgaaattctctcctgtggcctgttttctgtattctgtgttgatataaacacctacatattttttctttgatactccaaacccattgtgataacaaagctcttgaatttagcatagtctttctaaatcattttgagtagcacagcgtagaaaacactaacaaattgaatactagactattcttattagtagaatattattcttaacagtctttctttcattcacactgttggaatccctcacaggctgtcatttgtcatcaaacatccatgtcctcatctcctcaccttttaggataagtgttgggattcacaaacaacactctccaagcacgaaactttccttactacttcttcttcctcttgtttctccacattttcttatgtatgaaattcagttttctatttttcttcttgcagcagtccttttacttgtgataccaaaacaacctgtaacattatttttctgagtaatcatccaccctggagaaaaattatgtgcctctcttagaaggcatattatttgttttgtcttcattctgcatgaagaactgtagggttttccctctccactctatgtaagaaaaatgataattttataatcctttatattctactttttaatttattttggtgcctggttaaaaaaagtacatacttagaaatgtggttggcatgtaagaagggtttaaaagataataaaatcgacaatttaggattgttgtaagtggtgctgaagtagaaaaaaatgaattgtgcttatctaagtacatgataactagatgtggaattagaggatgcaaattgagagatgtagaaaagttatttttttaaaaagaggcatgatttgaggatgatttttatacatggattggattaaattgttcagcaatgcttgcttattggtatcttcagtttcatatgaggataatagtagtatctaaaactcagctgtccctgaaactcttggctgggcagggagtttactaattcctgttaaaagcttgactggaaaattaataattctgaaaaacatgctatcaattcattattctaaaagcttctcctgtatttttcaagtcctgtcaaaagctggctctcatagaaagcaaggaaggtcgccaaaatgagagcaaatagaggccactcaatcagaccttgttataacaaaggtcaccgaccttcacttgtgtgactcacagaagtcacacttgtggcagagactcaaaggtagacagagaagtgggttaactttgtactaaaaaaaaaaagaatctgggaagacctcagttttgctctgattggaggttgttggcatggggaagctgtaggtgggcaacctagaatgggaggcatcttttatgtttggctagggaacataattgactttctctggggttggccctgcattcaaagcagggcaaaaattggggaagctgacagtccttgaccaagtcctaattctcctgcattgattgctgcagaggttgtgcatcagagttctattgtcacgtatgatctctcactccccagatattacctacagaacctgttggttagacaaacctgaaattgtttcttatctgggtaagagagaatgcaatctcacaaagatatgacagtggattggggtggggagagtaaaagtcagtttgttgagaattggaagtttgatttaaggcaagtctttcaaacagagaaaatttgattagagttgggtaaggataaggatacaactaagaccgtttgaagcagcaagataaggattttgtggtgagtgagtcaatgcctgttgatgtttgtcattgaggagatctttaaggaagttcctatagtgaacaatcaaaccattttgcttgggcaggagactcctgcaaaaagagtcatgctattgacaaaataagagcaaactcatgtttatagagacagtgaggaatggttttattttatttaattatttatattttcatttttatagagatggagtcttgctatgttgcccaggctcttcccaaactcctgtgctctagtgatcctcctgtcttggcctcccaaagtgctgaaattataggcatgagccacccacccagcctgaagtgtggtgttccttttcagtatatagaccaactgtgggagtagacagtttttgctctctttttacttggaccatatcttctttcttccccttagataacactgtcctgtattgaagcttgcacaatatatgaaatagtcatgtcaaattcataatcacattttatgtgaggaaatctctcagaattttgcactgcattctatttcctagtattattctctacaaatactgtttattcttcctaaaggtgttctctatgggtctaagaatccttgcattatttggaacttgaacttgtttgcttttgctgactgtggaagggacactaccaggacactttgagctaatggggaaaagctactgagttggggaagcagtgctacttctggtgaatagtataatgtagtagcttggtgcaaaagtaattgtggtttttgctgtttaaaagtaatggcaaaaacacagctatttctgcaccatcctaataggtattgtccctgaggaggattaaggatgggtggcactagaatgtctatgtagtagaagattttttaaagaagtgatatgtctatgagaaacatgcactctatattgctgtatttgtctttcaagtaacttcagggtgtataaccactaaagccataacttggcatctgctactggctgaatgcagatttgctcaaaggtagtaattattcaagatgtggaaattttcctaatgaaagacttagatcagagaattcaagactaaaaggttcccaagaaaccagaaaattatcttagtgagcagtactttcagatcacatacatatatcccaggacacatctttcctaggtctgtgacatcttaccctgttcaccatgttcatctttcctttcctttgaaaatgccccaggctccttatgttaattattccatccagtttgcagagctctgcatgcaaagatgtgacatgccgagtcacaagaaaggcctgttttacctattccctagagcaggagacatctttctctctcttgcatttttttttttttttttttttttttttgactgagaggtgtatctctcaaggaacatgtaggaaaagttaaatctgctccaaggttacttggttttgcacaaatctagagtaattacttgtttcttttgcttaaaaatgatcaatcaataaatggagtaggaagcatctggtggggacatgcatacactacttcacaagtaaatgaatatgtaatgctgatcagctgaatattatactttgatttgttgcctaaagagtcttagaaatattggcatttttttaatgaggtaaatgtacgtatgagagagagctgaataagcaccttaaattctatatgtgacagatgagttggtcctggaagaaactgaaagactttgaagaataacgtgttgtatgattagaattaagacagtacaggcatttcttcatttacaaaaaaaaaaaatttagggtcagggtttcatgtgcaggttatataggtaaactgcatgccacaggagtatggtttacagactgattatttcatcacccagatgatgagcatagtacctgataggtagtttttccttcctctccctcctcccactgtctaccctcaagtaggccctggtgtctgttgtcccttctttgtatccatatgtactcaatatttggttcccacttataagtgagaatatgtggtatttagttttctgttcctgtgttagttcacttaagataatggcctccacctccatccatgttgctgcaaaagacatgatctcattcatttttatggctgcatagtattctatggtgtatatgtaccacattttctttattcagtctactcttgatgggcattaaggttgattctattactttgctttcatgagtggtgctgtaatgaacatgcacatgcatctgtctgtgtggtagcataatttatatttttggaggtatatacccaataatgggattgataggtcgaatggtagtttaagttctttgagaaatctcaaaactgctttctacagtggttgaattaatttacattctaatcaacagtggataagcatttctttttctctgcagccttgccagcatcttttgtcccctgactttttaataatggccattctgactggtgtgaaatatctcattgtggttttgatttgcatttctctaatgattagtgttattgagcattttttcatatcttgttgtttgcgtgtatgtcttcttttaagaagtgactgtttatgcactctgcccacttttctaatggtgttgtttgtttaactgtttaagttccttatagactcttgatagccctttgtcagatgcctagtttgcaaatattttctcccattctgcaggttgtcagcttattctgttgatactttcttatgctctgcaggtgctctttagttttattaggtcctatttgttgatttttatttttgttgcaattgcttttggcatcttcatcatgaaatctttgccagagcctatgttcagagtggtatttcctagttttcttctggggtttgtatagttttaggttttacatctaagcctttaatccatcttgagttgatttttgtggatggtgaaaggaaaggatacaatttcaatctcttacacaaggctagccagttatcccagcaccatttattgaacatagagtcctttcctcattgcttgtttttgctgactttgttgatgatcagatggttttaggtgtgtgaccttatttctgcactttctattcggttccattgtctattgtgtttgtatttgtgccattgtctattgtgtttgtatttgtgccatgctgttttggttactgtagccttggagtatagtttgaagttgggtaatgtgatgcctccagctttgttctttttgcttaggattactttggctatttgggctcttttttggtctcacatgcattttagaatagtcttttctaattcagtgaaaaatgtcattggtgggtttgttaggaatagcattgaatctgtaagttgctttgggcagtatgtccattttagcagtattgattctttctgttcataagcatgaaatatttttccatttgtttgtatcatctttgatttatttcagcacagttttgtagttctccttgtagagatctttcgcctccctggttagctgttttcctagctttgtgtgtgtgtgtgaatgggactattgtgaatgggatttcattcttgatttggatctcatttgaatgttactggtgtatagaaatactactgtattttgtacattggtttcgtatcctgaaactttgcccaagttgtgtaacagatctaggagcttttgcgaagagactatagagttttctaggtataaaaccataataatctgcaggcagacagtttgacttctctgtttctatttggatgccttttatttctcttgcatgattgttctggctaggacttgcagtactatgttgaataggagtggtgagagtgagcattcctgtattgttgtgattcttaagagaagtgtttctagcttttcctcatttagtatgatgttatctgtggattttattgaaagccttttctgcatctattaagatgaccatgaggtttttggttttaattctgcttatgtgatgaatcacatttattcattcctatgtgttgaaccaaacttgcatcctagaaatgaagcctacttgatcgtggtggactagctttttgatgtgctgctggattcagtttgccagtattttgttgaaaatttttgcatctttgtatataaaggatattggcctgaagttttatttttttgttgtgtctctgcttgtttcggtatcaggatgatactggcctcatagaatgagttaaggaggagtcccttctcttcaattttttggaacagtttcagtaggaatggtaccagttcttctgtgtaattccggtagaattcaactgtgaatctgtgtggtccagggctttccctggttggtcggcttttaattattgattcaactttggaattcattattgctctgattagaatttcaatttcctgctgatttaaacttgggagtttgtatattgccaggaattatccatttattgtagatattctaatttgtgtgcatagaagagtttgaaatggtttctgcagggttttttgtgtttctgagacatcagtggtaatgtcccctttgtgatggtgtttatttggatcttctctctttttcttctttattagtctcactagctgtcgatcacatttattctttcaaagaaccaacttctggtttcattcatctttggaatggatttttgtgtctcaattacattcagttcagttctgattttggtttggggttgattttgcttttattttttgagttcctctaagagtgatattaggttgttaatttgagatctttctaaatttttgatgtggacatttagtgctataaactttcctcttagcactgctttagatgtattccagagattctagtatgttgtattattgttttaattagtttcacagaatgtcttgatttctgccttaattttattatttatcaaaaagtcattcaggatcaggttgtttaatttccatgtaattgtatggttttaagcaatcttcatagtactgacttctatttttgttgcactgtagtctgagagtgtgattggtatgatttcagttgtttttttttaatttactcagaattgtattatggctgattatgtggtttttagagtatgtgccatttacaaataataggaatgtatattttgttgtttttgattggagagttttatagatttctgttaggtccatttggtcaagtgtcaagtataggtcctgaatatctttgttagatttctgcgttggggatctaataatactgttagtagggtgttgaactcttttactattattgtggggttatctatgtctctttgtaggtctctaagaacttgctttattaatctgggtgctcctgtgtttggtacatatatatttagcatagtttaattgagcactttaccattatgtaatgcctttctttgtcttttgtatcattgtttgaaagtctgttttgtttgaaattagaataacaacccctgctttttggttttgcttggtttggttttatctttgctttgaccctatgagtgtcttgaagacagcatacagttgggtcttgtccctttattcaacttgccagcataccttttaagtgggggcatttgtcctatttatattcaaggttaatattgatatatgtggatttgaccctgtcatcctgatgttagctggttattattcagacttgattgtgtaattactttatagtgtaaatgatctatgtatgtaagtgtgtttttggtggctggtaatggcctgtttctatatttaacccctgtgtaaggtacctcttatgaggcaggtctggtggtaacaaatttccttagcatttgcttttctgaaaaggcttttatttctcctttttaaatgaagcttaatttggctgtataagaaatcatggttggaatttcttttctttaagaatgctgaatataggcccatgatttcttctcacttgtaggattcctgatgaaaggtcgactgttggcccaatggggttccctttgtaggtgacctgacccttctttctagctgccttaaaaaaaatttttttttacatgttgaccttggagaatatgatgactatatttcttgggaaagtcatcttttatagcatcacacaggaggtctctgcatttcctgagtttgaatgttggcctatgtagtgagattggggaaattttcatggacaatatcttcaaacatcttatccaacttgcttgctttctctcccatttcttacttttaacgatagtgcgaggccataaaaatgactgtatgttgaaactcacaacgtgatcttaataatcaatgggagaattatgattgctctgtgacctttaaatttttgtcaaagtatttaaaactcttttgctctaaattgtacatccataggggaaaataatagtaaaacttccatttgagggctctagttatcttataaagtaactagataattttactagtaaactaatattatttagtgcattataatttaaacattagaaacattgagaaagtgttttttatatataatttaattaatcctaattatcaattttgtataaaaattaagtacttatctttttcttctccttatataacttatatctaatgagcatcctttctacccattggaagcaatttggaaaatgtgtcttttgctaatagaggattttcatttcttcaatttaaaaagtcatagtttgggtaaggggaattaaaaattatctgcaccttaattacaaatcaagtctttacagaattatcatttagccttttggagtattaaccaatgcaataatagttgaaatgtggagcaattgctgggctgtatcaaagattatcatacaactgagacatataagggatgtggagtcacttaccccatcttttcctcaatgtagggattatctttttaaaatttgtgaacattctgatacttttgaaagttgttccttaagagagcttcacatcatatctaatacagtgatcactgaaaaatttattcttgttaagtcaaagacttctcattacctttccttggtcccttattcttttctctagatcttaagaactaagcccacttgttgaacaggatactcgctaaacattcagacagctttcctgctcacgtccctcttttctctaagctgtagtttattctagtgccttctgatttctgaaaacctcataggatacttagttccaccctctttactctttttatagtgcttatccccaagagagtttattaatttggaaattttatccttttggtaatcctgattgctgtagtgccgaagagcaaggtcgtacatcttgggagatggaatcttgatttgatcctcaagtcagtggaaagccatttacgggttatatgtagtaggcagaggagtgagataaacagatttgcatttttatgaagatacctgcgcagcattttggaaaaaggaatggagtcgatgagggacagtgggatctgcaggggagtttaattatgaattgatcagggtgagtctttcaagtacctttctgtcaatgagcatttataaggtctctccaattatttctgggagtctttctatttctgctctggcagagtaaaatagatgattagttaagatcttacgttagacacccaaaggacttgcagaaatagttggcgagactttgagatggagaatcttaagtcttgtagttatgtaggtaggagtttgtgtactagagaattttaatattgatgttaatatactttaatttttaccaatatgctgttgaggttaggacacattcagggtacattttcacttataataaattattcttcatatgtgtctatctctcactagactatttattgtctgactgatgtttgagagactgacatgttagtgtttatgtctttgtaaatagcagagcatctggaacatattagaaaaaatatgaatgaatgaatgatagacataatgtgtagttgttattgaaattatgtatttcggtgagttggataaaatttgtctgttatttaccttgtttaaaaataaattgatgtgagttaaaatttagtaatgaagagcagcattgtaaatactacaaaaaacatttccagataatatttaatagctttacaagtgtgtctttaatgaacttaagatataccttcccctgtaattgctgacaactgtgttgttgtaggttggagatcacacgtgcttatcagaggtactattgacttatacttgttctgcttattgattacttaattagttttctaagatagctaatcagagagagatgtaggtatttaggagtctttcattaaaacatgctaagaaatttaaaacagaaatgtgtgacctgaaaggaaagctcagtaaaggcagagttcttgaggaccttggatataatgtaatgtcctactgtaggtaaaactggtataatttaatttctattttcttcttcagaataatgatatatttttttgttccattggttagggaaatatatcacatgcatgcctctatgatttatgggtatttccatttccatctgaattgtagattagcagaagtaagtgcacatttctacgacctatatattaaacacacttaacttttgacactttctctttttattggaattctattgataaaatataaaactaatgggaactttctctttttattggacttctattgataaaatataaaactaatgggaactttccctttttattggaattctactgataaaatataaaaataatgggaactttctctttttattggaattctattgataaaatataaaactcatatttcattattttttaaagttttgtttgtttatttatttatttatttttagatggagtctcattctgttgcccaggctggagtgcagtggcgcgatctcagctcactgcgacctccacctcccgggttcacgccattgtcctgcctcagcctcccgattagctgggactacaggcgcccgccaccaagcccagctaattttttgtatttttagtagagatgaggtttcaccgtgttagtcagggtggtctcgatctcctgacctcgtgatctgcccgtctctgcctccctaaaggtttattttttaatccaaatccgttttgtgtttctgttcaaatactaactaatataatatgggatattagtgaagtccttcatctaacaattctttaacttcaattatcttctttagaaaatgagttgttctcatcttcttatttaaattaattaataaacactagcacttttacatcatatcctgtgttttatgtaaaataaactctcataaagtttacactattttttttaaaagaagtgacttctaatgttatactttcctcacaatcagagtttttaaagaaaagtcataggaatattttgctctttctacatatctgtacattttattagttggtttgctgtcatgctttttcttaatattaaagttgaccaaaacaaaacagaataggtaaaactgtgcagtaatgaaagctgatcattaatgacatgtccttaaattgagctttgagatatgtacattgagataagaatatttattctggagaattctagatgctgcacttaacggtaaatttgctaaatagttctgatcttggaatttttacatactagtgtggaaagcttttattgttcagttatatcattattttattaaaactgtttattcatatgacttttgggaaacattacagagctggtttgtcacaagttctttgtacctaacagaatgagaaatgagatgataaaatagaatacagttttatttttctgttttaagcttaatacctaaaagatgtatgaactattaagtaaaaaaacactcaattattcattctttcatccaagtatataaccaatttattaagcatatatgtgctcatgtgaaaattgaataagagctttttgtttcagagcaattttttatttaaaaattcttaacataaagtaatacaagactcatctatacctctagctttcactgattccttgctttaatcattcgtctagtaattcaactgatatttattcagcaacagctgctcatttacataaaataagaaacaatatgttcaggaattggaggatattaaaaaacagttatcttaagcttaagtttggaaaaataacgtatatagaggattacttaaaaatttgtatagatttaattgtgtaaaatgtgagaaaagggaacaaattgcaaatgaaacaaatgaagaaaaagtacatgttttccatctttcttcaattgctgttttttgttgtttgtacataatttagaggcatagattggattagtagtatatcacttttcatatagtttatttgaaaacttgtattccctcttccggtctcatcccctatcttcccctactaatggtaaggaaaacaagttggttggtaattgaatataatagcattcatcccagcaggttgcatagtctccgctactgcaatagttcaaaaccagtgggatgatttggattagaaaattgaaggtaaaatgaactattaatgtaaatgaaggaaggcactgtgatttgttgaggaagaaaacaaagagtatgtaattccagtgtcctaagaggcagagagacttttagaaagccccacccctatcatgaggtcaggagatcaagaccatcctggccaacatagtgaaaccccatctctactaaaaatacaaaaaattagccaggcatggtggcgggcacctgtagtcctagctattcgggaggctgaggcaggagaatggcgtgaacctgggaggcggagctttcagtgagctgagattgcgccactgcaccccagcctgggtgacagagcgagactccgtctaaaaaaaaaaaaaacgaaaaccccacctctttcagtggcaaagcttattctaatagtgttcaaaataagtctcaggtacctatgactataacaaattgggttcttaggaaaatatttttgctacaattagttttttgggggatgcttgtacatgataaaaaggaggaggagtatttctgaagtgatattttgggtgggtctgctaactatatagattctggaaccatgtctatcaggcgaagtgtttttaaaccatcttttgataagtataggtcagactttggtgttatcatggattcattggcacacctccctgatccctcttcagggccaatacacccatccataattacctacagtgcctgatgcgcctcacttcaacttcaggaaagtgcctgggacaaggttatacctctcaggggacagcctacaaccactgacaaactcatgcatggacacaaatgttgggcccccttgtctcacttcaggacagctctgcaggagctgacactgcttgacaatgaagatcctttcagaagtggccactcagcccaaagatgtgaggataaagggatttgaacaaagatgaggattaaaaacttcccataactctgggtaatttattctacaaaggcagaatcttcatcctgaagaggtcaagttgaattgctagggttctgtatcctggtgtttagatcaggattaagaaaatggcacaagcattctaaactacctggagggaacttttcccagtcttagcatgtgcattatatggcatgggcttaaccagcaaaagctctcaaattccttctacttggagtggatgtggggggaatgacaagttctaccacacagagtatgtgaacaaggcaggcttatataactcctttaggatcaacaagtgaggcttgagggttccagtggttgattcacactgtcagctaaggtgatgttttacattaagtacacagggaggaatagtgatcttcctatgagttaggaagagaagagaaaccccattcagatattcctctgtgtatttatatggagagtagacttgcctttattccttctctttttattcagccatttatgggcacacttcaccctggttcatagcataatcaatctcaaaacctatcttggcagatatatttgctgtaacacctcagaaaacacaaacaatggatcttttatgaatatcatgaatcagggcttaagttaaaggttagcccagatgaaacagaaaattagagattaaatagtttgccctctcttgtcaattccagcttatatcttgtcactctttatagccaaatgaagaaaaaaaagcacaaccacgtatattttaaattatttcattgattaaagtagtatcaattcaaaatggcatcaaaaccaaaaatttcctctttgccattctgaaatttactcaaggccagaaggagaatagaacatagacctttaatatttttggtgacaagaagtttgaagggctgctaaacaaaagaaggagcaggggcgaatggggaagaaagaggagcaaggaccgccccagttacacatctgagaaaaccaatccagttcacttttcaaagatgcagggcacaaattgagacacaggactacatcttttatttgcagagatcagaatggggttattagcttgaatcaggaactttctagactatagtttgtttctcacaaaaaaagggctcagataaataaggaatgttcaccaaagctgtaatttcaggaagtagctggaagtccttgagttgtgtaaagcaagttagtttcctatttccattagctgttaagaagtaaaggctaattgagctgccgctcaaaaccgtaggtcagaaaaaaaaaaaaatccctctcagaccataactctgattctttctaaacaaaagccacatataaatagatcaccaagaaaaaaattaggaacataaaggctaaataatcaaaagggaaccaacaaagattctacacggaaaaaaaaaggaacataaaagacaaagagcagagaagaaaaatacttacaaaaataataaaatgtagccatgtagcagataaaaataaaccatcttgacaaaaatttaaagatcgtatgcctctgtgaagcacataccagagtgaaacaagtgctcatagagaatatggagacataagagacttattatatatcttaattaaaaaaaaaattatttaaaacagtctcaactcccaagttttctcatgccattgatttgttggatgctggcactttctaggtctcttcctcaagtagttaataacaaataaccaaatgacccacaaacagatttttgaccacagatatccagtcatgccaccttgaataacattgaggtcacttcactttttagatagttaatgcatgctagggagtgaagttgtaataacttccagtagtcaaaagcaattgtaaaacactgaaaattgtattaccccatggattttaatagtacatcccaatttcagagttgttaaaagtgtgataaaatgtgtatttttaaatttaaagaatagattaaaatgtactgtcagaactaagacaaacatctgtaatacaaataaataaaaatgggttgaatttaactattgaaagaaaaatgtgttatatttaatcacatatcaaagtccaattttgttctttcaacaacaaatatttctaaaataaggcattcttatagattgataaaaacatgggcaaagatataaaaataaaatgctaataaacaaatatcaagggtcatgataattatatcaccatatgttgaattaaggcaataattactaattgacataaaattatagtgctaaagtatatactatacaattatgtatagcaattatactaaatttgcatgcaagcaatatatcaacatccatagaagcaaaaaccataggaaaaaatattaaatagaacaaaatcacattcttattataagtaaaaaactttaatttgcctgtcttagaccatgatagatttaaacaaacaaaatttaaaaatataaattatataattaattaggtgcattaatgttgtataatgctataacctgaaaagaacaaatacatattatttttcatatcaatggaaaattcacaggaattgataacatcttagattgtaaaaacagtcttaattaagcaaatcagaagtagtatagaaaacattgctgtactgaaggtatactaataatgcactgaaaaatatattaataacaaaattaaaaagtaagattcctaccactttgatattaaaagataaaaatcctctctataacacttttattaaaaagtaattctaaaataaaacattgtagtaattatagaaaattaacataatgaaaatgctgaatatccagattagtgaaatagaggtagcagtgctcagaaatatattcatagaccaaaactatcttctattagtaaaaaagaagttaaacgaaataagcatataatttatggaaacatggacctatgaaaaccaaacattaataaaggtaacactggaaaaaggtgaatcaaaaaaataaaaagcaaaacagtaaaaaacttcataagaaaagaaatctcagagctaagtgggtgtttgtttgtttttgtttttgagatggagtctcccattgtcactcagtctggagtgcagtggcgccatctcagctcactgcaacccccgccaccacgaccggctaatttctgtatttttagtagagacaggctttcactcttttgagcaggcttgtccagaactcctgacctcaggtgatatccacctgccttgggctcccaaagtgctgaaattacaggcgtgagccacagcacctagctgctaagtgttttcttttttctttttttttttctttttcttgagacagagtctcgctctgtcacacaggctggagtgcaatggcatgatagctcactgcaagctctgcctccctggttgaaatgattctgcctcagcctcccaagtacctggggttacaggcacataccactactcctggctaatttttgtatttttgtagagatgggtttcaccatgttgtcctggctggtcttgaactcctgacctcgtgatccacctgcctcagccttccaaagtgctgggattacaggcatgagccaccatgcctggcatatgtgtttttttaaagaaaaaaaaaattggctaacccaacagagaaaaattgaatatatgttaatttaatagtggtaatcatcacacaatgtctatgtatatcaaataaaagatgaaaaagcaaaaagaaaaatggaaaacggcaataaatccgaaaagaaagaaaatggaaggaaggaagggaagggaaatgaacgaaagggattaaaggcaggaaggaaggaagggacgaagggacaagagcaaaataatataaacaaggatgaaaatggcacaaattatgttcaatcatataaaaataaatgtgaaatatgaatttgaggagaaaacatagttatctgtggattgtcataacagcatttgatagaattttttgtaaggcagaagtaaatggctaattctaatgtatgattaaaatgtatattaggccgggtgcggtggctcacgcctgtaatcccagcactttgggaggccgaggcgggtggatcatgaggtcaggagatcgagaccgtcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccgacctgggcgacagagcgagactccgtctcaaaaaaaaaaaaaaaaaaaaaaaaaaaaaaaaaaaaaatgtatattaatgtatagtataaatatgtgaaacatatataatatggttattatgtataatcaactgtaaaaagaatgtatcaactcctaaactaaaattatgcttaatgtaaaaaacctttaaaaagtcccattgaattcagaattaaagcaaggctattcattatcaccactactgtttaataaaaagtcagttaaagaagacattgaaacaataagtataaaattgagaatgttttccaggcatataagcattatcttatccaataatgatgaattgtctgaaaaataaagaaaataaacagaaaatctactataaacaaaataattcagcaaattaataactttttctattcataaatgacaatgtttaaacatagaatgggagagaagactcattttttactatggtagcaaaaaatactataaataaacttgaagtaatgtgcaaaagctatataaagctctatggacatggaagactgaactcttatcctaaagagaattggttacctgtaaattaatctctggaattcataggatcccaataaaataccatagagattattttagtaccttatgtcatgatttctggataagaaaaaagaataaataactaaaatcatctgaaaatgaagagtaatgaagggaagctagccatgctggatattgaaatttattacaatatttcaatcatttaagaagcatggtactgtacatatacttagaaaaagagtcagagcaacaataccaaaaacaataacagaaatagaacaaatacatcaaggaatttagtaaaagagtgataatcaaatcagagattatacaataaacagtgttggaacagtcttgtgtttatgagtgtattagtccattctcacactgctgtaaacatactacctgataatggataatttataagaaaggtttaattgactcacaattctgcatggctgggggaggcctcaggaaacttgcaatcatggtggaaggtgaaggggaagcaaggaccttcttcataaggtggcaggagagagatagcaagggcaggggaaatgcctgacatgtaccaaacaagcagatcctgcaagaattccctcactatcaagagaacagcataggggagactgcccccataatccagtcacctcccaccaggtcctttcctgaacacatggggattacaattcaagatgagatttaggtggggacacagagcaaaaccatattattccaccttggctcctctcaaatctcatgttcttttcacatttcaaaaccagtcatgccttcccaacagtcccccaacatcttaactcattccagcattaactcaaaagtccaagtccacaatttcatctgggacaaggcaagtcccttccacttatgagcctgtaaaatcaaaagcaagttagttacttcctagatacagtgggggtacaggcattgggtaccaaataggagaaaattggccaaaacaaggcacaggacctatgcacatccaaaacatggtgggggcagtcattaaatcttaaagctctgaaatgatctctttggaccccgtgtctcacacccagggcatgctgatgcaaagggtgggctcccatggccttgggcaggtctgcccctgtggctccagagtgtaaagccctggtggctgcctttcctttccagatggcattgagtgtctgtggcttttccaagcacatggtgcaagctgtcagaggatctaccattctggggtctggaggacagtggcccttttctcacagctccactaggctctactagtgccccagtggggatcctgtgtggggactccaaccccacattcccctctttattgctcaagtagagtttcaacatgagggctctgcccctgcagcaggcttctgcatggacatccaggcatttccatacatcctctgaaatttacgtggaggctgccaagcctcacctcttgtcttctgcacacctgcagtcccaacatcacatggaaaccaccaaggctttggacttgggctcccctgaatcaacagcccgagctgtaccttggcctcctttagccatggctggaggtggagcatctggacacagggcactaagtcctcaggctacacagaggaatggagccctagacctggcccacgaaaccattttttcctcctaggcctctaggcctgtgatgggaggggctgtctcaaagatctctgacatgccctgagacatgttcttcattgtcttggctattaaatttggctcctcattacttatgcaaatttctgcacccagctcgaacttctccccagaaagtggggttttctatcacggtcagtctgcaaatcttccaaaccattatgatctgcttcctttttaaacataagttccaatttcaaatcatctctttgtgaacacatataaccatacactttcaggaaaagctagatcacttcttgaatactttgctgcttggaaatttcttctgcgagataccctaagtcatcactctgaagttcaaatttgcatagatctctaggtaaggtgcaaaatgctgccagtctctttgctaaagcatagcaagagtcacctttgcttcacttcccaagaagtccctcatctccatctgagaccacctcagtctggacttcattgtccgtattactatcagcattttggtcaaaaccattcaacaagtctctagaaagttccaaattttccctcatttttctatcttcttctgatccctccaaactgttccaaagtcttcctgttacccatttccacagttgcttccacattttcaagttatctttgtagcagtatcccactatcctggtaccaagtctctgtattagttcattctcacactgccataaacatactacctgaaactgggtaatttataagaaagagggattaattgcctcacagttctgcatggctgggggagggctcaggaaacttccaatcatggtggaaggtcaaggggaagcaagtaccttcttcacaaggcagcaggagagagagcgcaagtgcagggtaaacactggacacttatcaaacaaccagatcctatcagaactccctcattatcaagggtacaacatggggaaagccactgccatgatccagtcacctcccaccagatccctcccttgacacgtagggattataatttgagatgagatttgggtggagatacagagcaacaccatatcaataaggaaaaataaataaattttacattatatataataccttaagccctcagtattttaaattgagcaaataaaaagaagagaaaagataagaaatggaaaatattaaaagaagataatgactataaatatacaagtatatatgtatatttatgtataaaaatatgtgtattatatatataaatgtcataccaaaaaagatcttctcaataaatatatgtgaaaccaaaaccgaattgaagaagataatatgtaaacacataaaaaaatagttgagcattgtggcacatgcctatagtcccagctattcaggaagctgaggcaggaggatcacctgagccctagagtttgaggctacagtgagctatgaggctggagttactgcactccagcctgggcaacaacaaagtgagaccccatcgttaatcagtcaatcagttttaaagacagcatcaccataagcgaaatataacaaaatgacagattttgatatgtattttcttaagatatttataaagagcttttgaaaaatataaattgatatgaaaaagaacagttcaatagaaaaataggctggagatctgaccaaactgttcacagaaaataaatagctcttaaacatatcagataacctcaaagtcactctttggtgcataactttggagagacaggtgttccatgaatagatgaaaagtggtttgacaactgttattgaaattaccatgcgcatctgaaaatttttctgtgggtacattcctatatgtacaagaggatatagataaaactttacacaatattatttgtgataacaaaacattggaaataaaccaaatgtgcttcaataagccagaggttaaataaattacaacccatatacacaatccatgtaagatatattatatatgcatattcccatatatataagtgaacactgattaaataatttatattcatccacattatagaatcaaaagcagctttcaaaaggattgatgaagtctctatgtactgatgggagataatcccccaattatactaaatgatttgccaagagtatgtttactttaatttttaaaactatttgtatataaaagaacaaagaacatttgtacatatttgttgaatatgcaacattatatatctacatacaagagactgataacaatttgcaacttttaggaaaaggaattgcaggtctaggggagaattgtaggttaggaaactttcactgagtaactttgatacgcttcctgaattttgaaccattcacaaattattaatttcggaagcatccaacatctatcaaaattggttgaataaactaccaaatttcttgttaatgtaagctcagttaagtagattttatatattgaagtacaatgagaattcatgtagcctttacaagcatgtagcccaagtgcataggaaaatccattagctgcataatttatagccaatttaaaatatttaatttgagcaagaagttgacactctgctatcccactgcctgaaaaaaaaaaaaaactttctgaatcaaggacacaaatattaaaattgtattgaacatcttattgaatttttagcctaaatgaaaattacaggttgctttggtaataacaaccaaataaaatctggggtaggatgaagctttaagcacaactgatgctatttagtccaattacttgactgaaatacaaagaatgtaacactttgtaaaattatctttactttggggtaaaagtgtcttccactttttattaacttagattcagataattttatatttggaaagtccttaaagctcacgtttccatcaggattttacaaagccatctttactctgatttcccagaaataacaactataactttgtttgctaacgatttactctttagcatctctacccaaagtcagcctaaatccctcatttgcaatttacatttatttccagacgttctggatgagaaagacatggaaaattttgtactggtggtatttctttctataacaacctttcatatattctaaatcatttattatacttttctcaaagtatttctataatatcaggtttaaaaatgaggaagctaaattatatttccataagtgaagtcatcattagtacttacattagaatgttttattagatgacataaaaaattacgcagaaaattggaaaaggtacttttctttgttgttacatgtacattctagtaggtatgattaaatctgagtgatttattattttggtttatatgctttctactgtttgcttaaacgttgttcatctgtagttgttttcctggcagatctatttcttttttattaaagcatgttcaaatgtttgttctcattctgcatccgcaaattcaatgtttaaacttagcaccttcttagaatttgaatttagaaggctacctttctttacatccatgatttttatcagtctctattctgaccgagtaagaaatagacacatatgggaggttttctattttagcagaaaaatggtatactaaatcttttaaaaaataaaacatcatttgaagtcagtagagagctactgcttctttttatgtgtctgatcatttgcttagcactgttttagttatgtatctgattaattttgaatagcacacattaattaaaatttaataacacttcatttaattaggttaggtattctcaaaagcactccagagctagatttcatgattcataggagcaaaaatacccacttcttactcaacataatgatcccatgtttaaaaggaatatagtcagagcagcagggatgaagcacataaaaacttgcactacatattattttgtgatattttagttataatcctttgtttctaaattaactcatctttcatagtatgagatacagcaaagagattgaaaacattatgttagatgctggagggcaaaacaaagaatgaaacagtgtctgaccttaaggatattaaatctaaaccaaaggacttttattattgtactttcaaatttctgaatagatgatcagaggctgggtaattcagcaactgcatacagatttttaccatcttgctgccctgttatcctgagcttgtttccttctgcatgatgtcaagatagctgcctcaattctaatgtcatgtggcaagctcaagtggaaaagggtaggaaaagagactagatgtgtctctttagcaatgagagaatcttttcaggaacccttaaacagacttttcatccgtcagaattgccgcataccactgtttctaaagcaataaccaacagagggaatgtgtttgccatgattagcttagttaagcacatggccctgtaaaaacaagttttgacagaacaaaattgggcttttgctaaccaggatggaagagagaagggatgtatattctgtaagcaactatcagtgtctgctatataattgaaaatttttgaagagggaagtgtcatgatcaatctgtgcttttttgtcttggcaattaaaatgtacgttgacctacttggaaaatcacagtcctaggtttcacggaaactggctattttatgcttctttttattctctctttctaccttttttctttctcttcttattatcttaattattatttcaattattaagtttttatgtctatcaccaatattttctgtttttcctcttaaatgccattaccttctatattcaccttagtctgttcacattatttcttttgtagacaacgaaaatagccataaaacatgtctaccttaatttactattatgcctctatggtaggactggctacatcatttgtagggtctactgtaaaaataagatgtggggcttctgttaaagacgtattaagaacttcagcgtggcaacagtagagtatcaaattcaagcatgggaccctgtgggactgcacaagctgcatgcctgtgaggctgggccctgctttccaacttgtcctccacccagtgccctcaaatatcttttctgttgctctcagaatgaggatctacatctttaatatgaactaaatgttatcagcttaattatcttatctgcatctacaacataccagcccctgttcttacttctgtgctctagccatggtaatctttcactgactctcttttatcatcataccactagacatttgcaaattctgtttctctcacaacattcattacatcctctttcaaccttcactgacttcataaatttggcaaattatcgtgtgatgttttttgtagccattgtaatataaattacaatatttttgctcactaattttctttttccttcttgttattggccatttactcaggaagttcaaatttatttatttatacattaaaaccttactgcctagtacagggccaggcctgtacaagagtctcaaaaatactcatcaattgaatggcagtataggagtgataaaagagttgagagtaggacaaatgtagtttttgtcatcataatgtttacaatataggaaaactagcaggtaattctatgaagcatgtccattagtttcaatatctgtaaaatatttgaaattaaatcaatgaaagattatttattaatattttcctcctcataaaagtcttacaggctttatttgtggagaatagaatggcctgccaacacatgctgtgtttgacatggataacactgctttgcctaggaatggacattaacagagttacgtgaatttaagtatttaacatacttttttcattgatactcaacgaagagctattttcctaaataaatttgaaatatacatatggcttacccatgtgactgattatcagccaactatacattggcatcaggaactggaatgaacttggtgggtgtcttgaagaaggttcatctcccttcaatagtcatagaataaatagcttggttacatttatacttaaaacaacagaattattgtacttattcataatgctaagtgttttaagtggtctagaaagcatttattaatgttatgttctgtcttcttagtgactatagatggtaaaatttttcaaagaaaagtttcactcttctaaagggtccttggattttgtccttggtttgaaagtagttttaatagatctatttaaaacaacctaaagtgcatgtattttgtgaatagatgaccaatttcataaccttctctcctatcaaaaagaagactagttgttctttttcattgatgtgatattcagacagaggaaggcttctttaagttcttgttaaagttattgcagataccagatgatacgctcaaagaactttgcttgttgtctttttaactttccacttctttaatcatagctaggtgacaagtctttaaaaagtcttaatatttgctaagtgtaagtaaagctttcattaatgattcttgagttattggtgcacagaagaggcttagaaaaggtgaagcaatttgaggtgaagaaagcaatactttttctctccatcattccatcacttaaatatattagaatatgtttctgttacccttccaaggaagatgtatcttctgaactgtagtcataattttttttcaaaaaatataaattctttaaggtaatttgtaagacagaattcaaatatgtaactagttctgttttcttctatagcttatatttatgtataaaactcttgcattacacttaaaatacataaatggtgtcagtgtgtataaattcctaaataaaatatttattgtaaaatataagctgggtaaatgctttctccacgtttgaattccagtctctatagttggaattctaattttctgccatagtagtaattttacagtaaagcacacatatctatcaaagtcagaatagttgatgtcagattcagatttaccatattttgcttaggcttttcatgaagcatataataacaaccattgttctgtgttgtctgcgctagagtcatatgaaatataagtgagtacatgatgagggttctaagcttgacatttccattatgcattcatcttcctattccccttctaccttctcttgctctctttctctcaccatatatatatatgtatatctttctcactatatatctatacacatatatacacttgtgcatatatgtgtgtatgtgtatatacatgcacatacacacacttatgtctcattctctatttttattaaaaaattcattgtaataaagctgtactctatagttatagatttatataaaagtatgtcttatatgttggctacataacacaattaaatgcaaataccaaagatacagaatttaaatgttagttgttggcttttgaagctaaaatgaaattatttattcattcatgaagcaaatggttacttaatatctgttatgtattagagtacaataaatgaccttcttcctatttctaggcctctattcccccaatgcctttttggggtactttattaatttttctggttcatgcaaataaagtagagttagagaactaaaaactaaaatatagttttagattcttcatgaatccagccaagatagattatcagatttttttttctctttctacagtgcctctgaggctaacttaggaccatctaggcataaaagaaaagctgatttcctgtcatgaaagtaattcctacttggacttaatgacttaccatagcaccattcttcaaccttttcattttttggcatattgcaaaatatctaaattttctagggaaatgtcaggggttaggggagacttctatttgtatggtagtgaaaagctttttcttagtatcgtaatagaaagaagaagagactagatggaaacggaagtgaatagaagaaaagcagtttaaaagacaggaatggtaaattagatatgtgtattttaccaccattataaaacaaaatgcacgagtgggacttacagtctttgcttcaacatgtgaagaagttggaagtcataattcctgactttaccataacaaaaagctgaataaactgaaaatcaatgacattttttaggcacataagagaaatgatatcttggggcagactgccatgctgaaatctagagagatgggctaatccagagagccacatcaaagatctgcttacttgaagcagaagccactggagccatacctggtagagacacaaggtaattttaataagttgctagagcctatggaataacacaaaagtgagaaacttattggggctacattgttggtggggaggtcattgtatttgtataggttttacatcctgtggaactgagaaatattctctcatagatatggaagggggatttcccccacgacagcccactctatcttttctttgtcacctaagctgggagaagggagaagctaagaaaaacttgggacataaccagggacacagagccacgaaaagactgagatttaaccataaggtagtagaatctttcccattctccacaccttaccacacatcaacaaagctctagtataataataaattacagctgaaagagctttaagacagacttaaagtaaagaaatggtgacaaatatgccatggtcaaaagaaagctgaagtatctattatgattttagagaaaacagacataagaacaaggaaaattatcagaaataggagagacactgcttaataataaagggatcaattctccaagaagacccaaaaaccctaaacatgcatgtacctaacaacagatatcaaaatatgtgacaaaaaacctgatagaactgaaaggagaaacagacaaaatcactattataattcgagtctttaatactcctccctcagtaactgatacataaagcagacaaaaactcattagcaatataattgacccaaatagcagtataaatcaacttcatctaactgatctttatagaatataaaacagcagagtacacattattctcaagctcacatgaagtatccaccaaagtagatcatattctgtgcccataacagaccagaacagaatgtagaaagggaaagtgatagaggagaagatttatctcaaaataattttggcagaaaaaaattataggtaggaggaacaaagaataaagctaggaaaacagtaaaagtaaataatagctaccacctcttactgagcttttactgtatataggtgggttctgttcccagcacattatatacatgacttgatttaatcatcttccactttcatctgggcttttgtcatcatttgcagatgaggaaactgagactcgaagaatatgagcaatttgtaagtgacagagccgagatttaaagccagagacctaaccttaaccaagacttgactttgttgactctttaaatatggagtcaaggtaccttttgtgaagctgggttggatggcttaaatctaaaactgattcattcatgagtaagagttttagagagtgaccagtgcctggtagagtatttgcatttttctcaggtcctatttctcatcagtctcaagcttccctacttccggccagctattcttggctctcatattcctaccagtaaatcttgttttcctctgcaggtcaagttattgctgctaggatactttcatcaaatatcccacgttgatcacttcatattatttaaaatatgtatgtgaaaagactattggtgactttgcaaatagaagtcacaagtatatattattcttgggtaatgggatgaagattgagatacaagtaagataaagaagattgttaaaatcagacagcatctttttctctcctaaattgtgaaataatgtttttcacagaaaatatatattgtggtacattcatgcttcataagggcaaggactataacttattcagcttcgtttcctccagcttgggtcttcataaatagaagttgttttaataaatgttaaatgaattgtaatccttaataattattttaaatagtaaaacatgcctcaagttttaggaaaagctcataaatatattgcatataaaattaagtatattttatacaaaggaatgaagtatgctgtacatagagaacataaataatataactctaatgtatcataaatttggtctaaagctaacaagctagctataaaaagcatttccaatttcttgtgcctttaaatttaaaagagcttgttagaagggttaggatgaactaagtttctataaaaggctgaccttggaactttgaattatactttcctttgatctcagtatatgtcccttaacaaacaaaaaatcatttcatttcttggtctagagctgagctcttcagaataaacagtctagtttattctgtgcatttcaatgcacagtgttaaactggtaaaccagcacatcagtaggtaaaggcacttgaaatgttcttctagattaaatatcttcagataaaccaaatgaagaaaattatggatatcctatatgaccacacatattaaattccagggtgttactatgaaagcaactttttcttggattctgatttccatccttcatgatcaaacaagtattttgtcagttaaaaatttaaatatgccatcttacaatggatgagtgctacaatatgactcagtgcagaaattgttctttaatcacagggttgaaatactagcatgtgttaaaatatattggaacgtcactacagcagttatataattatcctttaaatgttttctttttgagtctcttgtattattatagttggatcatgtaatatagttattagtgtatgtgaaacaatagaactgtgctgtactaaattttaaagtatgcacgtgtgtgtttgtgatagtgtgtgggctgtgaataatattttgtctaagatacaagtattctaatgtatcttagaaggtctctttattttcactaattggtttcagaacgtgtggtttgagctattcaactaaatagactggttatttgactttgagtatcttgattgttttcctgttgtatcaaccaactgttttgattccacatacagttaatttcttttttttccttccttccttccttcatctttatgactgaggataacattactcactgtctttacttcaaacaaaatgaactttgagtggttgtatagcttagagtcatttactagtgacctttttaaatcattccatgcttcagtttcctcatttagaaccaacctcgtggagttcttttgaagaatgcattaaacatattaaagttctcaatatattgagaacccattcaaaggagtttcattacgaggaatatattcctttaggaatctttcagttccctgtttatattttttcagtaaatagttgtgtttttttttgtaaacttttccaggttttatttttttaaaaaattaatttctggttgcggagtgatgcttttgttttacattatttaatagtactattatggaattattactgcttcccaaaatcctgctcccttcccactcccacagattagtgaaggtaaacttttggaagatttatcacttgacgaatcaggtttcagctactgtacctcctagctggattatgaaggtattaaattcataattctgttactaatgcttccctccttcataaccataataatgtgctttcatcaggaagcatcttaaaatatatcatgtaaaggcccttgttactctatacctcccacactgtcacttccttggtacccttaattctttgaagcttgaatcatactgtgtatatatacttcatccatgtccagccttttaataatctttctcattgtggcataaagattgttgtactagtagaaaagaagttccatttcccttaaagtttcctatgtccacaattctatgaaacttttcagtggaggtcaccaagtccacttttacagattttctgttatggggagagggcacctcacaacttgctctcagatactgtattcaaaatttcattatcgtcaggaaatatatctcctttaaatcaccaaaccgttcagttgcagttgttctcaatagcctagtcaatttcattcactgaattatagatttccctgattcttaataaatttactaattatactttcctcctaacaccctctgctatgactgtaaaatcactatttataactgataaaatttgccaaactcagtttcctgatgtactcaacgcctctggattttgacatttcttcattttagccacccagtggcaatgccaattcttcaaaagtgtcaactctcagaaattctccacctctgatttgacagtctcaaagatagacaaggactgcctctccacttttttgacaagtgacaaacactgaactgacaactgataaatttgtacctgaatctggtcctcctgtatattctttatttgtccacttctgttgctaggttagagatgaagataatttgtttccacgctgcccagttagtatctgagatggcctgactcttagcattcaaaagtatcactttgctaacaccattctacgtggctagcagataacttttggtctgtgtctcttgtggaaaatccacagaacaagaatagttgtgtcacttatttattaaaaaataggctgggtgcagtggctcatgcctgtaattcttacactttgggaggctgaggcggttggatctcttgagctcaagagtttgagaccagccccgtctctaccagaaatataaaaacttagctgggtgtggtggcccatgcctgtggtctcagctacttgggaggctgaggcaggagaatcccttgaacctgggaggcggaggttgcagtgagctgagatcctgccactgtactccagcctgggccacagagcaagacactgtctcaaaacaaagcaaaacaataagtagtaagcacttactacaaactactagatttattcactattaacaataaaatatacatatatgagtatgcacattatagtgtcatatgtaatgtgtatgaattacaatgccaaaaatttaatgaacattccacttatttattcctctaatccttatactgttttagataatatgtctcttatggtccattttaagctgtttcagattccagcctttgttgattgcttctttgctaatgaccacttactgtcccaattgaactgttcactgcttctctaggagataaaattagagtattttctctttgcatttagctaacagcttaactttcctgaattgaagtaatccctacaatgggtagacagttgaaatattattcgcttagttgatgcctcaaacatgttagctatttttcttttaaaataatatcataacgaaaaggaatatttttaaataacattataccagcccaataaatacatacgtttatatttctgcagcaacatgtttcaagatcaaaacataaacattaaatatatttatgaattactacattaagtatatttttatataactaaggtaaaatgcaattatatgtgacagatatcaaaattaaaatggtttaaaaagacaacttattttcccatataaaaatccatgtctttttaagggtaatactcagaattttcatgtagtatttgtgtctcaatctcatgggacaaaacttatcagcaaatcagattttaaatgtagactttattctaggcatccatgtacttgtcttgaaataggaagttctatgaggaaggactaaagtgttaatggagaatggggggcaactagctgtctctgcctctgatattcatgagatttctgtggtcctattccaaaaacacttggttgacatgctaccacatgtttgatccagaggatataaaaattaatgaaatatggcctttacctggaagattataagcaatttattgtgaaagggggtggtagagcctaggaatgtagtgcagtgaaaactcaggaatggaaatgattaactcagtttggggtggggaggggaaacaaagcatttcagagaagatcaggcacttgtaaatgattttgagtttaattaggaatttttcaggtgaagtatagggtaagatattctaggtggtctgatacacaagaaaacaagctctattatggaatggcacaatctagagaacaggcacaattccacagtggcagcctgtggagtctgcagagggaatgtgggaggagataggtctatagaggcagcttgtggtgtgatgtaaagggccatgtatgtttgaatttcaacgtatggaccagcgtcttgcaacctagggtccataggccatatctggcctgctacctctttttggaaatagttttgttggaacacaatcacatccagttgtttaccttatgtatctatggctgcgttcctgctgcaatggcagacttgagtggttgtgacggaggtggtatgacccacaaagcccaaaatcctttctatctggcccttcacagaaaaaaaaaaaaattgccattcccctcatctgtctcatcaattgttcttggaagctttaaagcagtaggaattcattaatgggagttcttttaaaaaagtgtggagtaacagctcatttattttgaagatcttcatagttttttctgttttgctcttttttaaatctttaatatagactatgcttagaaattagaatgcaaaagaatcagaagaatatacactataaatagtttatttaccaccagtatagaaagctaactaaaaaatgattaaagaatttgccaaaaaggtattaaagaatttgcttaaggagggaaaggaggaccacactttcacagtgaaagcatggatgggctttgcctgctattttaattagtttttgaggctgtctttcatagtctttcacttagaacttattacggtaacattaattattgggaattatattggctgtattcattgtcatgtcaacacaataggaagtgctacagtacacaagtctgggccatgacaactactgaacaactgcagagaacatctgggttagctcaccgtttctagacccagaaatttgtcagttttaagaatgacttcttttcacagccaagtcttcctaggttgtcttaaacttgaagccttttaagtgctcttcatgaagttgtcatacagtatgaatacacaataagcgtcattcattaactctacattaatctgacagacattgtacttcacataattactgcctgctgcattacctttgtcctttgtaagctttaatttcacatgtcaacagcaatcactttagagtgttatatttgtagatacagaaaaaggcttgccatggcaaatatgtacttgaaaggtaagccataaactcttgcacttttgtttgcctcccagcttattatagagttttaatttaattttattttttataatttcaacttttagacttgggggtacatgtgctggtttattacatgagtatattgcaggatgctaaggtttgggatacaaaagatcctgtcacccagtgagcatagtacccaacagttagtcaacctttgtccacctctctccctccccactctgggagtccccagtgtctatcattatcaactttatgtccatgaatgcccagtgtttaggtcctacttacaagtgagaacatggagtatttggttttctgttcctgcattgattcgattaggatgatggcctctagctgcatctatgttgctgcaaaggacgtgatttcattcgttttaaggttacattgtattccacggtgtatgtgtaccacattttatttatccagtctaccggtgatggacacctaggttgattccatgcctttgttactgggaatagagctgtgatgaagatacgagtgcatttatctttttggtggaatgatttattttttggggatatatactcagtaatgggattgttgggtcaaatgggagttctgttttaagttctttgagaaatctccaaacagctttccacagtagctgacctaatttacattcccaccaacagtatgtaagcatttctttttctccacagcctcgccagcatctgttgtttttaactttttaataatagccattctgactgttgtgagatggtatctcattgtggttttgattagcatttctctgatgattagtgatgtagaatattttgtcatgtttattggccacttgtatgtcttctttagagaaatatctgttcatgctctttgcccactttttatgggattatgtgttttgtgctttttgaactgtttaaattttttatacattctggttattagacctttgttagatgcatagtttgcaaatattttctcccattctgtaggttgtctgtttgctctattgatagtttcttttgctgtgcaaaagctccttagtttaattaggtattatagggtcctgcaagcttgagttttacttgtataatttttcctgttatattgttgtaaataagactatttgctattttattaatgaaatataaagcactgtgatctgttattaaataagcagattctattagaacttctatatttttcacaataatttcctatcaattccttaggttttaaatgacagccatactatagaactatttattttgcatattgaagatgtaagctaatttgatgccttcagatgcaggcctgagtctgttttcagtggaactctgttttattaaaaatcatattgaataaatcccttcaagacttactttaaaagcactaccttatagttaaaacatgaaagacaaactggaaaatcagaaaaggggatattattatgaatatgtaaagaattcataaatatattaaataaaaatgtgtatctcaattgaaattaaacaaaaacgtggacattcaatccacaatgtagatataagtagctaataaatatgtgtagagatgcataacttctctggaataaaagaaatacaaattaaaagcacagtgtcgtatttatatttttacttacttgattgtaaaggtgagtgaaacatattagctacagtagtagctagggcacataaaaacataaacactctactgtttataagagcataattcttagtctttctgaaggagtgtttgacaatatatactacatcttaaatgttatactatttacaaacttattttagtaattttgcaggaatttatgctaaggaaatggtagatcaagggcataaagattcatgcataaatttgctcatcatagcattgttgatactgtgaatactagaaacaaccaaagttattatctgctgggaggtggcaaaatgctgtaggatacactcataaaatggatattattcagctactataaatgacaaataaaagtaaaacgtagtttccttttcaagtactcttccctttccttccatcacagcatactttgggttttcttctaatgcctctagattttgcttatctttgaaggcctgttatcccctaactggcattgaaatttggcatttcacaaaattctacccgactcacttcctttgtccagctttctccttcaatcatactttttcaaactgtgggttttgatagaatcttgagacattaaatcaatacagtgggtaataatcaaaattttagaaatgtattaaaaagaaaatagcatgagcaagggtggtgtatttgaagaatttcatgaacttctagaaaactgcattatgttcatttgcacacattctaggacttgagcctggcaggaaaagtaatggagagcattgtatgctgtgagaaatggatagcatttggtcttggaaatgatgaagaaacactgatattttaaggtgaattttattgaagaatgtaatgtactcaatctctttataagcaggaagaacagtgaatattctgcttattggaaatgtatataagacattctaacatatccttagcctaaggtgatatcccagctcatcaatcatctccacaaagactgaacttatgtcagtagtctatcagggcctattagagtagttagccaccataatattgatctttgcacttttagagttgttgcattgataacaattatctttgtctttactatcaaggcaatatccaagagcatgtgtgtctgagtcacagagaagtataaggctcatcttatgttgtacaattataatgtgtaacactggagccacagcatcaaattactataataatcctcatgtctttgggattcaataaaatctgatgttaccttttaaaataattactatcttagactgcttacagtctctgaacttggatgccacatctttcttgaagctgtcttcagaaatcccatgaaagttagtatttcattatgcatccagaagtgttggtctatgctcatagccaaggtccactgcagggatgaggaaagcattctgaatttaaaaacaaaaacttatctgaaaggtctatataaattagttttttcccaagatatttttcatagaagtaaatttagctatgactaagcagtgcataaagcaggtcagtatataattgtcttattttctcataaaaatgacagtgtttccataaattctgaaatgcattaaacacatgctgacttattaagcataatattctgtaatcaaacacataccttctacctattcttgatggttcagagtaaatattgtagtcatgcaaatcataataattccttaaatctctgtaatgtattatagtaaacaggcatatattatttgaatattgtgcaattatatgtttatgttacgaggttcttaaaatagctgaagttatatgacctgacatttaacaaccccatcctgccaacattttgtggtcccgaatcctctttttaattttttctctgcctttcacatcttacaggattttaattttctcttactgctgcaggcaacgtggctccctcaaataatgctctttttcttgtaagaaaaagatcatgacttgtgtgtgtagaagagaagggcattttactaacgtgtcagtctgaagtgtcatctgactcttctttcagccttattggtctgattgcctctcacattacctttctttgttttggaggtatccagagcttggttcttaagaatcagcagaaaaaagaaagtacagaggacaggaaagaatccatagactgagaaagggaaatgtaaagattatacacagtttgacccaattgattattgttttattatatatgcatatacaagttctgactgaaaagacagaggacaaaggggcaggggaattctcggagcatgagaaatggaaataggaggattatacaaggttggatcctttaaaaagtcaatcttacagaaaacgagaaaccagtcaatgaaggaacaaggtaataaagagaaatcttatctccatttatattttgtgaagaccattattaataatatttccccttttttatgtgtacaagtttataatttttaaactcctacctattttccttttattgcctgctgccagtgcctgtcttcctagtgacctttacaagaggatccatgagcagagaaagactaatggaagtatgcccagatagtggcagcaaagatgagcctctggaggccattctttggattcagagaaaaagagctggaggggaggtgacctggaaactaaactaagatccagaagtgaacccagacaattaaatctcacagtgatccctgggtgatttccctaaaaacgtatcagcagcgctgttatttcaagccacttaagcaggaaagcaggccttactctagtacattcctacgctaacgaagagaatttccagtatacaagaatgcagaaatactcaaacattttacagaagagtcatgatagctactttagaatccatttacatttggttatgtcctacttgttattttgtttttgttttttattttccctaccaagagaatggtctcaagtttaatgttgaattaacacttggaataaccattgcatgttcttaccttattgtgctaatgttggacacctcactatatcattttagttgtttgttcagtctcaccataaatatcattgagataatgatgaaagtgcctataaaacacctgagatgcactaggtgttctttaatattagtgatctgcttgcaaataaaacacactgtgttaggcacagtgaaaactattaagatcaattaaaatatagtctatcccttagaaacatctcagtctaatcgggaaaataatataggcatgtagtcatagttaaaatggaaaaatattagataaaactctgatacagtctttttgctttgattttgaaatgaccacccattgctcactcccagttccctcatagcagcccaaaggaatttaccttatcttctttatctggccgggtcaacttctaatacaggtgacttggcctagaaagcctgctgactctcaattttcagatattctgacatgttcccatttggatcagatgagcttggctttctataattgagtcacacagcttaggtgagagttggagactgtaatcccagtttttggaaaagtcaattgttgcatatttccagatgtagataatcctcttgagtatatacctcaatagtaaattaattaatttatttattttagaatttgaacagcaggggtgggggcagcttgaaagagtcttattttaacttgtttttttccccccttgggacacggtctcactgtgttgcccaggttggagggcagtggggcgatctctgtttcactgcaacctccatctcctgggatcaagggattctcccacctcagcctcctgggtagctgggactatgggtgcatgctaccacacagctaaatttgtattttttgtagagatggggtttagccatgttgcccaggctggtctcaaactcctgggctcaagtgatccacccacctcagcctccccaagtgctgggattataggtgtgagccacctcaccaggccatgttttaataccaggccgtctttttaaaaaatcagttttagcacttttatctcaccatattcagtactttaaatcagtcatgtatttgatcatcaggaaatgtactgacaggtaaaaagttgataattaaattttatatcaaattatactacataacaattttatcaattatgtataataattttatgtaagctatataaatgaatttatatagagaaataaatttagagcaaattacaaacatgttcttttatacataaatgcttcagtatgtatttcctaagaacaagaacatccttttacataattcttaaattataaatatcataaaatatataattaaataattacatattaaagtaaattaaaattgtaacttaacatttaatattatgtgtaattaaactatgtaattataaaaatcaagaagtttaacctacagtgtttatataaattttattggttttccctgtaatgtgttttgtaactgttttcttcctaatccacaatccaatccagaatcatttattgcatttagatatcaattctctttattttaccttagtctggaacataacctcagctttctagacctttacattttttgcattatgaagaattataaaatatttgatattttgttccattagcacaatctctagtccagtcccatttagagtcagaattccaaacatcttctaaattaaccctgtcctcttatccatctcaagcctactttggactggatgcctatcatggtaaaggaagaggaagacaacgtcagatagttttctgttctttccctctattgtactttatccttcccctcactgctgtttctttgtcgactaactcttgtttctgacctccttagggttggcagaggggagaggcaggagggagggtgagctacacatcactgttgttgcagtggctggcattgctcatctctgggtttactaagttcaaagaatactctagtggaacatctccacagccttcagagattcctcacaagagcttctggttgcagcagtctctctcctcttgctggcctcttacgacatattctcagcttctgaatgtgatgggtgcatatccatcttctctctgctgatgtttccttgctcccagatgaagctgtctcagtccatcagcatactgcatggccagtattcactcggtccatgggaaacaagcatcttttgctttgttgtctttgaaagcacagttgccttctaatatggctgtttcttttccctcaacagctaagcaggcagttccattaaggttgtcttagaatctttggggactatgagtcaggaacctattgtgcaaactgtgggggacacaaatcaaattttctgaattttgtattgaatcgtctctcttacctgattggaggggaaggaaagcaatcttctcccctccactcccgcaagaagatcagaaaaaaaataccatgccatcattttgactacctcaaagagtggtttaatatttctaatatatgtgttttcttacctttttttttttttttttttccaagacctgattttgccaaatcatttgctcatcttacttggtgggcaaacatttccgttgggaatgtaagagcatgtgccctgctattttggtttctgctttttgggccttctgccaaaactgagacagaggcccttgaaacatccaggatagtgattaaatctagcaagtgcaattaagtaaacatttccagctcctgtcctcctttagagaaaaacaaatgaagaaaaagtttaatttctagagggagattttgtgcatgagcaggactaaatctaataatcccaatagtctggcatatggcatacgtggatattcagtgagaatgtaaaatcatcctgcaagcttttctgtatttatttttggggattgattacaatctctatagtacagtgacttctctacatggattacaggagactgttgtctcagtccacagttcttggaatagtcatatttctgagcaactgattttttttaaccttatggacactgaattgattgtttttcacttgtgataactgctagatctactggagctgagacggtttttcacttctagaaaatgtgcaaaactgcaagacacatgtttggtttacaatttcaacccaggcttttttattttactttttttcatttttctttcttccaatgtcctcacttttttcttgacatgtagacttgtatttaaaaaatgatgtttgggaaaaaagtaatgtatgagtaaataactttattggaaggatagctattaacactttcttttgtatcagagaaggacctcattcccagtttctacatgccttagggatagaatgggatatttttaaagtatgtaaaaggataagtattcttatatatccctttatagtggttggggaatcatttaaaaataaagcaacacaaattggtaattgttaggggattgtcatgtgtttgttttttaagatgagaagttccaaagaaacaagccttatttccttttcgtggtattaaacagctactgccaacagtttatacagagccacaaccatcactgcagctgaccctgaaaacagaaagtgagggccatccattaagaggtccacgactgcactgagtctatgatgcgcaatgtagtggagcagaaatgatgcttgctgcacatttagttgagcctaggagagcagggccctccatagacactagtttgaacattgctaggtttaaaatggtttaaatataagatggaaatctgcacactactagtgtttgtattcatattttttatttggaataacctgtctgtgtatctatgtatctagttgctttagtcttctcatagaattagtataacagttggttatgtataataattatggaaaagggttaatcaaattattacatttttacttgaagcctacatcacagcattacaatggaaagctagactgttactattttgttttcacaagtgtttggtgcatatttgattcatttcagtattgttagaaaattaaactggcattatttttctgatgatgtctcacattgtcgtcactatagaaatgaggctaataatgccagctcattcgaggaatatagcttcaggaatgaattgttttttttttttctttatattgaaatggtagttttttaatagagatactgaatggtgtatttcagatatctttaaaggaacacttaattcagaattgagtgcaaaaaagctgcagaagatcattcatccatgtagatacaattatattgtggtggataatggatttgtgttattcttaatgtctatacatggctacagtaagactgaagttgtttttataacttttcagtacattgaatgaaagaaagtatgacagcagaaaacatctgataaattaaatgtgacatgttttttattcatataaaatggtttctgagcagctggtaattgtgaatatttcagcagtcatttttgatgtggaatacttcttctgtggtaaacactaatgagttgtgagttgtacttcatcaaattgacagtttccttacttttgtaaataggcatttgatacaccttgtaaaagctggtaaaagacactcaactcaccttttaaatgcatagaattttccccttattctctttctacattgtgccatccacttttcctataaggaagataatgcaaagaaaggctaccattcactgggagcttaaaaaattcccagaatcattctgggtaccataatatacactatccattcataattcttacagctcaaattagctcaaaggaaaaactaagactgtacattggctgggagagtaaacgagtgcaccaagaaattacccgtactcaggttttgtaaagtgtcttaatgtgaaatagttgtgtttcttgttattttaaatactaggtatttttagagaatgagataccttacattcctccatcttaaaaaaaaaactttatttataataatcctgtaaaataggaatttgatgtactattctcattttataggtaagagaaattacatagagatgaatgttagtcacagagtgggaccatagtgcagactcctgttctttaatatattgtattgtttttacttagagaaataaattaattgtactagggacatgaaagaacatagaataagaattgtccgaagagaactaaagatgttaagattaattaatcaggaagtatattttaacaaatctaagaggataaaattagctgtggtactgcaattaaaaaaaaaaaaaaacctcttgaaacagattgagtattattaacaagattaacccaactcattctttggggagggaacattatatattaagagctctcttaaaacatgaataatgctacatattttgagtggaagtgtaacttagtgctcaactagcacagctgaattagtacagctgctgctagactttcaaatcaaacagccctctttggtcttttttataccttggtattgtatataatatttctgtgagtaaagagttctgatactaacacattgtctgacatagtcatccatattttaatgtaaattacactgataataatttagaataccactaatagacatgatagtgatagcatcttatgcttttacagaatattattattttccaaaagagttttattttgatggttctgccaatatgtcaaaatcagtaacctgcaatcccttcaaaaacaagtgtatagaaattttaaaaatataacaaacctattttataaaggcataaataagttcacaaaatataagaggtatcctcagaaaccaaatacgaacaagtcaccaaaagtcagggtggcgcagacatgatctgacgatggggttaactagagctaaggggattggggtcaatgttctcagtccagaggtttgtgatgtcccatttgtacacatgagcaaatttacatcttagttttttgcataaattggaaccaccaagagactgcatgtaacctagatgtactagaacaggggtccacaatgccctggccatgaaccagtaccagtttgtggcctgttgggaaccaggctgcacagtgggagatgagtaacaggcaaaccagtgaagcttcatctgtatttgcagccactcccaattcctcgcattaccacctgagctctgcctcctgtcagattaatggcaggattagattctcataggagcatgaatcctattgtaggttgtgcactccttatgaaaatctaatgcctgatgttctgtcattgtctcccagatgggaccatctagttgcaggaaaacaagctgtgggctcccactgattctacattatggtgaattgtagaactattttattatatattacaatgtaataataatagaaataaagtgtacaacacatgtaatgttcttgaattatcctgaaagcaccccaccccccagtttgtggaaaaatggtcttctgcaaaaccagtccctgttacaaaaaagcttagggactgctggactcgaaaacatttcccccgtaagcatagggatgtgacagaaaaatttgcagtaagctgaaatcgacctatgcctcttcctagttctgctcacaagacaacttagtacgaaatctagtgcttcctccatgagttgttctttcattttatgaggacagttatgtgatatggtttggctgtgtccccacccaaatctcatcttgaagtgtagcttctataatccccacatgtcatgggagggacccaatggaaggtaatttaatcatggggatgggtttttcccatgctgttcccgtgatagtgaataattctcatgagatctgatggttttataaaggacagttctcttgcacatgctctcttgcctgccatcatgcaggacagggctttgctcctcctttgcctttcaccgtgattgtgagacctccccagccatgtgaaactgtgtgtccattaaacctctttttctttattaaattacctagtctcaggtatttcttcatagcagtatgaaaatggactaatacatcaggtctttgctaggtcttgccttttctaaactaaacttaaaaaaagtagtaagaacacagtgtaagatctactcacttgatttttaagtgtaaaatacagtgttattaactgtgggtacagtgttgtacagcagatctctggaacttaatcatcttacataactgaaacaccatatccattgaactgcaactccccatttcccttcctgctaacccttggtaaccactattctactctttatttaaaagactttgactattttagatacttcatgtaagtggaaccatgcagtatctattcttctgttactgacttattttacttggcataatgtcctccaggttcatccatgtcatcacatttggcaggattcccctcctttttaaggctgaataaattccatcactattcaagtcactattttaagacgaaaaaatcaattgcttgtatataatacattttttaaattcattcatcagtgggtagttaaggtgtttccatatcttggctgttttaaatgatgctgcaatgtgcatgggagtgcagatatctcttctagaccctgatttcaaatctttcagatatatatccagaagtagaattgctgaattatattgtaattctatttttaagtcttttggaattgctatactgtttgtatacaggccacaccattttacattcctaccaatactgtataatggttccagtttttccataattttgcaagtatttgttgttatttttggtaataatagccattctaacaggtgtgagatgatatctcattgtggttttgatttacgtttccctaatgattagtggtatggagcatcttttcatatgcttgttgaccatttgtatgtcatctttggagaaatgtctattccagttcttcctgttttctaaccaggtgattttttttttttttttttgccattgatttgtaggagttttataattttggctattaactatttatcagataagtggtttgccaatgagagactaaatattaccattttatttaaatattatgtgcacagtcattagtattacaatattatattccccttgctcttaactgggtgaagcgtgcaggttaacatgtgaaattctgtgctcaaattctagttctttgaatctagtttccctgattttaaaattgagaggattgctacctgagacataaacaagattaggaagcatgtaaccccttagcccctgatacatagtaaatacttaacaatttccttcttaaaatgattatttttctataatgtatcggtatcgcatttatatatctacaattctgttataacataccatttgtttacaaactaatttaaattgcccttgaaaaagttaaccatatataaataagttaattcagaagaatgactgcttgttttatttaaaatttaaaacattcctaataatagaaatacatcattcttgaaaatatgcccatagaacccatagaagcttcttatgtaaggattttgtttgaaaatatcaatgtgaaccagctgtaaagataaccattgtacagatacatttcacccatctagaagtcactattcaagtcactattccaaagtaatcaatatctatcatttgagagttatggagaatttcccatatgtagaatgtaatagacaaaagtagctcatacctcataaaattgtgataaggaggatttaattaggttgcacatgataacctagtgtaactaacacagaggatagcccatagtaaagattagatgcattattatcatttgcattatgataaaataggcaagaaaaaatattgttaataagactggactgacaagataaatgaaatatgaacacacacatacactaaagttgatgaaattcatttatgggagaaccaaacctttacttagggaactgtaattcagaaaataaaaaggacaaaaagagcagaatctattaatgtcagtcaagttcacagcagcaaaaattgttaacaatgccttaacagtgagtgagggtacagagcatcgttcaatatatatatatatatataaaactcaaaaagtgtggtcctcccaaatcatttaatatgagaacagccaggcctacacacattaatcgtctgtgaaggcatcagcacagtccaccatagggccaaattgatgtctatggtttttattttctgggataacagaggaatatataatacactgaacagaaaatgaaaattgagcaaaccaaaagctttggtgcttgaagaagcgaatttctattatctagaaaaatcactgaagtaggtgtttctttccaaatgatgatggataagccaagcatttctataattgcatactgaacagataaatgtttgacctaggcttcatatgccaattactcctagatgtggtacagtgggatccagctagccaaggtaatgcagattaatatcatgtcacttctgcatgcctgggtaatatgttgtttcatcagatggtgctttaccttggcttcctttggtgtatgaacatattacagcagaagaaaatggtctgggtgggaaaatctgatgaagcaggtgatgtaaactgtctgtaatcactaaatataatgagtggacaagtagaactcctgttaggcctctagcttttcctactgtttggaacttgaatcaaaagtcataatagaattatgccaatctttcctatttttaaagtgcacagaaattctgcaaagtaatatgatacttagacactgaccatttggtaggcagcacagaagtaaagaagtcactcttcattcaaagtggatcacagcattaacagctgtgattcttgctattaaagaataatttttatcaaaggagtatattttaaagatttagttctataggttacttctctatgaaaatttaaagaaaatccttccacagagaggtatggaggatatttactgtcaataggtttatactattaatgagttatattcatagtggtatgaaatattagttatgtcagcttcttacaattcatgggacttttgcagaccttcagaaatgcagataagcattgctctgctcactttgaatatcggatacatcctccttgcactttgaaaagcaaatagaatacatacatttatcaatgctgacattgatacctttctacatagctcagcaaagaatcatccaaataatacaaaattgaaaaactggaaggctaaacaaaataagccgtcttatattttacagttgaaatacttagatgtaagtgaattaagtaattctacccctatataaagtgatattttttcctcctcttaattctttctttcaggaagaagcacagataaacagaaggctaacacaatatgatttatttatttatttatttattttatttcatttttttaagaaaaggtctcactctgccacccagactggagtacagtggtgcaatcatggctcactgcaacctcaacctccagggctgaaccattcctcctgcctcagcctcccaagtagctgggactatcagcatgagccaccacactgggctaatttttgttgtttttgtaaagatgaggtttaatcatgtttcccaggttggtcttgaactcctgagctcaagagtttttttgtttgtttgtttgtttttttttttaacaattgaaaacgaaacagaaataacttatataaaagtttaaagataactggatatgacctgcggtgatatatggcaattgttttactgattatgtttagaaaaatccccaacgtgttcaatttcatattaaaatgcctagtatttatggtttataattatcatttttagtgcaatcttgcgcaacaggaatttcattttttataaagttatttgtcacagtgggaggatttgttttctctttagtttatattttataacaattgcaacccatgatttcacagaggagactatgattaggtataatacagattaacctattaagaaatacttgtaaatcttacaattgatcaagattattttgttatgcaaaaaaatagaaaattttattattattgaaagtgctatcatcatacctttaaactttataattgtatgtatttttcctttattcaaggaagattatttaaagtagtgtaacatacctacatactttcaggagctgggcagcgacataagtgaataaatgagtctgttggggaaggtgtaggatgattgcattaacctgcttttagtttgacatagtaacacctacctcattatatttactttcttattctgggggtgtgtttgtttcgatttaatttaattttttgtaatttattgtgactaattgtggggtacagagttatgatatatgtatgcagtgtggaataattaaatcacactaacatatctatcatcttaaatattaattatttaatctctcaattgcaactttccaccctttgataacattatcccatcccaattcccatccccttaccaccaatctaccctctgctactatgagttcaacttttttagattcctcatatcagtgagatgagtggtatttgtctttatgtccttggcttatttcactcaacataatgtcttccaggttcattcatgttgttgcaaattatagaatttccttcttttttcaaggctgagtaatattacattgagcttacaaaccacattttctttatccattcatccactgatggacacaggttgatttcagatagtggcttttgtaaataatgctggagtgaacatgggagtagatatctttttaattcctcatgatatatacaccaaagtgggattgctggatcatatgataattctagtttcagtttttctttctttctctttttttttttttttaggaacttccatacagtttcccataatggccatactattttacactctcaccaacagtgtgcaagggttccctttctttacattgttacacatctgggagacaaacagaacatgtttatggggtgtagtgggcctcagaaagtcaccaactatagcctcctctattacgttactcagtaagatagatgctcccagggagatgttaggtcaatggtatctgccaacttttcattagaaagtattaccctcccctcacaaaggcagtttagaaatacttcatcatggaagtgaaataaaatgctgtcataatttctctactatgacatatctacctcagtctcttcctgttcaatccatatacacattacccttgccccagggttatctttagatacatgagtctttttatgtattctgtaagtagttaatggatttaattcaatgaaatgatatcaccttcaaaagaaaatctaaactcttagactattactaaagcagcctttgggaagaccctccagcatctccctctcattttcatttctccctgtctaccttccttcacgccctaatatatagaaacacatctcattcacttccccactaatgtaaattgagcaccacaaagaagtcaggcactatgctagatacaagtgttaaatatgagtgaacgagaaagacttcatcctactcttggggagcttcacagaggctagtggggttgacagatattaatcaaataattatgatgcatgccgtggaaaagtttaggtaccatggactgtgcatcagttttccaagttgctttttactattttactcatacctgccctttccatctgtgaaaccttcactcaaccctccaatcctcgttgatttacctccttgggacaattattataacttgtatgcatttctcttattcaaaattatcctaatgaaatgggttgcttggttgcttatatgttttcacatgagcaattgctctattttctcttcctttgcagatatagcccttggcgaggtgcctggctccatagtaagtgttcaacaaatgtttgaataaaatattgcattgttgaattttaaatgtatttaagcaaattgataaccaacatctgaccagatttcccaaatttagatgcaatgtcagatgcttcttttaatggtgtcagagattggctgacaggcttgcctgtctttaaagtaatttattacccatgttggttttttggtataaatggttactgtttgtcattggagtatgtttgtattcatggtagagattaaatacatatgtattgcatgaattaacaaatggttatgctagttgtaggaaagattgataagtgaaagtttctaatgctctttttttgagatggagtctcactctgtcacccaggctggagtgcagtggtgctatcttggccaattgcaaccttcgcctcctgggttcaagtgattcttgtgcctcagcctcccaagtagatagaagtacaggtgtgtgccaccatgtccagctaatttttgtagttttagtagagacagggtttcgccatgttggccaggctggtctcaaactcctaatttcaggtgatctgcccatcttagcctcccaaagtctaatgttctttacaggcctatgagtattttatgccagaatattgattttattggagaactaaaaattgatacaatccatagcttgaaagtaaaaatgtcaaaatacttaagaccatacacaaataagtattctaaaataaggaattgatatttataaaatatttttaagaaataaggacatttggccaggcacggtggttcacacctgtaatctcagcactttggaaggctgaggcaggtgcatcataaggtcaggagttcaagacctgcccggccaatgtggtgaaacctcgtccctactaaaaatacaaaaaaacttagccaggcttggtaacaggtgcctgtaaacccagctacctgggaggctgaggcaggagaatcacttgaacctgggaggcagaggttgcagtgagctgagatcatgccactgcactccagcctgggtgacagagcaatttaaaaaaaaagaaataaacacatttaccattacagtattttttagccccccaatcttgttattattaataacaataataaaataataagcccttgacttctttactttgctgtccttttcatttattttgcatttcttcattttccttgtgcagattttatactctgctatcctcagccaccctatccgtatcatttctatggtatctctgacctcaactatgtttagatttctccgtcttcccctaattactggcatcttccttttttatgtgcttctgctttctctgattttgggcattagatccttcctaatctgccctctctaaggttaatatcctgttcttcttggttagttaggatctcttcccatttagttttaatctaatatatccttcttctcgtctctcaaactagttttgcccattgcttcaccttggttctaatccagggaaggacataagtccctaatgtctattttctgagcagacaaaataaaatatgcataaactgtatctgaacattttagtcctctaattatttgtgctgtttcactgcaactgaaatgaaaaactccagcctctgcacaggattagcatcagcagctttgcctcttaggctctattaaaagaaaatctgtagacaaattaaattcagcaaagcttgctatttgagtaaagaacaattcatgagttgggcagcacactgagcctgtagaggttcagagagctctccccagtagtagatagtatttatagacagaaagggaattgatgaaaaaaacccagcttgataggttaaagtttagcatttgctttttttgggcatggtgggacaagacatttgccttatatggacctaacctgatcagttggcagcctgtgatggctggagtttggctgctgtgattggctgagacttagctatttgttggaggaatatactattaagttagattacagtttatttgcatactaagtaaggttgcaatttgctacatatataggcagctttaagacaaatttaatttaacagctctattgccaaaatcacttctgaggaagtaactcactatttggtatctttgcaccaggctatactgtcaaaaggtatggattttcagagacagagtttgctgactgagtaatgactgagctgaaagttggcttgcatgcactttttctgtattttctacttacattgttgcatttcacttaccttgcaagagctcactgcatgtcccactgacattcattcctcccaggctattttgcacccccattcccatcagcatcactttacaaagtgggttattttacccagccagttgtccatttaatgtacagaagggtctgtataaagggtctgatcaaatcattgcacaatgcccaggcaattacaccaccaggaacaattactgctttatcgaccgtaaacatttttctgaagttaaaaataacaagaaaaccatattccagcagtttctcaaaaggtattcaatttaaaaatttaatccaatactacaaatatttatttagaaccaacttttacaagttctgagcctataatagaaaattgtgagggaaaaggattatggtgtatgtatgttcgggtggtgtatgtgtgtaaattatcataagatgcatggaaagttttgacatttctgggccagggttagggttaggtgagttaaccataggttaactatgattaactaacctgtgattaactcacctatggttagagttgccctcaattgtaggctaagttattcaggcaaccctgaaacaggctgggtagggaagagaagcctaacaccactggtttagatttgctgcttaaggcttgggacaagtgtgcctgagatcaacctatggatagtccgaggtccagggaacagccattcagaggcaatttttcttggctttccctggatttaccttcctatttaagttttatcatatgtccagaccacacttagaactagaaccaacatttaaaacccagtttatttggctaggattccaggtactctatttaacacttaccacccatccctctccagggctaggtctacaaattagatgattcattcagaaaaatgctattgcacctttcttatctttataacagcaacttgtattgtgaattttcatgagtacttcacgtagattatacccagttctcacaggaacattaggtattacagtttaagaaactgaacaaggggaagagctgaaatccaaacacacatcagtctttgactaaattttggttatcataagttcctgagaactactgctgtcccctgcctaccacactggacatctttggttagtaggtcatccttatgcagttacttgagcttcaaattctggagtctgccttgatattttctctccccccacctacccttatattcagtcattatcagtcattgttcttaattgcaatcaacagatgcaaacacttaagtatcaaatgtgttcattataatatgcttattagaatacagaattgacaagagttctgggaagccaagtttgaggctacatcttcaagagatatgcttagaagcatatcacaaggctggccttatatgaacatgagcctagtaactaccatgcaatgagatggaggaatcacccatcaccttaatgaggttaggcctgagccaagaacttgaccttgcatcattttggtcatcattgtctctgctgctgtcaccaagtatatccagacaccactgcacaactcccaatcccccagcaaaaatataaacaacttcttcccattactcccatttgaatacaagtgtctcttgatttttgcatttgatttctggagcctaggtcatatgtctgtatcacaacagcaaaggaatctgcttatttcaagttgagcttctgaactggaaaggtagaattcacagtttgaaaatatattcaggtaccaaatggcttttcgtaagacactgggcagccccatgtatgaccaatatccaccacagttggctaggcctatagctttattcccccacataccctgacactcccaatatcttctgcagtcaaccagttcacagggatctaaaatgcacatcaggctccaaatgtgaatgcttataacagtttgctatactgcaaaactgcagaaatagttgctgttgagtgctgtttttcaagtgtttttgtaaaatgaagaatttttttaaatatttgcctatgaatttagtttgctttatttttcttgttttataatgttcatttgaaatctgtattgtccctggtcgagacagtactacactggtctgcttgtgggttccagaatgaaataaataagtctgtaagaaaataagcaactaagtaaattagtaagtaaaaacaagccatgcatgtattacctcagaaccagggcactagtaaacttcacaaagccacgttaatcagagtgctacaccatttacagtgacaagaggccccttctcattattattgggacaatactgccaaataagcaaaacacaaataaaactgtccagtggaaattggctaagagtaattaggggcaagtagttttatgtagactaaaatactataattagaagggaggatttggagcactatttgaaggagagaaatcaatagaagagttgctttctatgctccgaagagctttgccagctatctttgttcagtggtaaaatagaattattttacagtaggaaataaacctgggcactaaggatctctgttggggagatacctgggactgccttggataaggagggggtgagcggattgtggcatgacattgtttttcataacatgttaatagcaaaacaaaataccaaaaataataatgatgaataatttattcctgtttgttctcggttaactcttctttagaactttaaatatcaatatcgaacagtgttacattaaagtaaaatgtttatttataacagacaaaaccagttctatactaaataataacttaatgtcatcttgaatctgattaagtagttattttgttaagaatgttctaaactgatcaataagaggaaaactttaagtattctcatatattacttttctgaaactgtcatgatattaatattatgtacttatagttgtggtttgttcctcaaactattacttaatgtgatttattttaaatgtgaattttgcctttagacattcattttaaaaaatagcctattctttattatttttacttagaatttacagaatcctgtggtacagagggacttttccagctcccaggggtgcataaatttcctttttctgtattactggctagttgatgattgacttgcctctgaattatccctaccatgtggccaactagatacccttcaatatggcccattttatctttggacagttctgatagtctcccatattgttaattcgattttttttctcttggcagcttcattttatttgtccttgttaggtctcttaagactaccttgttttttatttttatttgttttgcaaggatggggtgcacaatcagtggtacagtatggttgttccataactttattaaaaggcatataaagtacttgatgctacagagtatctagaaatatgcgttgtgcttattcatttgtgacaataggtattttggcatttttaatacattcattacatttgcaatttaagaagcaaatgaattaagttcatgatgactgaatgggatgggagttagagtttgtaaggtgacctggagaggttaatttcacagcgtgcagtaattgtgaatttttagatggaaatatatgtgtgtaaacctgaatcttaccccacattggagacgaagctgcagagaaagttgttcttttgaccttaaagcaagttaaatttggagagctgcccaattaagaaatttttatccacaatatatttttaatttaattcttactttgtggggatattaaagactttttttcccctccaatttgctatttcagtgctagtaatataaatccattgctaaatccagaggaaaagatttcccatgctttggattttacccggttagttctccagttatactcttaagtaatttagaacctctgaaaaaactgaggttaataaggaataagaaattaataatggaaactaataaacaagagatatggaaattaaaaatactcaaaagaaacaaatccttgaaaatcccaacatacagggttcaaataaaattaggatatttgaagggccatttaggatatttgttatgcttttgtaatattcctgagagtgtataccacttttgttcctattttacaaatgaggaaactgaatgtcagacaacttaataactttcccaaagccacacaactaacaggaggtcaagactgaatagtcagactaaatctggaattaggccgtttttagaaactattaatgaaatggaaggggaactgagatccatcaaatgcaaaaatgaaaactatatcataagtaatctgctggcatttgatgcttatttatttctcattacaatcctgtgggttagctattgttatcttcctttttcacataatgaaacacacgtttggaaaggttaaactatttccccatgttggccatggggaactgatagtcagtagacctagcatttgaacattgagctctggactgcaaatcttatgtcgtttttttactctgcaaaaaattgtaaactctttttagtaagaaaatactgtatttgaataatctatttcatagaaacccaagttaggtaaggtgccaattgccgcgacccctgttggaccacccctagacgtttccaggacacctgcggacttgaaagtgcccatgctaccatgctgcctaaagtcattctagttttttgaaactataattacaaataatttcccagatacaatcatattaacatatacatacacagtccctcccatgttactgtcattgattcaacatatgtttattgagcaccctctatgtcccggactgtttcgaggtgctggggaatataaagatcaaattctggcccttcatagaacttgcatggtttttactcccatcgtttagcccactccagtgagtcattcactgtactgtcttggtgatatctgtaaactttccatctcctactagcttttaagcccccgtggtacagaaagtgttttattcatttttgtgtctcccacagatcacctgccacagcaatattcccagtgcatctcttcttttacactattttcaatcacaagactataacatgcagcttcgtaaaattcatcccttcacctaaatagattccagctgtgacaatgtttataatttccctgtagcttgaaattttcatcaaatttctacttttagatatgcaaatttacgattaatcaatgagtcactgagaaagtatgaatcattttttgttcacagcacgtcaagatatgttacaaggtgcaagacttaacattaactgcctttctaacttatgaaaaaaacattttaaccacctaaaaagggtgttttggtgagcatttgttagaggactgggagttgtttctctgagcagggttaatagagctgagtaattttttacttataaagtcctctaaaaatataaatatttttgtctttatttgatagtgtcataaatgtctttgttcctctttgaaagccattatataacaaaaggatcattttgagtaagagatttttgactttaaagcatatagttatttgttattggatatcccaggatatcttttgaaagtctggagttgttgtcaatgactcacagtgacaaagtgcttttgtgtgtctttatttgcatgcctgagggaatcactatttttaaaaaatagattttttttttttcacacagccctttaaaagaaagtgtattgtggctactgaagaaattcccagagcaatgttaagaattacaatttgcataataataatttttcctttgcctcaactcagtgaaagccaccctgattaaaaacagtttgctggaagttgctagttactagaaggcacttgaactaaatgtatttggcaaatttgtaacccaattctgggatgcaactctttttttccctaaggcccatctcagcataattctcccttaaagtaaaatataaaatcaactctagacagctcttaggagtttttactggatgcttttggtgtgtgatgggattgggattagacaccatacaccacaaagtaaaacttctgaagaaattctcttccagctttatctggagtcagatccttcaagacaactctccacagctctatttccctgatttctcctcagtcactttttgaaaattctagctgtagcttcaggactttctcattccaagttggcccccttctcctacattctgaattattctttttctatggcatgtgattcattcttatataatttaagttaacctcttaagacttctagtgtttctctacattaaatatctaagtcaatacaacggaatcctgggagccaagctgagcaaaggaagagtcctccttagaagacaggggtagctaaaagcttatgtctatttatactttgggatttttatgtttattacactgagagcttaaggtttcagttttcttttggttaatggttctttagaaaagccgcacaattaggacctcacaaaatagctctacctgggtaaatgtaccaccttcctgcgagaaaccctcagctttgtaatgaatcctgcatttttgtcagcataccaagagtgcttctatctcatgcgcatcacaaatatacaaccaggatgtaaaatcacagtaataatttactttggaaattatgacttttgagaggacaagactctgtgtttgatatgtctacttcatttcctccatgaagaagacgtaaggagagagccaaattttactctaggaaagttatttgatatatctagaatcataccaaggggtcttaaaagttcattcttccattgtttctatcactgcaaattcagtacttaatctgagacaaggactctgccgggaactaggactataatgatgaatatgtcacatcagctgccccatatcgcatagtttagtggcagaaacagtattaaattaagaactcaaactaattcagaaggaagaacagtgttcagtaagagtggataacttgtggctttccaaatatatgggttaggaaaagcttttccaaggaagtggaaagtgagtttgtatgtagtttgtatgtaggaatggagacaacatagctcatgcatagatcatgggattgatcttatgtaccagcataagagtttaaaattttgtttttgagcaaaaggaatttatctttttctaagaggaccaatatggtcaaatttgtattttaaaatggtaagtatgcgatataaagagaatgtggtagagggtgaaggagattcagtaccattaggagatgatagcaggaagtgcagatagcatgggatggtcactaggcttatgaggatggaagtggaaagtgagaaatctagatggatttcttcatttatgtgcagtcaaatcaagagcacttagtatctgattagaagttggaggtgaagaggtagtgataaaggtgactctgaggtttttggcattaacagctaggtgaatggtggtatgaaatatagaatgatatggtttggatttgtgtccctgcccaaattgcatgttgaattggaggaggggcctaatgggaggtgattggatcatgggggtggatttccctgcctgctgttctcatgatagtgagtgagttcttgggagatctgatggtttaaaagtgtgtggcacttccccccttcactctgtctctctcctgccaccttgtgaagaaggtgcttccttccctttcatcttctgccataactgtaagtttcctgaggtctcccagtcatgcttcctgttaagtctgtgtaaatgtgagtcaattaaacctcttttcttcataaattacccagtcttgggtggttctttatagcaatgtgagaactgactaatacataggtaataaccaggtttgaaggtaggatattaaattcagttttgtatcagttgcaattgatttaggctgcataaacttaaaacagtaatagttgttgaaaccatacaaactccccttctttcacatatcaagaagatcaagagggtagttccaagacgatacactggttcaggcccttttattccatgcctattgcctcattgctacattgctacaaaatggctacaacagacatcatgttatcattaaaggcagaaggatggaacaggaaagtattaacatgctctcctcttgttcttatcccttttataataagcaaattttttacctccaagactccagaagattcatttataggtctacccagccatggcctctctaaactgcaaaggatgtggactgtttagaaaaggggaaagagatcatcacaattagcttagaacagttgttctcaactctattagacaccaactcttttgattagtaatctgaaatgaaatttacagatgtaatttacctacacacataacctaacaagaaaaaatgttatgctctctttgtcataacacagtaaaataaaagaatatgtaaacatttgggccagattcaaattgaggtaattggattcttgcaaatatatatatagaataatagagtaaatagtgtttgcagcaatatatggaatcacaacaaacacagcagcagtgatgcagactgatatatttttgctgtaagggcgtcacaaacataatgagtccagttactgttgctttctctaaaatactggacaactcttggtaacattccgattaagacaatgtataatgtttcctgattaatattttacttgcaatcctgctgcacattggaaagtggtaggaaatgcagaacaattatttgataacacacttatgtcccttcacattgtaggatgacacttcttagacctcgctaacaaatgccagtaatatccccaatcattgtgacaagcaaatttccaggaaaaaaaggtataatttacatactatacatcagaatagaaatgtaagatcaactgaaagcaaagaaagattgatttccttgattttgagtggcatctcatgcattcccacttactgcctatagctgttacagacattcattacaaagttaaattaaaggttactctgtaataatttctcattatatgccaagccctaaaagaatctaatgaattctgtctaggataacactaattgtaaggttaaagtttcctggggaaatcttgcctggtaccttaggcactggggaaatgtatgctagtgatttcaaagtgaattaagaaacaagtttttaatccgtcttttcaagaattttaatgaaatacctagtttgtatctttagaattctagaaaagtacctcatcattttagactgtttccttttaaatcattggcatctataggctaccatcctcttgaactagatagattttaacctttttccttattcattctaatttagcttgtcgtatatatataaatatatatatttatatatttatatatattttgatagtggctatttgctcattaaaaatcaaaagttaaaagtaattaatctcaaaaaatggttaactggcttacctgagaaaaaataaatttagttggtaaaggctgatttaattaaagtttatatgttttacatttcctttgctccatgatggaaataagtatttttctttatgatgtggttcgccatctacatgaacattttaataagagaaagcaaaataattttgaagaatacattagtatttgtaggagccattcatactgctttctgcatttaaggtaaattagaattattcactaagtcaaataatgtcaagtagaaaacagaaatagatgttgatgaatgaattaaatatgattaggcatattttattcattgtttttttcattttgaactttttaatgaagtcattgaaataccaagtcatggtcataaaatttcttaattcctcttaaaaaattaatttaataataaacagtcatttaattagtttataaagcaaaattgaaacactttgagtataggacttaatagtggaatttagagagttccccagaactcttcttagcttttaggctcttagaagataaaattgtgtgtctgtgtgtgtgcacatgcaataaaacaataaaatggcctactaggaatacatgaaacgatgttgtttattgttgtgatgtttcagataagggaatataaagtaagattgattagtaaaagatgaaagaagagattagtgaatgatggattagtaaatgatgagcgtggttttgagcaggggcttgaagaaatgatgggtatgtgaagcctagaatactgatatgaaattacatgctgagaagaatatggagaaaataaggcactcctgaagtgcatatgtgagaagaatggcttaactgcactggtgaaactgtgttaatgaggaattgaaaattgcttagttagaaatagaaatgttgagagaatgaagaggttgttgatttaatgtcttagatgtggataacaaaaatgaaagactcttgcagagattctttaggccctagcattataagaactatatgtgaggtagtatttgtagtagcttattggagaagtgcagagttggaaggatccagaacatatgtaaaattgctgagtactttacgcattaggtgatgaagaactagatgattaaattgatggcaaatacttaaatataaatatgtatacataaatatagaaatatatttatgaacctggtaatgacaaattgaaaagtatacacacatgcaccacaaagtatttaaccatatgaatccattttactaaaattgaattaaagaaaatattatttctccccattatttcacagtatgtaaccctaattttattttctttgggaacagggtgggggtttggagggactttgaactataggtatttaaattattttgagagcttttttttttttaaagaacaaacaaaaattttcattattgaatgctattatcttttaggtttctactgaattagcataaaccacttttgttaagttaaccatctatccttgtgaagtgactagaatgaagggttaatgatatacttgcagggtcaaagataaatttgttgtaagaaagtaagacaatattctgtttataatatatttgtatatatagatttaatatttaaaccattaatatccttagctatcttcagtaatgctttctttcacttttaaaaaagaagtattttagtcatgtctaataatcatatctgtacatgttctttgtctaatcactttgaaaatacctatttaactaaaatcactgtagaataaaacaaagatcagactttcctcgtttgtatataataaattaatgcttttaaaatctgaattaactcctgcagtaacaaggcatgctctgagaggaaaatgaaaagtccttaattctaaatttaataatttgcaaatataatctctactaaacaattttgcatgtatacctactagacctgccctgtgttattcaatagccactagccacacatggctttttatatttaaattaatgaaaatgaaatacaattaaaaatatcatgttttttttttttttcttttaactttttttcttttgagacagaatctcactctgttgcccaggctggagtgcagtggtgtaatcttggctcactacaaatctcatgcctcagcctcccaagtagctagaactacaggcatgcaccagcacgcctggctaatttttgtatttttagtaaagatggggttttgccatgttgcccaggctggtcttgaattcatggccttaagtcatccgcccacattggccttccaaagtgctgggattacaggcatgagccaccatacctggccatgcgttcatttcttgctgtggagcacaaagtgttacttgagtatcctttgaactttttagagattactttttgcagctaatgctagaattttgaaaccccagacctttgtcaaccatcaagaaatatagttgatgctaagtaagcacttgtgctggacaataaatgtgaacattttgtattaacccaataaatgttgtcttgaatcttacaagagatgtatccacttacaaacttcttacttataaatgacattgaagtgtttaagaactttacttctagtgagaaagacactgaaaagttcaagaaagttctaatgtgttattcattccaatgaatatcgaagattaatgaataaggcaattaagtaagcattccttcttaatcttgactacaggtaagacaagaggaagcagggggcacaaggatactgtagaaaaggaaattttacttagatatgaagaaatgtttcctggtgtggaaaggaattgcacattggaaggatttattgagtgaggttgtaggatttggggaaatccttaaaaatagaatacatttcaatctctctagggaggtatgtgatatgcctgcaggcattgagtgtggggatgaattagattcattgtcatggttttctcacaccaacaattctatgaatctatagaggacaataaaattggataattctcactgtgttcttcagggagtcaggtttccagactgatttttctagcagtgaatcaggcccaaaatattaccttacattcaacaacttttcaaatgcagtaaagaaaaaaaaaaaaaaagaaaaataagaaatgccagcactttgccattttaagaatcagtgtttcttgagatggattagtatttcctcttctttagtaagaatgaaatgatttgggtctgagtgtaagcactactattggaaggaaaatcttaaattcctattatatagctgagtttaagggaaaatgaatttagtgtgatttgaaaatacatatgaaataatgaattttgcctttaatctgaacagtaaaattagtttcacatgtgataagctctagttgccattttgagaatgttccattagaattacacaagtttggtgtttcagcctcctggaatttgttccagcactccaatattcaagcccttggctgtgctggaaatgaggcagcaggcactcaggtcagagctgcaggcaaccagggatttgggaagtggcccaaatgcactcactggagaggcattggaagaaattgtacagagaagaaactgggacaacagacctgagcatgctgctgtggaggatggggtggctacatcagagttgcagtgaatctagtcacatattatttacatcaaagaagaaatcctaagccataattcatctgaaaagccaatggctgaagtttttgtttttaatctagtgatgtaattcttcgccaggtttaaaatggaaagcagaagcaggtcaagctgagtcatacacacaaggccaaatgtggggaaagcaggaatcaaaggctggaggtaggggaaattctaaatctgcagagcaccatctttgagaaaaagaaaaagaataaaaacctatactggaaggagaacaatcacgaagagaactggtgggtgaagaagttgagataaattgtgcaagccttcactagagataatgtccttttgataggccggttggtgtagtagaagaagcccctgttttagagtgagaagtttattttcacatgctggctgtgagactttgagcaaaatactgaatctctgctccttcatctgtaaaattcccataataattcttattttccaggttgctgtatttcaaaactgagcagccactgtacctgatatgcagtagaaaattaataactagtagtcactgttattttgttgacttttcagtgggtagtggagtgttcttagcatttattcattcttcattcattcagtaaacatttattaaatatacacagaataccagagagtactagaaacagaccacaatcaggagtagttcattagttcttaaattgccttaccatggttaaactatctttagaatatggatcactagcagcagagtatcagcattatactagcaatagagagggaggcaccaagattgaagtgaattgaagagaggaattgcatctgagttgggcaatttttcttatgggatcataggggtttcagatatctcagcatctgatgtgtccctctagagcaggggtcctcaacctctgggctgcagacccatatcagttcctggcctgttaggaactgggtggcacagcaggaggcaagcgagcattacccactgagctctgcctcgtgtgagatcagtggcattagattctcacagaagcgtgaaccctgttgtgaactgcacatgcgagggatccaggttgcacactccttatgagaatctaactaatgcctgattagttaatgatcatctgaggtgaaacacttttatcccaaaaatcatctccccaacccctagtccatagaaaaattgtctttcaggaaaccagtccctggtgtaaaaaatttggagaccactgctctggagggatttctttatctttgggaacagcaccttggctagtcccacaggatttgagaatatattgaaggctttcttatttaaaaaaattataatttgagtagaaaaatagaagaaccacaatgtgtggtttagactaagggatttatgattgggattaaaccttatacaattgcaggacacagtggggaaataagtgtctgaaagggggagattgaaggatcagaaacacacacacacacatacacacatgaacttaaggatcatgaagaggaacttatgaagaattatggaaagctgtcaccacgcttttggtgatgggcatgaagttattgtaggtgctctgggcagctggatataagacaaggcaaagacaaacttggacccatgaggacaaactgggactgatgagcacaaacaagaaaccttgagaaaatactcaaagcccctacaacaaactggaagccatgtctgtgtctcatttcttctaatcgcagtgatgttggccacctgcagaaaaatctggtctcttcatcagggatctgcataggcacatgacccaggactcagaaacagaagggagatggggaaaaggggagtttggattaactaccagtttggctgctttgtcacaccaatgaggtaaaccttcagatgagtgacaatgtgagtgatgtgcgatgggtaatgccttatctctgccttccataaacagtgcatatttctttatgatcaacaacctaataccacacaggaaagggagttctggagaatttgcctaatttactttttagcttagctatgttgacactgcaaaatcactcccaagaagagagaagagatttgatattattcttataagggagcattggcctttgatctaactctttctgctttggcaattctcagagaggtatgaggaggggttgggaagcgtaaaaacggatgaataaggaaggcatcccaggatcatgctggggacattttccagctgatcacctctattctgttgcttcatctccctgaaccctgcaattttgattacagtttctttagaggatgaatacacaccccgctgctgctgaagaatcatagcatagcaagtcaccaatactggtgtaaaagcagtcattcccttaggtgtatctatgtgcaataaagctgagaaccactgatttatatactgtagtagcttttgtatgtttgtttttaccaatgtattcttgactccttaaagacaggcatgcctacctattgttctacaactcaagttacctatagtcttgttatgcagtatctctcagtttgcaaacttaggtatccccaagggccagacataaaccacaaatgttagaccaaaaaagatggtgggattgaggattacatctggagcatgcattgcctaacctaatgccattcaaatgagagaagagaggcatcaaccatcgcttctgacaaaatgagggaggctgccattttcatataaatagctcgcttttcttactagtaatataagattcacttggtataattctattaaggaatcaattataaattatactgtgaccggcaaatggtgttcataaacaatgcagatatttatctgctttgacaataaccctctgatagaaactaaaaacattttaatatttcaatgaagtagcaaatgacctactaaaaatgttctttattgaaatttattggcataagttggaagaaagaaaagaggtatattagcttattcttattcttagcttattctttcacctaaaattataaaatataaaaagtttaataacatgaaaagtatgaccatgatttaatataaaacatctactgctatgattgaattactgaaagagaaaataatactgaattatgtgtgtaaaagttgtgtatattatgataaaaactcatgattcattaacactaagttataaatcatcacatagcattttttaaaattttacaaacagtactgtttaggagagtatattctacactagtttttcagttcaacatcttttcataattgttcagcttaagcttttcaattgttgctaatgtgttacatcacaaaattagttgaacacattttaagagaaaggaatatatgatttagaaaagtttaccttcaatgaggtatagaagtttagagatagttattttcagcttcaaataaatagttttgaatttttttttacttgctaaacatcccttccatgcattttgttgcataaatatcctatgggaatgatagacgctattaaatagtcaacaaagcaagaatgacaactggtacatggttggttctttgaactgtttattaaatgagcaaatcaatgaatgaataataaatgaaaaattttcactcttggactatttacctggttttcttaatagtaaattactagtcagttatgtaaaataaataggtgtttgggcactcttgggcatacatgtatgatacattttatattttctagaaggttccaccagtcttctcttacatattgaagacacaaatatttcactcatatattcacccagtatctttctcatttccagctaaacatgtttttccttttcaaattgtgttaatgacctataagtgagtcctcatctataggatgaaccaaatttacagtgttgcaaaactaatgttggccataaaaatcaatacattgactacaatctataaactatttataaaagaattgatgttcgtaattataactcaatttatataataaaaggataaaaatgaacaactaaaaggaaattactggcagcactgccactgatatctagcactaccactgatagtgtctagaaaattgaagcaaatgtattttatgaaagcagtgagttacttagaatggaagaagaataaagttttaaggtttggtgaatctatgtgctaactcaatactgatatcatattaatcaaggttcttggatacagacaacagaaggcagttatgggttttactcagaaaatgaattttttagaaggaaatggttagtacatagaattgaaggaaatgctggaagattggcagaaaccacagaattagaaatggttaagaacctaaagcatctacttagccaaattgtgctcttggaatagtagctaggaggtccctgctgctggtactagaccacacactgaccgcatggacacgttggcattggctgccactcatagatgcttcactgtagcttctgttgtaatcagttctgaactgttcttaattctttgtatcacttgctctagattcatggtcccagatgatatcatccagttgtttaactgggtcacatgtttatgctctgttgtctggtgccagagagagagagagcaattaactgtaattttcagattctgctgtggaagggaggaccctacctctaataaaaacatgtaagaagatgatctcccaaaattggaagggaatatgtatgcatcaaaatgactaatgagcactaacgccattaaaacgttgtatgacctaagagggcaaattattcaacctttctagatatcagtttttaaatgtgcaaaacaaagattgagaaatggataagatctacctctaaaataactaatttgcagtttagttagaaagataatataagcactctgtaaacaacagctacaactaccaaagatctgcagtagtgggagtgaaaatgaaatatcagagatggaaaaggatgtttaaaaggtggctggaggccgagtgcggtggccacgcctatgatcccagccctttgggaggctgaggagggcagatcatgaggtcaggggatcgagaccatcctggccaacatggtcaaacctcgtctctgctaaaaatacaaaatttagttggatgtggtggcttgtgcaggtaatcccagctacttgggaggctgaggcaagagaatcgcttgaacccaaggagttgagccaagatcacaccactgcactccagcctggaggcagagtgagatttttgtctcaaaaaaaaaaaaaaaaaaaaaaaaaaaagggtatcctgggagtttgtcagtctgcatctgtacaacatgtgctgttcacacaatatacaaacacatgataacagctggatactattcctgtcaaatcagattttcacaacagtggcaaaggattaagatgattggagaatagtaggaaatagcctctatatgacctaacatactaatatcttaggttatttaagacagatgagaggacaaactgtaccgtggtgttcggggaaaaaaaacactccgtagaaattctcttgaaaacaaagccacctacatactacatagcaattttagagaaatatgtctcattttcattttcttttttcttttgttttcttttttcttttttttttttttgagatggaatctcactctgtcacccaggctggagtgcagtggcacaatctccgctcactgcaacctctgcctcccaggctcaagcgattctcctgcctcagcctcccgagtaactgggatgctgggattacaagtgcctgccatcctgcccaactaatttttgtatttttttttttttttttttttttttttttttttttttttttttttttttttagtagaggcagggtttcaccatgctggctaggctggtttcaaactcttgacctcaagtgatctgcctgccttagcctcccaaagtgctagaattaacaggcatgagccactagcgcagcctcattttcttataataccattatatgttgtttgataatttttcatatctttcaataaggtttatatctgtcaggaaaaatcactattttttcaggtgcctcacaaaattcaaaggctaggaaaagcatagaccttttctataatttttgagaatatattgatttctgtgaattgtgtcacaagacatagcaatctctcccatacttttcttccattaagaaataacacttttatagtatctttcatcccagaccacttgagtgttattagaatttcaccctgtccttttgctttatctcattattataggtaagatatcctagcaaataagtaatattaaaaggcctcaaatcacagtggactggaattttaaaaagctatatcccattgatttaaagtttagaaaaatgattccagatctatgctgtcacttattctctgagcttaaaaaaagtcaccttttccttcctttttaaattttctcatgtggtaatgagggaatgtcttaaatggttctaagatcactctgatttctaaaactatgtgattctatcataccactgtacttcaacaagtctccaactcgtgatacacgcagaagtttcattgagttgatgtttcttgatgtatttcactcttctgctgagaatttgtaactgaaaaacgaaataagtcaaatatataagaaacataaaaagtacatgtatctatttagatatgtgcaagcgctattctctccctctttctcaaagagaaagaagtctagatacagaaagatgtgtatattacaaacgtagtttaaaattttacatataatttatttgtagggatacttagttatgtgataatgtactattataattttgatgcacaaaattatatctaaaatgcttagacatatgttttggaatttataattagaaaaataatatagtgcatataccatgttttacgcaacactcccagtagcatttggtcagtgtattagtctgctttcaggctgctgataaagatatacctgagactggccaatttacaaaagaaagaggtttaatggactcacagttccacgtagctggggaggcctcacaatcatggtggaaggtgaaaggcacgtctcacgtggcagcagacaagataagagaacttgtgcagggaaatttactcccccttataaagccatcagatcttctgagacttattcattatcatgagaatagcatgggaaagacccaccaccatgattcagttatctcccaccaggtccctcccacaacatgtgggaattatgggagctacaattcaagatgagatatgggtggggacacaaccaaaccatatcagtcagcaacccataatcaaagaaattaacagttatacactgaaataaacttagtattcataaataaacaaaactacaataattccccatcaacttcatggcaagtttgtctggcacgttagtttagatcaggtcaagtttttccatcgcatgaattaggaaacaaagcttttaactttaaaaaggttttaggcttgagctatatgcataagggattttgaacctatgaatacatgatttgtctgaccagaaactagtcttttgggaaagagtttttgagcttgcttctgttctagacatgtattttgtactgaagtttatcgctgtcctcaggccacaccctcccctggacacagtggagagcagccctgattatttactgagcagtgctcacactgtcctcttgaaatccaataaattcttgacaagaaaactggcatcaaacttaacaattacagtggaaaaaactagtatttatttatttatttatttatttatttatttaacttgataaaggtcaaaagaaagagatatagacaagcctctgcaggaaactgtggtaattttctgtcaataaatacctcagactgaaagtcttggttctgcagattgtttctcctctctgactgtgaattctctcttcaacccagttaagttgtttcctacttctgagctgaatttaaaggagacatgaaggacattcaaagagcttcaggggggtaggttgtggaagacattactaggaggatttcttccccctttaatcattggctttacttttcattgaaacatgttacttttaaacttaaaaacaacccagcattttaatgctgcaaatgaactagctgaattacttattctgaaagaataaggaaaataaatgatactagtgaataaagaatacctagctctcacagaatgctttagtttaagtagttataggaaagtgctctccaattgcagtatattagcctatagcaaaccattaaaaattcttacgaatttttttcttcccaaagaaaactatttaggcatcaaatcagttaatataatgaattaaaacagaacatcactttggtggcacagtttcaaaacagacggattagagacattcagatactgaacatgcaacaccagctatgatttcagcagggagtcttatttggcctttgttcatcttaattccatcaatttcaaatgttattaacaacaatgggacacaattccaacagtgatgctttacacagccacgtaaattttgaataattttagtccttgcaccattttgtttctaagggcaggtatacaatttttgttctaggatgtattaaaataaccagtatttcttccagtgagcattgaagaattaagctgtaaaagacaataaatatttagttttagtgtttacaggggaactactactacttacctgatttaacttagttatgagtaaaaatttggataggaagactaagatgagcatcctaacctactgaacctgctgctaaagtaacaggattgtcaagaataagaagttattaattttaacgtaaatgaaaagtagttttagagtagttagaacatgggaaattttacatacaaccacacacacacacacacacacatatacacaaccatacacacataaagtgttttgtgcttgggtgtaaactaatcatgagtctgttaaacggggaaccatatgatatgttcagtaaaattagtatgttagaatggtaagagtcagaaacaggaacaaagaaaaggaaaatacgagagcagcagaaaaaggcagtgtgcagcaagtgaatggcaatgtaaaatctgcagtaaagctaggtggaagtgtttagaatctgagtaattacacaaactacagatgtttaggtggtcagaaatattttcaggtcgtataaatgtgcaagtttgtagaagcctggaaacagaatgagggtatttcaatttattcactttgtggaagcaggaggtgagggtcactatgtgggcagtatatatagctgccttagattgtcagaggttgcaaaattgcattgttccagaaaagtgagacaaagacagtttcattaataagattattatgataataataatgttacccataataatttttacccatctctgggtaaaaatcctcaaagagtggtagtgctgaaattaaagaactgagcaaacacagcctggcctatgatgtgagcgagagtaagaattaattgtgctacttccttatccttataaccccatcctcttgctcctcctcacggaagccccaatgacaacccctgtagaagcagattcattacatccacattcactcagtatttactctgtcaagacctgagctaagcacattcatatatttaatattatctgaggaaattaatttgtgataacaggcattgctattattttacttttcactatgaaacagatatacagcaatatccgaggaagattttaaaagatttttagtataacgtatttcgtgatgcacggtgacattctgcgtctctcactctttctccgtcacaaaaaaagccacaacaaaaaactacttggaacttacttcctccttgtatttctgcattgaattccttatgattgtgagagtaacatcatagataaaatgaaataatgtttaacctatggagcacaagtttattaaaaatagggaataaatttatgattatcacacacacacacacacacacacacacacacacagaaagagagagagagagaagggggcaggaaaattttacgtattacttaactgagtagactgaatacaaaattcaaagttcctaagggggctgctttgtgaaatactgtgctgtgatatacacatcattagagatgagaaaactttagattcatcaacaatttagagaactatttctaaagataaatcctttgaagataatgtctttatgaacaggtttcttgggaaaaaaataaagttgtcaaatgccagtgtagcttttattatacatatatagagagacagcactgatgatttcaggaaataacacaaacacacatgcagtcagtgagaattctgtcttgtggaagatgatattgatgctgtgtgcagcccgctaataaaacactcagttgtgattagcagaagagctgaccagagtataaagtttcttacatgaatttttgtaaaaaactaaaaacaaaacaaaacaaaaaatgctttagagtgcttggcaacaaatgaagtcattcatataaaaaccatactaggggcttcaaaatgtaaagaaagagggataaatgttagagaggtggtacttcttggctgctaatggagaaagtctagtatgactttacaagtcaataacagcaaataaaaattactgggctaattttagtgaacatctgtgactggagtccactattttggcagaaaaaagggcaggtatttgccttctgagaactctggcacgtgagcggcacacattcacctacattcagccaatcaaaagcgttctcctagcattgctttagtctgaatgtatcataaagcaacaagaatagttcaaaatctattctgcatgtggtagcagcagcagtagcctgcatacagtaatagaggtgggaacaatggggccagtagcaatttaaaaactgtctgctcaggaggccaaggttggaggatcacttgaggctgggagtttgataccagccctcacagcatagggataccttgtctcttaaaaaataaaaataaaataagctagtcaggtgtgctggcatgagattgtagtcccaggaggatgactgggagaaccacttgagttgatgagttccagccaacaaagtcagaccttgtctctaaaaaataaataaatagtagtaatattcctttgggtatatacccagttatgggattgctgagttaaatggtaattctgattttaggtctttgaggaatcaccacactgcttttcacaaggattgaactaatttacactcccaccaacagtgtgtaagtgttccctttttctccacaaccatgccagcatctgtttttttttttttttttttttttttttttactttttaataatatccattctgattattgtgagatggtatctcattgtggttttgatttgtatttccgtactgatcagttatattgagctttttttcatatgcttgttagccttatgtgtgtcttcttttcagaagtatctgttcatgtcctttgcccactttttaatggggttatttttttttcttatgaatttaagtttcttatagatgatggatattagacctttgtcagaggcatagtttgcaaaaatgtcctcccattctgtaggttgtctgtttactctgttgatagtttattttactgtgccaagctctttagtcaatttttgcttttgttaaaattgctttcggcatcttcatcatgaaatctttgcttgttcctatgtccagaatggtgttacctaggtcatcattgagggtttttatagtttcaggttttacatttaaatctccaatccaccttgagttgatttttgtttatgatatatggaaggagtccagtttcaattttctgcacatggctagtgagttatctcagcatcatttagtgaacagggaattatttccctattgcttgtttttgtcagctttgttgaagagcagatagttctaagtgtgtggcctcatcttcgggtctctattctgttccattggtcaatgtgtctgtttttgtacaaatactatgctgcttcggttattgtgtcccttcaatatagtttgacgtcaggtagcgtgatgcctccgggtttgtcctttttgcataggattgccttggcaattcaggctcttttatggattcatattaattttaaaatactgtttctctagttctgtgaagaatgtcattggtagtttgataggaataatattgaatctttgggtggtatggccatttttatgatactgattcttcctatccatgagcgtggaatgcttttccatttgtttgtttcatctctgatttcttcaagctgtgttttgtatttctccttttagggatctttcacctcctagttagctgtatcctagctgttttattctttttgtggtaattttgaatgggattgtgtttgtgatttggatatgagcttggttgttgttagtctataggaatgctagtaatttttgtacactcattttgtatcctgaaactttgttgaagttgtttatcagctgaaggagcttttgtgctgagactatagggttttctagatataggaacatgtcatctgcaaagagtgatggtttgacttcctcttttcctatttggatgctctttatttcttcttttgcctgattactctggtcaggacttccaatactatcatgaataggagtgatgacaaagggcatccttgtcttgtgctggttttcaaagggaatgcttccagcttttccccatttggtatgatattgtctgtgagtttgtcataggtacctcttattattttgaaatatgttccatcaataactattttactgatcattctaccttaaacacatatcaatgttcattgcagcactatttacaatagcaaagacatggaatcagcctaattctcaccaacgacagattggataaagaatatgtggtacatatacacaatggaatactatgcagccataaaaataaatgagatcatgtcttttgtgggaacatggatggagctggaggcaaactaatgcaggaacagaaaaccaagtattgcatgttctcactcataagtgggacctaatgataagaactcatgcacacaaaaagggaaacaacacccactatggcctacttgagggtggagggtgcaaggagggataggatcggaaaaagtaactgttgggtactaagcttagtatctgagggacaaaataatctgtacaacaaacctccttgacatgagtttacctgtataacaaacctacacatgtactcctgaacctaaaagacaaaatttaattaattaatgaaaatgaaaatgaaaataaatagaacactaaaaacacagtcagtggaatcattttgcttgtggttctaaccaaccaacttcctttgatttctgaacattttcaagcctgaatcacctttattctcattgattccttttttgaaaatttttacatttttaatttttgcaggtacatagtaggtgtatatatttaggggatacataagatattttgatacagacacataatgtgtaataatcacagcagagtaaatggggcagccatcacctcaagcatttatgctttctttatgttctgtgaaccacacatcacttatatatttaggttattttctgctcaagatattcagagtcattttctattatttgccattcagtatcttgactgcaacccacaaacaatacccaatactgtggtggatacaaactgtcctagtttccagtatgagccaagtccctaaagaaccatatgattctttattattctgagcttcttaaagtttagagttatcacttaccataatttttgctttttacagtctgagagcacattctgatgtttaataaatacatcttgaatgaaagaataaagtaggtattttatacctaatttaatagaagttttattctcacagagttaaagaacaaaagctattttatggaacacgctaatcccactatcaggaacctataggaagaattatttgatcccatttgtaagaattgaacacatgaatgttaatggtacaaaagtggtacgcaaattcatgcttttttgaggactgtcctttctaatgattttgattccttttgctaatattataataagtaataataagcattcaacttatttgccaaagtagatataaatactttattagaatatgtcatccaacgaagattttgaaatatgtaagagtgaaatgagaagtccttggccaaaataaatcgactagtctttataaattctcaatctaccagagccttggctgattgagaaacacaactgccattgtaaaaatctccaaaaaagactgtgatttccattttctttccttgcaaactggtggactcaaataagcagaatagaatgaagcaaggtaacattttccgaaagtgaaaagcttctagagttatttgaagaataagtaagtctgtttacaagaaaaatgtaccatacataatgtgtttgctttaaaaagccctttgtaaaggtgacacaccaaagaccatttaaaatctaagtcattgtaagatagcttatgttgtcatgaatagaaaattgacttatactcaaggaacaagggcaggcacttctttgaaagaaaaaatttgaactaaggctcagtacttggaatagttttattttacatttttacaaaacatctgacagtgcttgaccagtaaaatttgtaatttagcagataatactaaggatttccaggtatgtcagaaatatttcaagtggatctgagtgaagaaataaaattgtatagaagttttattgtcagcaaatacaagataatgctttagaagaaggttatatgtatgagcccagaaaggttaccacttacctgcctgtagcagaggcaattactagcaccagaaagaatgggtaagagaaagacagaaatctgtgttatgggaggctagcaagtataaggcatgacatctcccattgaggaagcagggtacttggcaagttgtcaaaactgagcctcaaattactggaataaaagaaatttgattactagatggaacagggattagaagagtagtcaaatcagaggagaaataggccaagtcaaagcaggactccctgcagattctcttgaccctgatgttcatgagtttcttaatttcttctacattgagggtattttcctgtctttctgattaaagttcatattagtttctgaccttgggggtcagctggattctgcagttccacatcattcactccggcaaaggagagaacttgtaacaaagatgagtgccaagtttagtcaatttaccctacctggaatactatatacaactctgggtctcatgtgtgttaaaatacatacagtgaagctgaggaagagccactgaagtaaaaagtattgtttacaagttggaaaggatgtaaaaataatctaaagtatactaagtcaggaataaaaggcagagttaataaaattgtggctggtactgatagactaaacagatatattttctaaatcctggaataattattaaaaaattttacatgtatcaatggattccagactccatattttaagtatcacaactagtgtaatttaaaagtatagtttattgaaggtctggagtctgaataaagtaccccaagtgagtcttgtgagaaggtaagtttggaacacactgacttacaaattttgtgcttaatttatggattttgtggccctcaaaatatcatgtgggctaaacaaaagaatcttgaagaatttaaaataaatcatgtccaaaatgagttgtcaagagaaactgaatatattcttttggtaacagccttaacattttgaggagatatcatcaaaggttaactgttttttttttttttttttttttttcttaaactgatcccatgagatcagttttcttttagatgataccactttcatagcctgaggcaattaaaaatgtatgcttatttgttctctagtaggtagaaagttaagtccttaggaataggttgtgctttagtgttcttgaacatgtgagagtgtccttttctatactaatatttcccaaagaagactcagtattttatccacccactctgctcaaatacaccccatgcatcttaggaactaggaaaatagagtgattttcatgtaaaccattgaaaattcagaatgaatacctccaaacaaatgtcagaattacacatccataaaaccagtgttcactgaccttaggcttagcttagagttctgcaaagttttcaagatacaaataaattataattatcaatattaatagagttgtcaatgttcaccatcatgaagaagtaaataatagattgtgagaatgatatgtgaaattttcctatgatttatttaaagaatttaacaaagcaatgagattactggctagcgctcttgaagtcatgtttaatatagttgcctctttctagaacacatgctcttcaatgtttccttggatagataaactacgttttattctttgattttccttaaacaactacaatcaaaaacagatatccacttaattgttttaccttcaaggtaacatttatgcttatatccgtttatgccttcttaattctctgcaaactataacacattttaatgtgtgccaataaagttataaggtcagccatttggagctatctctggtgctttgaactcacagtatcgaagtaagattgggcatggcttgctatatttaatcttttcaatatatatagcttttgagttagacaaactcttatttccaaagataaatgtgcatttgagagtttaattatgtatttcttaacatttcatgtattttaggcatatatgaataatacatttcatgtattttaggcatatatgaataaataatatatgtacatttaaagttcaatttcatagaaactagtatacccctgaaaacaatagatgtgtctaggagacagaagaattgtcctttgtaaaatttcgctacagttgcagcaaagttatttgttgataaatgagagaaacagactactcataaactatggcctttgtaatactgaacagagtctagaattatgataatcatatggtttccgcgagatctagctgatatgcctttttgagatgataacttctgtccttgagacacttcactttttttttcacttatctccagcattgaataaagcccctcttttccctgttttgagtttgttatcatatgtgtcacatgattactatcatagtttactgcttcacaagaattcatacagttttcctatattttgggtgcttaccacatcccagaccaggtgttctagttccgtatttctatattttctcctttacagtgaaccatacttggctttcaagttccattttgctcttggaacctgcctgttctcagtccctgctttgcttttggttgctgccacctgtttctcagatgcagctccatgttcgacagcctgtggatatatcccaactacttccttatttagatcaggcttcagcctaggagaaggaaatttagatttgagcagaacatttaaataaagttcaaattgtctccaagggttataattataaagaaatcttactgtaggaggcattgggaagatacaattttagtaatcttccaatggattggttcatcttaattatttaattgtatttctatcaataatagcagtggcaagaaaagtaataaaattaggcctagatcgtttttcacaggtttaaatgcagtggtttatgttcccttgactgattgtacaacttcagtcacatatggtgaggtcaatatttattaaactatgcatccaagtgtttgtgagtaaaaatgtagtactttctagcattcatattactatgatagtatgcttggagatatttttgatatcagctttgataataaattttatctggaataaacctagcgaaactttttaaatccctaaagatgatagcatataaaacaacaaataatatttaaactgcactctcatttccactaatagggtggaccaagtttcttgactgcttcttccactaaaaaacaaacaaacaaacaaaaaacaaaaacaaaaacaaaaaactaaaagaagagataaaatgtaaaagcatccaaacatatagaagtgcaaacaagagaataatcatctaggccaaaatataaatgcgggcaggaattgagtgagaaaaaattgcttttatcctaaggacatatgccaaatctggaaacatcttagctttggtttctctcaagctcaaaaaaaaaaaagaaaaaaactgtactcctttaagatctataaaaatatgctgttttaatactgtttcattaaacatcataatagttagactattatgatgactaacctgatttcacagatgtttggctattgtgttttatcacccatcaggtgataagaaactttaatggtggtagactatatgcttctcaaaattgtgtgtgtgtgtgtgtgtgtgtgtggtgtacacattttcttaaactgtagaaagagcatgcgttttggtttcagacctgtgttggaattctgactttccttcatttgatgtgatgcagattatttaattcctccgaagacttggtttattcatctgcaaaatggggagaaagatacctatgtcccaggttccctcactcctcacatccaatccattattgaggcctgtcatttcttctttgaaaaaatatataataggcataatatttctgagatgtaagccaaccaatgtattttctttcttggaaatttctggtccctagttgtctcatcagtctatatcaagagccacccctggtagaccttcattggagagttagttttatattatggagaggatactgtttccacctgagtttactaggtcatgaggctcctggcctataagaataatggccaaatgatgtaagataaattcagattcgatggaaagagaaacgggaaagcttactctttctggtcctttagaatgtaggaaaaaaagaagcaagtagttaaccacatgtctgttcctgtttgaaatcgtagaagtggagaacgaaaaggagcagatgcttgtgtctcttcttattgaaaggctacttaaaataggccagcatcagtggtgggggtccagtaagagttaaaaagtgtttcagaaaatgtttaagcaccgaaaggatttaaattagtcatcacaggtgtccttaacagatgcagaagtttctacctgccttgtggtgggcagcatgatctatgcattgagaagtaggttacctgcagcaagggctccgtaactgagaatgagtgtcttcccccacagaatctgaggtctggcagctcagacagaagctgggtggagggtgtgattgtgttcagaaggtccaccagtgcaccaagagtcaagatgagaccaagtcagcaaaaagaggaccccaaacatttatcatacaagagaacaaaatttcatcaagtacaatcccagtaagagaagccagggaaactctcagtgaccaggtagtaaagggaaattctccaaagggaagagatgaccccaacgacagccacgaccctgtttccaacctcactaaggacatttaagcctgcttgttctccacagaagtcacatgctcctatattaaattctacgattttaaagttttaatatttatatttagatctttaagactctgtgaattgtgtatgtgtgtatatctgtatgaaatgtagtcaggatctgattttaccatttcccatgtggataacttgttccagcattccttcttatctcagagaaaaaggggtccttcttaacactaactcttccacctgttctttcagtttctccatctttccacctttcaaaatcctactccattacttaacctatttcatttctcatcttaatttctttttttctaccattttcatattttctgtttacaaatgggcttatgttccctctatttccttcaacccacatttatacatcagttaaggccactatttttaatttctatcaagttctttgaaatgataacaaatgtttggtgtgcatgctcttaaccttctcccaatcatactcagactgcagtatttacctataacctagttactaagtcagttaacctgtttttgtccctcatcaaatgtattatttttgctgcatctaatatggcctgtttacttcttgatagtgttctcacttttagttctgtgacattatttttctttggttttctttccatctacctggtcactgtttctgtggcatttttccttgttgttcctttctctcagtataatgaatctgtccatagggaaaaatagaaataatctttgaaacattaaagttctgttgataatataaattttattgatgattggaaatatagcctatctctaatatagttatttgatccctccaagttataaataaattatataatcaaattaatatcataaaaatttatttggttttctattgcagatgttttctttctccttttatttcctctatgattgagaaaatcatacttaacattgtcaaaaaatgaacacatgctagttaaaatacatttgggatggaagttaaatatgtgttatttatcagcatcaagccagcattagaattaaaaaaaaaaaaaaaactgcagtgaggttctttttattaaaatgtaaccaaaataactcctttgaaatagttatctttaagattgtcactggttattttttatggtttaacactctcaaataaatgttcatcttgcaaaaatctgcatgtaatacatactgatgcataaagaaaatgcatcaactaagcagattgttctgtgatgacttggattatcaaacatttgcaagttaaattcaatattactgtataaatttgaagaattaactaaaattaacataatttatttattctgttagtgaataaccaaaattttaaagttcctcaagctattttaaatgcttattaggataattataattattcatttctatttaaaaattaaatgatgttagccctacagtgtttggtgaatataaaaatatatatcattgaattataaatcattttgtctccagctgccaacttgaaatgccaggcatttcacttatcttcatatttcatataatgttgaactatttatggtccctgtgctgccatatgtaaaagagcaatattcattaactcttcatgcttcatgaagcaaaaagggttatttcatttgtgagcttctttcgtaataaagactcgtcaaattttctacgttatttatctttgccaccttacgtgattgtaggcatccagaattttcccactgagagtgtttattaatttgttttcttcatagtaataaaccataagcccagtgagggtaggcaacaggttaatcttatagtcattatattctcagtgtttaacaaattgcctgattgagatgaataagtgcatttattttcaagcattttgtttttatttttgatatagttattcactaaaacgatccactcacatcacttattcatgcctgatgttgtcaaaacaatattaaaatatatcgcttcatgtcagagaccttcagtattatatctgaagacacaggttaatacatgtggatcactttcagtgtaaaacattgtcctattaatactacttgaatatcaaagagtacaaatcaaataggtattcagaaaagagggtcttttatggggaatcagactcctggaagtgacagttgagtaaagcttacaaaaagaaatatttgcaacaaataagaggaaactttcctttccacataaatggagcaagacattgagggcttgagaaaggaaagatcataaactattggagggtataggaggctccagagcttattaaaaaagaaaagagtatgtttggaaattttgtgttattttatctagatataaaggattctgaaaggcagtgaaagtactttttactccagagagttaaaaaaaatatgggtctaatgaatgactgtgaagaaaagattgcacccagtgatgtgttgagggaggttgaaggtagattgaaaagtagataaactgaagtggagtgtagaattgagtcagtgaagatctgggttaaggttgggacaacagctgtgaaaggaagaaaaaagaggatggggtgattgatttgagacagttacattaaaaaaaaaaaaaaagtggccaaactgaaacaaaggtgtcaagtctggataaataaatgagcaaaggtgttataccaagattgaagaattgagagatgtgggtaagtttctgatgtatgaaatttgagatgatagccagccagatacttatatgaaaatatctaaaaggataaagaaacaacttaaactatgttatgcaaaataatttccatgtcccacttaccatatcaaatgcatatacatgttcacacagttttcgcctctttaattgcctactttttccaggaaattttctttacttattctcatttttacaaaatattttataatgcctttgtatcaagaagagtaagatattacacaatcactttaaacataaaattacctatttgaaaaagatataaagtttcctttcctttaaaatggggataacacttgccctacccagctcacagggttgttgaaaggatcagaagaaatgatgggtatgaaagcactttgaaaacgaaaatcctttacaaatgcaagctatcatcattatgattatactgtctcctccatatgaacctgaagcaatttcaatttccatttatcacgttactcccctaattcctgtagagcatgtcccacaagatttttatcatgtgactctattttaatcaacgacaaatgcattttcatgaaagcataatattatttctattatagatattctttgaactctggataaagaataatacacatttcaaggaccattatacttctgagagttttttcctatctctttcatttcatagcttcctttctcccatattacatgggtgcaatgaaattttcattgagtgaagtaccttataaaaacttgactgtatgtcccatcctcctttcccctgattttatctttttcttactctgtgaattcaaattctctgataagcaccatccttcgctctgtggattgacaccagtccgtcctaggtaccaaattaaacactgaagatgttttaaggagatgatagcaatatcatgctcattatgtagtggagcttaaaattagagcttggtaccaaccacatccaaaagttgacatgttaaagagagttctagttatttttaaggctacctatgcctctactccattccttctccaattaatactaccccaattcttgcaacatttgttttgtgccctgggcataataatggcaataagataaagagaacctattggtacacataggttgtacgaggacctaaatattcttccacccccacaaagtccaggaaagtaaagcaaaagttaatcctttagtcagcttttctagatgtgcagtatattttcaagcattttgcgtgtatatgagtaatcagatgatccatttacatatcttaaaattgttattttggaaaaaatagcaaatctgttacaaactaaactacttttacattccaaacttgttaaagaaaaaaaatgctgattataatattaaatggaggaagttaaattcaatcaatttctaagagctatataaattagttttagagcaacccaaatttcagttatataacattatttttcaaaagaagttcttaaaaaccatctaattatataagacaaaagattagaatagaaatgaaccttaaatatgatacttacttcatctaatgtgtgagggatagttttagaacaaaagggacaaggatgagtacaccttatccatctactctcagtggttagttctgaagggcttcttcctagcttcctgtcttgggtgtaaaagccacattgctgtagaccattgaacaatgtctgtcttcattctgttactcctttcctggaatcttccacatgccttctcctcaagattgactctctttgtctcagaacttgattgaacagttcataggtttacgaattacctttgccactgtatggctttcctagctgcacctgacagggctagctagcctttgatgttatgcacaattcaggcatctcacagaccacacttagtaaactgatctgtggctggcccttaacttggccattcaccttcatcatctaagatagttgccaaggttcaccatgcttcatctccaggatggcatggtaaggaactgattttaggaccaagtagccactccctcctttctgtatcattctactgcctgtcaaggtggctttattatatttcaccctgacaactttcactctgtctctctcctctcttggcatttatgcaaagcagtgtaagcattcacttgggaaagagaggcatcttggcaaagctgggtcttttctgatacttgaattagatcaccaggtcactgcagagttatagaggaaatagactacatttaagaattttctataattgccagaagtccaaacctgtaattactattgccactctgggagcttcaagtgaagcctctgtagttagcctttgcccttatccatcctgactttcctaccatattttgctactttctcctttgttagaatttatattagaaatagatattttaaaattcagctcaaagtttttagactagtacaaagaatattgtttaatttacttgttacataacatgtatcaacaagcagaggggaaatttaattggtggtaatataattgttaattttaacaaaaattgggaacgtttgactttgaaattttcagtttttgagctcataatagaagacccatgaccactttgtaacttatcatttcaatatagttccattgggtagtagtacctttattctgttttgaagataaggacactgaagggcattacagatgaggatactggaggttcaagagttcacagattttcctggttcagcaactgagagctttcagacccaagtgctatatattggttaccacactggcctgcctcttcctcacttaaattcatccattgactacatatcatcttcaggataaactaccaaggaatgttgcaaggcctttcataatatcactctttcctacctcctctgtcctgttcttgctagttcacttcctatacttcagcattctaaacctcacggagagcccttcctctgaaaatgttgcctgtccttttcacctcaataactgacacctatttgttgggcccaatcctctggggaagccagtgtcatcagagttggcttcagatggtgtcttgtgaaatctcttttagccgttagtgctgttaaattattggttcccttagataaggcttgtgagggtagagagtgtctccttcacttttgtttcctcttttccattgtctataaaataaatataataatagctaccttgtagatttattggaaggattagaggtaatgtatgtaagtaacgtaactagcagtgccagggacatggtaataaaaccaacaataactcatatttattaaaatcattttctgtgtgccaggtactatatggtaggcacttaacatgtattatctgtaatccgtatgtaatgattactgaatggcctgaactcaccgccaaaaagcacttttactttttttcttcaagcatgttatcaaatcttctcatcttgtggtttgattcaacttaggcagagaccatagcttttctgattttgtcataaacacaatgtaatttcaataattaaaacttatttttatttattaaaatttccaggctgtacttaattcaggtaaacttcaaaatcactcctctccccttaattcagtcctgactcctgcctccagctctgcattgcagagtttgttgactgtattttttaagtatctctcagtaatcagtgcctctgtcaatggcagggattgactgccatgtagaatatatgtgtaaactattcagagaaccactctctcccctacaccacactatttgggatcccatctttctgacaaaggacatattcgctttagctaccactcagctccagctctcagcagcaattccagaatctccttctgcagttcccttacttatttgggaaggtggttcttttctttctttctttctttttttttttttttgattgtaagatagctacattttatttttaaaatttattattatacttcaagttttagggtacatgtgcacaatgtgcaggttagttacatatgtatacatgtgccatgctggtgcactgcacccactaactcgtcatctagcattaggtatatctcccaatgctatccctccccctacaccacgccacaccagtccccagagtgtgatgttccccttcctgtgtccatgtgatctcattgttcaattcccacctatgagtgagaatatgtggtgtttggttttttgttcttgcgatagtttactgagaatgatgatttccaatttcatccatgtccctacaaaggacatgaactcatccttttttatggctgcatagtattccatgctgtatatgtgccacattttcttaatccagtctatcattgttggacatttgggttggttccaagtctttgctattgtgattagtgccgcaataaacatatgtgtgcatgtgtctttatagcagcatgatttatagtcctttgggtatatacgcagtaatgggatggctgggtcaaatggtatttgtagttctagatccctgaggaatcgccacactgacttccacaatggttgaacagtttatagtcccaccaacagtgtaaaagtgtttctatttctccacatcctctccagcacctgttgtttcctgactttttaatgactgccatttaattggtgtgagatgatatctcattgtagttttgatttgcatttctctgatggccagtgatggtgagcattttttcatgtgttttttggctgcataaatgtcttcttttgagaagtgtctgttcatgtccttcgcccactttttgatggggttgtttgttttttttcttgtaaatttgtttgagttcattgtagattctggatattagccctttgtcagatgagtaggttgtgaagattttctcccattttgtgggttgcctgttcactctgatggtagtttcttttgctgtgcagaagctctttagtttaattagatcccatttgtcaattttggcttttgttgccattgcttttggtgttttagacatgaagtccttgctcatgcctatgtcctgaatggtgttgcctaggttttcttctagggtttttatggttttaggtctaacatgtaagtctttaatccatcttgaattgatttttgtataagatgtaatgaagggatccagtttcagctttctatatgtggctagccagttttcccagcaccatttattaaatagggaatcctttccccattgcttgtttttctcaggtttgtcaaagatcagatagttgtagatatacggcgttatttctgagggctctgttctgttccattgatctatatctctgttttggtatcagtaccatgctgttttggttactgtagccttgtagtatagtttgaagtcaggtagcatgatgcttccagctgtgttcttttggcttaggattgacttggcaatgcgggctcttttttggttccacatgaactttaaagtagttttttccaattctgtgaagaaagtcattggtagcttgatggatatggcattaaatctataaattaccttgggcagtatggccactttcatgatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcacgatttggctctctgtttgtgtgttactggtgtataagaatgcttgtgatttttgtacattgattttgtatcctgagactttgctgaagttgcttatcagcttaaggagattttgggctgagacaatggggttttctagatatacaatcatgtcgtctgcaaacagggacaatttgacttcctcttttcctaattgaataccctttatttccttctcctgcctaattgccctggccagaacttccaacagtatgttgaataggagtggtgagagagggcatccctgtcttgtgccagttttcaaagggaatgcttccagtttttgcccattcagtatgatattggctgtgggtttgtcatagatagctcttattattttgagatacgtcccatcaatacctcatttattgacagttttttgcatgaagggctgttgaattttgtcaaaggccttttctgcatcaattgagataatcatggtttttgtctttggttctgtttatatgctggattacatttattgatttgcatatattgaaccagccttgcatccctgggatgaagcccacttgatcatggtggataagctttttgatgtgctgctggattcagtttgccagtattttattgaggatttttgcatcaatgttcatcaaggatattggtccaaaattctcttttttggttgtgtctctgcctgactttggtatcaggatgatgctggcctcataaaatgagttagggaggattccctctttttctattgattggaatagtttcagaaggaatggtaccaattcctccttgtacctctggtggaattcggctgtgaatccatctggtcctggactcttttttgttggtaaggtattgattattgccacaatttcagagcctgttattggtctattcagagattcaacttcttcctggtttagtcttgggagactgtatgtgtcgaggaatttatccatttcttctagattttctagtttatttgtgtagaggtgtttgtagtaatctctgatggtagtttctatttctgtgggatcagtggtgatatcccctttatcattttttactggaaggtggttcttttcactgggatctcataaagctagcaaattactttctgtgggatgactgagcccatggaaacgcaggcattcttgtcatgtctaataatgggatgtagttcctcccagtccactgtctcctctccttgttttctgctgttatagactgcatcagccaacattatgcattctgaattctccaggagggactgaagcagtcatctcaatgttcacacgttcctccaaactttaggggccacatgtcagtttgtttcagaatcttctcatcccagggttatgtggagatttggctgcacatctctgcagctcagcaagcctgaggtgagaattgagacactgctttctttgccttgcaaaatgcaccactcacttaacatatgggagcacttgtgaaaagaagacaagtcagaagcccttctcttcccttggataacatctcattgcgtggacgactctttctctctcaaaatactccataattctgcatttgagaggccagaggtggtaggttggtagccggtttggctgcttattaggaagccctaggaaaggtgcctagtgagtgctctttagaatcccttctgttaactattctcaatatttagggtttagctgaaatgtttgaaacaaagaaaagtcctatttcacatcttgtacttttaaagcactcatttacatctaaagaaatgtgactgtagaagttaggttatattccctaaggccacaaaatttacttattaaaagtcaaaatctgatttgtctgtaggttattctcaccccaaacctccttttcagttcattgtactatttacctccaaatatgattgttcaattataagtggttactgtagggcatgtgtaagttgagataaacagcaacagaactcttcagtatttatttagatacagcataaaattgggttttgatattgtaggcatattaaggctagccagcttaattggctcctgcatttgtgctaacaactattagtctttaccccccagtaagtgaagaaaatacttgatatagctaaagtagtacctagctcattctgagacttcagtaaatattggttaaatgagagactgcaggaattcaaagtgagctgatgctgccactcccaacaaacagtgacttctgctgagttttttctgatacttttactgtgaaggtctcacttttgttcatgcatctgtcatcaacccttatattcaaggaaatgtctccagaatttttattggatgactgcattttccttacatgcaagtaaaagaaataccaggctttgaaagcgggctgattgagtgagagttgaacatttaatcagcaagaacgcacttaaaagtgccaagttgtagcaaaatctagggaattttaactttacatatgaaatccttttctgctccactatagcctcaactttctttcagtttttaaatttagaacattctggtaaatggccactgcagaagagtttaatatggtacaataataattcttatttttctcttactgctcaaaggaaaaaaaatctggataaatcccagggacctttaaggagttttagaaactgtcctcttcattaggttaatccactaaagatcaattagttaaaatgctatttgaaatatttagttcttttcttagagataaagtattcatttgtaaattgaatctattgaagatatttccatataaaataaagagtgaaaaacaaaaaaaaaaattgaatcacagctgctttatgtggactgatagataccttagtgcatttgcagcacaaatccaacatttaaaatatttaaaaatacatctctgtatgtggaattttagaaagtattaagctatagtgagagaaagctgatcagcctgaaggagttggggaggggcttgactgtaaagagacatcaggaaacattttcaggagttagaaatgctgtctatctcgactgtgatagtggttacaggaatatttcctagttgcccaaatttacccaatggtatacttacacaatgggtgaatcttttgtatgtacattaaagctggcgggtggggagaagaggaaaaaaaatcttattgaatttgggctattttacttgtaatatcttttatcctgataaaacagatagtactgtggtagacaaagtgttttatcatctacatagaataataaaatctcaaatttcaaatgttattcattcactgttagtcaattggcattaaagtgttgctttctgtgtttcaggaacagtgcaatttgtgaggtacagaaagccaaataaaacagtctttgcctaaaggaagtgtaattcattatccattgctatgtaacaaattaccgcaaagtttaatggcttaaaacaccacacatttctcatctcagttatcatctgtgagtcaggtgtccaggtgttgcttagttggtatctctgtctctactttggggtatctcacaagactgcaatcaagaagtcactcaggcctgggatctcatctgaaagctagactggtaaaggatccgctcccacgctcacttacatagtcgttggcagaattcagtacttcaagtgctgttggactgagggcctcagtttcttactggctgttgaccagaagctgccctcagttccttgacaggtgaccctctccatgtgactccttcatcaaagagtgcaggctgaaaaggcaatagatggtcagttaggaaagggaagtcacaattttttataacccagtcacagaagtacatcccttcaatgacgctatgtactgttgcttagaaggaagctacccaagaaaagggaattaacaaggacatcaatatcaggaggaggagaccactggcggtcattctaaaggctacttaccactagaagcctagttgattcaacttactatccaggattaatacatcaagaagtcatccagcaagtgctttaatcttttctgctacacagaatagtgtataagagtggtggctttataatcagacttctcttgcttaagttgtcgctaacccttattagccatatatctgggaatttattaaaccttctaagcatcagtttctcaccataaaatggtgtatacctcataaagtgtgaaaattaaacacaataatgaatatatagttctgagtatggcacctggcaaatagtaagcatgcaaataatgataattattttttattatatatctacttactttattcctcacttgaaatccagctctctgaattttcctgttgttgaaattagtttaccaacttggaacttattaatcaccatatccactttaaaatcctcaccctgcctttaatttacatctgaagacagtgtatttgttgccttcattttctccctacttgtgcacactccagtcttccactgtttctacagatgttccttatgtaacatgatttcaagtgtcgttcacttccttctgaccacatttgttgcattataacataatgaatctgtaagtcatcacatacaactaaataaattccaggtgtagcttgttccatgcaaaaggaatcaagattattactagtgatgtaaataacctatatgtattgaacaattttaagtagtttttaactagtacaatgatattcatgaatctttttcttgaaaatgatagtagtttacaaatgatctaaggagcagcaaatattattaaacactttgcgtacttccatccagatttatcaaaattgttatgaagctgaaagcatagtgcaagaatacagtttggtgcctcatggttctttttatgtactttgtttaatataaggtgatttagcaataatatgattaggatgcttactgtaaaaactccttatctctattattgcttaggcacatagtttttttatagttgtaagacatgaaatatttatctatatgctataatgaactatttactggatataccatatatatgatgcttattcactggtgataaacccatgattgtttttaaatatagattttcatgattagattaataatggaattcacactctttgatagttcaccattatatgcaaaggttttttacaaaaatgatagaagttccaaatattttttcccaagttcacaattcttacaagctcacataaaaataggaagtgtggtttttctcaggggtggcattttctcattattctccttagaaaacataataaagtgaagttcatttactcatttatttttggctttaatattaaacacaaaatatatttttattggaaaggtcaacattgtttatttctgcttgttaaagtatacatgttcctggtaaaacatttaggaacaacaaaaacacaaagaagaaaataaatattaccataactcatagacaattgctgacccatttaatgcatattttagacaattatcataagatcactttttttctgttggaatattagtattttattaaatgattttttaaaagtccttgtatacatatatacatacatgtagtgaagatttaggcttaaagcattttttatttctgtctttgttgtcactgttaggatgctttatttctgttgcaaccacattgtgtcctcttattattccatttctaataaaaaatatagaataacaatattaaaacataaatttttccttgtatgttgtttgtgaatttttgagtgaagttgttttcaataactcagaattttgagttgaaaatacgtgaggatttctgtgatcaaatatttgttatctttttgtaaagagtgctgatttgattagttctaaaaatcatcagtgtaatctgtaaatgatgtaatccgccatcagcacttgcacttttcttcagattattatagaaattcaaatcaataacattttgttgttttctattaaataacatttggcacattacgtatgttcatatggttaccaatattccttaaaaatagcaaggttttaacatgttcatgatatccttaggtagagtctaataacagagaacatttgtgtgaggataactattttaaaatatactctcttttttgaaatagattgtgaaataatctttggtaaaatctctatctttgttaaaaattcccagaatgagaaatgtgaatgtaaaatacttagaaaacttcctttcctagggatgtaaatttcactattataatctttatttataagtcactcgttaaaatggtcttgcttctaggataagaatgcagttcttcatagaataatatctaatttgaagttttgctaatagttttggaagtgaatgtatttttttaaagttttaaatacattcattttagcatattgctttgactatatggactaatttatcaattaaaatatttctattttcatttgatagtaatttttttcaaaaacttatattgtttataaactcagcaagtcttcagaaacatgtttgagtttgttgtatgcatccagattaggtcctagatcaggatgcttttgaattaacttgaaataagaataatatctatggtctatttttatttgaaagttttaccttcccatgatgggctcattttgttaaggatttctttaaaaatttgtggcatatatttgaaatgaagctgcctaaaagataatttatatagttcttaaaagatcatcaaatctcaggtctgcatttaatatttcaaccagtaatgttattgtgctttaaaaactctggtaagataaaagtagacttttacaaaatgaaattgtttcatttattcactcattcattcattcaataaacattaaagaacccttgttcatgttccagacactgggtatataatcacctgtggactagaaggaaaaatgacagacacagaaaccattttaaagaagataatacattattgttaattatagttaattaaagaaaattaatgaaaattcctttgatataaatacttaggtcttacctatattagtaatgtccacctatttttaattaatagagattagcaactctgaaatttataaattgttaaagtttttcagtaagcttttaaggttgtgtgagatatagttttagaaaatatttgaaaaaaaaagtcacattaaaatgatcaggattgtcttttgtttctgttttataatcaagggcctaacatctaatatgtaaatattcttctagtaagcaattaatgtggttattataatcttattattcatagaatatcccccccgccccataaatatcaacttcctaatccccagaacttgtctaagttacatggcaatagggacttagctaatgtggtcaacgatcttgagaagggaagacaatcttggattacccagttgggcccaatgtaattatacagtcctagtaagaggcaagccagaggatcaaagacagaaggaaatggacaacagtggcagaggccggggtgatgtgccttgaaaatagagggagggctccagccaagggcaccttctgggatctggaaaaggccaggaaacaaaaatttctcccagaaggagtgtaccactacctataccttaattttagtcctgtaagactcctttcagacttctgacctccagaactgtagaaaataattttgtggtattttaagtaatttaaatgtatgataattagttacagaaacaataggaaattaatacaaacctacacaattataacattgtaaaatggcctctgttgtgacaatttaacaaaatgccaggttttttccccagaaaaatccctgcagagatgattagctattagagcagagtgtgaaaccttttaacaaaggtaggctagctggtaactgcccattattaccaactaagtctttgaaggtagcaaagcaatacaaaagcaggtactcgtgtaacctaggccagaaccaccacatttattgatttttcatagcttccttttaactgaatccccagataccactagaattttatgaaatgacttaagaataagacatttgaacatgaaaatttaggtgtttcttcaactgtcacacattcaaagagcccctcctggtaatctgtgtgatcatgttcttgcatcagtcgcagacaagcaaaaagctgaactcagtactgcacctcctgttttctgggagtatttaattttaagagagacccatacttccttttataaggtgaagggaaaagctgtaatagcttctttgccattagttttgaaactctagagttcattaaaactccctttggctttcttcactgccatctttctttcttcttatgaattattcaagacaaatttcacttgaggtaaatagtttgatttgaaggtttttgtatctggatttagatgcaacaagaagtgttaaatgctcagaattttaagtgtagagaatggcacagactcagctattaagatggaagacatttgctgttaatgttccagggctgctgttgcgacttcagcttggtactattattcattctgaagtaggcaggcattatgatgcctgcagtataaatcagattttacagagagcttgatccgcaagcactttgaacattccatccacttctcagttaacagaacattttttggttttacaaggtaaagtttcttttttttttatccttgccaatacattattaatctctttttttcatatattgtataccaaaccacaaaacagttttagactatacatgtctcttgaataaagcgaaattgtaagttttgaaagtttcttctttcaataaatattgtgaaagataagaggacctagaaaatatttcatttttataaaactcaacgtaagaccctttcttctttcacagtagtaatatcttttctagatattgtgtcataattttaatcttttaaacacttagctcatggagtcacacacctggaaaaatgatacatggaacatatgtctgaaaactaccttattttggaacttaagaattggttcaatgaatgtaccacatttaaaaaccaatccaggccagtgcagtggctcccacctgtaatcccatcactttggaaggccaaagcgggtcgatcacctgaggtcaggagtttgagaccagcttgaccaatatggtgaaaccccatctctactaaaaatacaaaaattagccaggtgtgttggcatgcgcccgtagtcccagctactcgggaggctgagacaggagaattgcttgaatccaggaggcagaggtggcagtgagccaagatctcaccactgcacttcagcctgggcaatagagtgagactctgtctcaaaaaaaaaaaaaaaaaaagaactatgcaaagaaatcttattatagttttgtctgctactaaaattcactttcctaatgtcagtttctattaaagttgcctagataaaattatgtttatgaaattatgcccaggtagtactgctttcaggcaaagcatttcattcccgtttcctgctctaacacaatatcacaagcagcaggagtttcattactaaagaataataaaaaacatttattaattgctatatgatagaacatgtgctaagtactttacatgcatcacctaagttaatgctcacaatgagtcttagaaatagtttctgttagtgcccccattttatagctagacagttacatggagagcacagtcttgtaatccctctgtaggacatcagaatccatgtccttaaagactaccaataagtgcaaactcaaaatgtacaggaacatagatttatgaagttgcctagtataatgcaatatgaaatggtggatactgtaacaaattgtcaacaatttacatgcatttatatttaaactacaaatccagcaaccaataatttatttgtgggctatattcaggtttcagccctctggtttttaactcaccacaaagccacactgctttcaaaaccgttcatttacatgcataattattcctttatttatttcaatcttattcagattttatcaggcaatggaaacatgcagagaacagaattacattgtaattacattgtaatcacaatgtcttataaccctttccatggtaaaggattacccattagcccagtcatgtagtttacctgttgttagaagggaagaaggaattctcttctaagtctgaaggagacacaggttgagaatcttttatccaaaatgcttgggggccgggtgtggtggctcatgccgtgggtggatcacttgaggccaggagttccagaccagcctggccaacatggcgaaaccctgtctctactaaaaatagaaaaatttgccaggcatggcggcacatgcctgtaaccacagctacttaggaggctgaggcaggagagtcactcgaacccagaggcagaggttgcagtgagtcaagatcgtgccactgcacttcagcatgggtgacagagtgagactctgtctcaaaaagaaaaaaaaaatgcttgggaccagaagtgtgtcattttttggattttggaatatttgtatatacacaatgaaatatgttagggatggaacccaattctaaacataaaatttatttatgtttcgtatacacgttatacacagagtctgagggtaatcttatacagtgttattaataattatgtgtgacctgtcacttgaggtcaggtgtggaattttccaagtgtggtgtaatgtcaacactcaaaaattttcggattttggagcatttggagtgcagattttcagacttgggatgctcagcctgtgctggaattgcaagaatgttcagactcaaaagtcaaagaaaaagttgagttctgaagagggcacattaattgaaggggccaacaaaatgtattaaaatttagcctgtagtgctcagtgtcttattgccatgaatatgagagtgatggtggctaaggaagggaactggagccatatttctaaatcgggctttatattttgtaggtgattgtgccagccatagtgtaaggcagacatgagtcatttttcaagggacttgggatgaagtgcatgtaaattttggacatgaaaatttaagggcgaaagagatgtttaaatcctctaaggaaagctatgggaaagctgtgtaggcaccattagtttatttggatcatgaagtccaggtaagagattttcatgttcatgtgtcaagtaacaaagataagtaggaaaagtgttgtcatgtgttttattatttaataaggaaatacattttgttatgaatgaatacatttttttcttggcgtgtttaattggtattccttctcaaaatgtccaatgactcatcaacttagttatggcaggcatcttaatttgttaagttgcttaagttttctggttgttcatttccatgaagctgtgtgtgggatttataagctttttcccccaatggatatgctaataaaatacaaagtttgaaaatcactgagactgattaatcatattcctgtcagctctaaaattcagcagctcaacagtcagttatgtcaagggtgtccattatctgatcattctttctactgaaatgtgctttcttttcttcttcttttttttaatcttttcttctattctgttactttctattaaaaaatgaacttcattgaatcttaactcaatgtttcagtgtggggaaggtttactcaccattatggaacatttgaaaatatgtaagaggccaggcgcgatggctcacacctgtaatcccagcactttgggaggccgaggcgggcggatcacgaggtcaggagatcgagaccatcttggcttaacacggtgaaaccccgtctctactaaaaatacaaaaaattagccgggcgcggtggcgggcgcctgtaatcccagctactcgggaggctgaggcaggagaatggcatgaacccgggaggcggagcttgcagtgagcccagatagcgccactgcagtccagcctgggcgaaagagctagactctgtctcaaaaaaaaaaaaaaaaaaaaaaaaaaaaaaagaccttactattagcatttagtaaccagttagggatattgttaaacatcatgcagtacatcagagaatattcttatgtaaaagatcaatagcactgtttttgagacatattgaaatgggttatgactctatagcctgacagacattgcagtaaaactttttttttttttctgataaggactttaatttctggatttatttggtcatgctctctgcctcaagcacctttctagttaccctgtcaaaaatcttgtttgctcttgaaggcttagttcagatctcatctcctttgtgaaatcacttgtaaccctttcactttactataaactcagaggtctccctactttttgatggcccttgtataatctcttgaacacaagcttgaataatctccaaatgcaatggcaaattgagaaaaatggtactggcttttccattctgctttccgtgtgagttgtgtaaaagggccaagacatatcacttttgttttgttttatttaaattattgttcctacagagaaatagatgataaatactgaaataatagtgagtcatccttatacacaaaaacatcaccatagcaaatatgctacctaagataaacatgctgcatagctcaacctaactttacttatttgtagttaattcactataagaactcattgagagtacagcatgaaacttgttttttaatatcctttcttgctgattgtgtctcaaatccataacttagattttaatatatagactacctgatgataataatggtgttctagaaataaaggcagctttcggagcttctcttaaaaaaattaaagaccgtctacatgatcaactacctaccagttaactgaaacaagactgggtatcactggcccactgtcctagttcaaactcaatgaaggaatcaacactattctagatcatattcttaacactatgatcttagtgttaagaaatagaaaatccttgactcctgccatatgtcagtagtgaaaatagacccttccaagaccatttccaatccttacctctagaaattacatgctgtttctgattttcagcacatctcaaagagattcatatttcccttgagttacagttgttgtagtttgtaaaaatgttcctatttctccatatcctctccagcacctgttgtttcctgactttttaatgatcgccattctaactggtgtgagatggtatctcattgtagttttgatttgcatttctctgatggccagtgatgatgaacattttttcatgtgtcttttggctgcataaatgtcttcatttgagaagtgtctgttgatatcttttgcccactttttgatggggttgtttgttttcttcttataaatttgtttaagttcctggtagattctggatattagccctttatcagatggatagattgcaaaaattttctcccattctgtgggttgcctattcattctgatagtttctttttgctgtgcagaagctctttagtttaactagatcccatttgtcaatttttgcttttgttgcaattgcttttgatgttttagttatgaagtctttgcccattcctacgtcctgaatggtattgcctaggttttcttctagggtttttatggttttacgtattacatttaatctttaatccatctcaagttaatttttggataaggtgtaaggaaagggtccagtttcagttttctacatatggctagccagtttttccaacataatttgttaaatagggaatacttaccccattgcttgttttcgtcagttttgccaaagattagatggttgtagatgagtggtgttatttctgagggctctgttctgttccattggtctatatctctgttttttttttttttttttttttttttttttaaccagtaccatgctgttttggttactgtagccttgtagtatagtttgaagtcaggtagcgtgatgcctccagctttgttctttttgcttaggatcatcttggctatatgggctcttttttggttccatatgaaatttaaagtagtttttttctaattctgtgaagaaagtcagtgatagcttgatgggaatatcattgaatctatgaattacttttggcagtatggcattttcacaatattgattcttcctatccatgagcatggaatgttttttcatttgtgtcatctcttatttccttgagcagtggtttgtagttctccttgaagaggtcctttatatccactgtaagttgtattcctaggtattttattctctttgtagcaattgtgaatgggagttcactcattatttggctctctgtctattattggtgtataggaatgcttgtgatttttgcacattgattttgtatcctgagactttgctgaagttgcttatcagcttaaggagttttgggtctgagacaatagggtttctaaatatacaaacatgtcatctccaaacagataatttgacttcctctcttcctatttgaatacgtttatttctttctcttgcctgattgccctggccagaacttacaatattatgttaaataggagtcgtgagagagggcatccttgtcttctgctggttttcaaagggaatgcttccagcttttgcccattgagtatgatattggctgtgggtttgtcataaatagctcttattattttgagatatgttccatcaatacctagtttattgagtgtttttagcatgaaggagtgttgaattttgttgaaggccttttctgcatctattgagataatcatgtggtttttgtcattggttctgtttatgtgatggattacatttattgatttgcgatgttgaaccagccttgcatcccagggatgaagcctacttgattgtggtggataagctttttgatgtgctgctggatttggtttgccagtattttattgaggaatttttccatcgatgttcatcagggatgttggcctgaaattttctttttttgttgtgtccctgccaggctttggtatcaggatgatgctagcctcataaaaagagttagggaggagtctctctttttcttttgcttggaaatttttaaaagtaatggtaccagctcctcttggtacctctggtagaattcagctgtgaatctgtctggtccagaagttttttttggctggtcagctattaattactgcttcaatttcagaacttgttattggacctaatagacatttatagaactctccaccccaaatcaacagaccatacattcttctcagcacaacataacacttattctataattgaccacataattggaaataaaacattcttcatcaaatgcaaaagagtgaagatcataacaaacagactgtcagaccacagggtaagcaaattagaactcaggattaagaaactcactgaaaaccacacaactacatggaaactgaacaacctgctcctgaatgactactgggtaaataatgaaattaaggcagaaataaagatgtttcttgaaaccaatgataataaagacacaacataccagtatctctggaacacagctaaagcagtgtttagagggaaatttatagcactaaatgcccacagtagaaagcaggagagatctaaaatccacaccataacaattgaaagaactagagaagcaagagtaaacaaattcaaaagctagcagaagacaagaaataattaagatcagagcattactgaaagatccagagacatgaaaaacccttcaaaaatcaatgaatccaggaggtgtttttttgaaaagattaacaaaatagatagaccactagccagactaataaagaagaaaagagagaagaatcatatagacacaataaaaaatgataaaggggatatcaccactgatcccacagaaatacaaactactatcagagaatactgtaaacacctctatgcaaataaagtagaaaatctagaagaaattgataaattcctggacacatataccctctcaagagttacagttttaaagatgactttgattttcaagttttaacaagagaatagaattgtttcttcaaatacactaatatatttttgtaggatattacataaaactgtagataaggatgtgtctaaataaattcatgcttaatttttaatcagtttaataatctagatattttcattcttttttttttttttttttttgagacagagtcttgctctgtcacccaggctcagtggcacgatctcggctcactgcaagctctgcctcccgggttcacgccattcgcctgcctcagcctcccaatattttcattcttaatggataattaccataatctagaaaaacaatgcaagacaattgcagacttttgttaaatatgaaaaagcaaggtaattctgtaccatttcatacctaaagtaaaaaaaaaaaaaaagaataacaaaaagttaactgtaccacctatttttattctaaatatggagcatagtattttatttaagtaaggaactgttatatgtatgcttacatttcctaagacatcttcagagcattacttttttcatgttcttaaatggctatacaagtagtgtaaatgttcaatagccagaattctgtatgtaatatatctaagtgttatatatgtatgcatatctaagtgcttattctctttccagagagattatgaattttcaggatttaggaagtccagttatattgcctcttgtgaccttgggttgtacacccactttgaaaatcagtttggcaatatgaagccatatgggagtagtgatgaaaaataaatggagaaaaaaccctatcttctgcttggtttactacctaacatttgggaatataatattaggtaaatatattcaaatatattgtggatcagaaagtgctgggtaagtggaaaataagaggtggcacttctgggcattttcttttgatataaccattttgaataaaccatttacacaaacatacgcatacaacctcttacctaggaacatcaaaactgaatatttaaattatgtagtcaggaaacatttcgactaccatgggccctaggagtctaaggcatgttgaaatgaataaaataccaatactttctggaagcattaaggaacctcatgcattcagtatttgctggaatttgtccttttggcattgaaaagagataatgggtgattacactgtcaaaacttctaattctcaaatataatcttcaaaggagtgcctgtgcagacataggcagaataattttaatggaccttgaagcatctggaaacatagaaagaaaccttgcatagcaacacaggaacattgctgatatttttgtttgttctctctctctctccctctctctctctctctctatatatatatatatatacacacacacactcacacacacacacacacacaaacacacacacacacacaagaatatattctgtgtggtcttgaatgagctattcaaagtctccatctgtcatttccatatctatggaatggaagtaattatgatgatacagcatgggtttagtttgagtgtgaaatcaggcactgcataaatggcacgcaaaagagtgcctggcaaatgataagtactcaatacttgtgttgggaagaccacaccactacatagcttcctgcctttcctcatcatggggaatagttccatatttaagagaatatgaaagcagtgaacagtatcttattttgaaaaaacttttcattatgacagatttcaaacatgcaaaagtagagacaatgagtgaatgaaggaatccccatgtgtctatcattcttattcaattatcaacaattatcagtatctacagtgttaagataaataatttgcaaaggtagtgaaaataccttggctcaaaactgaacatgttcagaaccccatatactttacatatctcttgaggtaatagatttccctatgtctctgtaacaaataaatatatttacctatattctgttgttagatagatgggtttgaggaaaacaaattcactaaatgcagaatcaacttttacaagaaaaagaaattataaatgaaaagcttttaaaattggttcagtttgcaaaactgatactaagaaaatatgtcaatacatttttcatcagaataataatattagctaaaatcatagattgcttctatgaaacaggcttagcatcatctcaattttcatagcaaccctattaattaaggaacactctaattatcattatatagatgaagaaattgaggttttgtaaatgtaaacaaattgtccaaggcaagtggcaagactagaatataaatccagggctgtctctagagattattcgtaaccactataacatatctcaaaacattttagtcattagcctaataaaccaagaataagaacgctatgaaaccttattttacttaaaaaaaagtttttttaaacttatttattttaattatatctgtaatgatacattttataaaatttataaatgtttaaaatgtcatccacatgggattaaaagaaaatcataaatctcatcagggacaaaatggaaggaattttttcagaccatttttctgttgaacacaatagaagtttagcttaaatatgcactttaattaccccatattttgattccttgatttcaacaaaaagttctgaggttacttagaaaaaaacctagcatactctaatgagattttcagtaaatagaaaaactctgtcatatatgccatacaaagacaaataaggttcaaagtaataaaatatgtcatccagcaaaatctatgctacagatttaatgatgatgacaataatttagccaaggccagctgctgtactaatagaccccaaatccttgtaatggcacaaaacaacagaagcttctttcttatttcatatagcagcatggggtggatgaataagtgtccatggacgctctctatgtagtcattcaagaacccaggtgggttggggctcttccatcttcaacagctgggttcctgaatgattgcatggaggagacaaccatggacgcttgttcatcagttcatcactagtagtcatcagtcaagaaatctaagaataagaatgccatggaggcagggttatcagataaaatgtagaacaacaatgctatatgtagaacatactagcactaaaatattattctgtatttacctgaaatttaaatttaactagattttccatattctgtttgctaaatatggcagcactacatgtaactatgtaagaaaaaaaaagaaactgtgcattaaccttttaaataaatatttttaatagtatcacccttaaatgcttagcacaatgctataattaactttagtcatcctgatatggaaaaagtagtgggataattatctcttaattatgtgacgaggaaagaaaatgtaattttgacctccccaagtgggtaaatgactaagattagaagccatgtccactcattactagatcctgcataatcttgcataaactaatatcaaatattttaacgtttgaaagtatgctaaatgtttatcagagcaggtgattttatttcattgagttctcatttactcatgtatatgttaatttatctattatgtattcaaaattactcaaatattgtattgagtgctctaggataaatattaataagtgaaaattaacactaatatatctctgattctttgcaatgtgtataattaattacctgaactggacactattgagagaaaagggatgcttttaataatcactccagaacaacaggggacagcttctggaaaacagggacaaataattattctgttggtccacctgattttaagttttccaataatagaatttcagaggagagctatcatagagctcatttaatataattgcactttatagacgaagaaatctgaggcccagtgaaaagaaataataatttctgtatattaatgtttctcacttaagtttatgacattttttaatgaagaatgattgatatgagactttttccatcgtatactcctcttgtactggaccaaagattgttgtcttctaaaacaatacgtacttcaactaagatcctaaagaccataattaaatcttaacacattaccaggtatctctatttattcttttagagcacaaatccactttttctaaacctattaagaactaagtatgtgttgcatgaagttttaaagtaatatttcatcttacaatccagaaaactcttttatattctaatggctctatgatgttgtagaacaaatgacatgtcattatttgaccgagaatggaactaaacccaaaaatggcccagccacagaatcttaaaatcttctattaatatggtctctggtaaatataatgagctgaaacacaacttctatggtatttttagagataaacattattttctcttgaaattctcacagtattcttttagtgcttacatgtcagatgtaggtttttaattgttaaacatgaaaaatactctgataatttaactactcctaaatttaagtgtatatatgctttcttttttgttcacagtaatgtaggagaagcagtgttaaatgatgctaggaatctgtactctagaaccggattgcctaggttcaaattctgatacaaaaactctatggcttttgaaacaaggcttacatttctaaccagcctattcatcactgttctcatctgtaaaatgggattcattatggtaataactacataatccagaacagataagtaaatgatttaattaatataaaacaattatcagagtgtatctgtcatgtattagacataataagcgtaagctttcatcagtatgttatttctttaaaaaaatccctcttttctctgccttataatttttggataattttttccaaatataaactggtaaattataaaccagttaaaatatcaggacattattgtttacaatatgtcgtttttaaaaactaattaagatcacattgcagtgaagaatgaccccatttaatatatattgacattatatttttgagcattttgtagattaaataaaacaaaaaaagatttaatacgaaacattttctatgtttgataaagttgcatgtatattatcactgttattttcttacctgttaaggaaaatattaccccaaatttaagttggaattttaaaaatgcatactattaagagtgaataagagtttatattctgcttgaattcctggtttatgacatacatacaaaatgagaaaggaaataaactctaggatgaatcttattttagtaagttaatggccttttcactgaaagtaggaaatatttcttctttcaaaagcacccaagatcaataaataatcttgatttaggaaatatgacaatgcaaacttttttcaaaatctgcttaaaaatgtaataaacaccatatcaatgggaatgtggtaataatcagaacaaattttctcaaaaatatatctttttttaagaatgagcaaatcaaatattttggactttattttttcccatggtattatcattaagaatatctaccccaatgtctgctttctccactttcatgcctaaactacagaacatcactggacaaaataataacatcttgctgatggggtccactacccatgacacttcagattagctctcagttggtgttttacagtattttatttccttgttttcattttctagtgactccattttacagttctttcagtgacttttctaaaatttaacagttctgagtgtcatcatactgcttctattccctctccctttaaccagatgatctcaaatccatcaatatggggaacattgaattctttttacttttttttttcctggttttgttctttagaagaacaagaagttcccttcaacagttttcaaccaaacatctgtcttcaagttacatcttcatcatctcaccatcctgaggattaaatgtgataatctatgtaaagcacttaacaaaatatcaggcacttaataataactattatctatcttttcccctagtgaatagtgggcaaagtttcaaccattgattatttgtttaaatacttttatttcagtaaaattgcttgcctttgaatatattttgccagtgctgaaaatcgtcatatgtcttctaatatccaaaaattactgaataaaatagtggttaggagcaaaggggcaggggccagacttcctaggcttaaatgtcacctttgccacttacaagctgtatgacaattgtcaaagacttaaacttgcctctgtatcctcatttggtaagttatttaaaaaaattatctctagtacagtaaagaagaagaagtatgataatatacacaaaatgcgtagaactgcctgccacatgctaagtactaacaatactagctgttattaattttcactgtgtctaaaattcattatttcagcaaatatctattgaaaccctattgaaaactaattgtgatgtgtgattttaaaggacaatgataattatattacttattgtctagacagcaaaaaaaaatacaaagatacaaatcaaagtacaaattatattaaaagctatgaggaagtgtcaggttatcagaggggatgttatcaaatttggaaaatcaggcaagctgagattcttagagtttgtaggtgctcattacaattttattttattttttctgatagtagtaataacatattttctgactatgataaaagccaaagtgttatctatgttctttacgtgaaagttcacttagattctctttctcatatggattatagattgtcccttattcaggaaagcaggacattttttggtctgaagagatttccctctgggtttcatttgtatcaaaagtgaattgtgaatcccaaaggcattcacattgtaagatgatactactagttgggatactgaggttccatttttattcctttaatagcttcctaattatagattccttttcctttaatttcagcctctatattaatgataaaactaatctgcaatctctctcaaataacttttatgctaaaagcaattaggtagatattttcttggctccttagagaggaaatagatttagatatgcagaaagagctttgtcattaaggacccaggtaactacgatcctctaacagttaatgacacaaggaactgggctcaagtagagacatatagtttaaagtgaaaacattttgacctgaaattccaaggtgcacctggtaattggtgaccttaacaagtggttatgacagcaaagtcctacagtttgtggaagatagaaagcaaattcactaaaaggaaaggtaagaggaggaagcaaagagaaagaatgcaacagagaagaagaaaaaagaataaaagttttccctaattaaatgcttactatcatccctttctcactgctattttataatattaattttatatattactaattaaaaactatataattatatacataattaatttttttctggttcttcaaaatatttgactaaataatttagaggtctcaaataaaaatggtaattttaagaccactgtgatcaagttctggaaatttttaaagatctaggaactttttaaagctttaatattttttgattatttttatattttatacaacatttttactaattccaaagaattataaatgactattatgtatttttatttggaaacattttggttatttgggaaaaagtaggtgttagtccagctatacattgtatgtttactgatggagaaaaaaaaaatccctcttgttattagacactgttattttactgatacccaaattctatatatttagatatggtttgggatgagctgtgtaacttatttggacatgtgaacatctttcactatatgttttgcatatgaaaaaaattatctcactttgccttttatttaatgattctttgaaatatattctttgtataaaccttataaagttgtcaaaattaattttcaattagaacatccataaaagtgccaagttattataactactgccttatgattcactcaaagtaaaggataaatccataacattttctattaattgaatagataatcttcattttacaaatgatttccatatagaattagtgttacgataggcagttcttagtgaaatcaatatcagcttatttcctattttgagtcatgaaccaaatcattgtcgtcatcattaaatctgtagcatagattttgctggatgatataatttattactttgaaccttatttgtctttgtatggcatataagacagggtttttctatttactgaaaatctcattagagtatgctaggtttttttctaagtaacctcagaactttttgttgaaatcaaggaatcaaaatatggggtaattaaagtgcatatttaagctaaacttctattgtgttcagcagaaaaatggtctgaaaaaattccttccattttgtccctgatgagatttatgatttttttaatcccatgttgatgacattttaaacatttataaattttcatgaaaaccattttcatatctgttaatataaattactctatcaataattattttttgtagcaaagaaaattaacaatactttgccatttttgttcactttggcctcctcctgatgtcattcttcattttatccacatttcattaatgtgcattttataaactatgctaaaaatagcctcttttgaccacatgtgactgtgactcagaaagtttacttgcatctgtgcttcaaatgactaaacatttttggtttctataatggcaggtgaagggaattaaagaagaggtaaagtaaatattttaactggtgtataatatggttagatcatcctgtttttgtgccttccactatgatttgattacttctaagataaatgatttcgagcatatttgacgtgcaaatatatttaagattcaactatcaacatttgcttagtaattaaaaatttagtttttcaaaaaatgctgagtgccattttgtagctgcagatgaaatttcctaatatcgggaaatgaattgtttttatttgtttgtgtgtctgtttgcattttcccatggcttgctggtgcttatactttatttttcctcaattataaaaatattgttctaaaagagaccttagagttctacacagcaacccacttacacagctcaggaaacatgggccaagagagatgaatgttctgcttcttcagtggttcttacccctgaatgtttgtggtaatcatcggaagcacttgagacccaaggtcagacttctaccactggcagctctaaaatccaagttcggggtgggtcctgaattgtaatttttaaagtcataggtcactggaatggtctgtcaaggctgaaaatacctactcatgcatttagtcttatagaaaggacataagggttattgtgatttcttactagtagaattgaaattagcattaaggcacttaatactcccttcactctaatattctgcctctgtttttttttttttttaatggaagttattctacttgcagacactcgtttttttttttttgtttttttgttttgttttgttttgttttgtttttttgatggaggctcattctgtcacccaggttggagtgcaacggtgcaatctcggctcggctcactgcaacctccacctcccaggttcaagcgattctcctgcctcagcctccctagtagctgggattacaggcgcctgccacgacgcttggctaatttttgtatctttagtagagatggggttttgccatgttggccatgctggtctggaactcctgaccttatgatcgacccgcctcggcctcccaaagtgctggtattacaggcgtgagccaccgcgcccggccgacactcttgttcatccagaaatctggtcaccagtttccttgccagtatctaccagcccattctgcaattctgacggaattattaaactcctctgtgccctaggggcactattgccttatgcacagataacatctaggagacactggtttttttttctggtatatgtaacaaaaaagtaacaaaagcaaattgctgaattgccgttacaatagtacttaattaatatgtatgtataactgtatatgtgtatatttatgtacttagtgtttctgtatttgtattgtttttataggaaatgcactgattctctaatattaacacaaatcctcttcattcaataggtgttaaaaatctctaacacacttgtcagtgctctcagatatgagtatcttttcattgtcaagtcgcagattcatgtctgatttcagaactttgtaaggccagtgaaagtgagtgacgaaggatcatttaaagacaaggtacaaatagcttgtagatatgtttgtatcatataaatttactgtttatgtggcattttgagatctcttacccaattgacaccctttggcaatgaaagtgaatccttcatttatccactggttttatttattcactatttttcattcattcaacatttattgagcattcactctgtaccagatgcaattctaaaagctgggaatacaaaagtagacaaaagtatacctcattctggtcctcatcacacctaatagctactggtcaagacagacattaaatatcatccaaataatcataaaatttactgtggtgagtgcaataatccagggatctaaactagtctgtgcaggagtggaggtggataaaggcccaggggcaggtaaggctctcctgagaaggtggcatttaggaagtagtaagtaggcaaagaggctgaataatagttcccatatgaagagagaagaataaatgaaaaggtgttggcactttcaaggaactgaaagaaaaagagggaaactggaaagtgacatttttacaagtatttgaaacctttttttttcatgtgtaaatgtgggattacttttacctttgcagaaataatatattggattgtaagagttgttttcctgaaggtcatcaaaaattagaatggccattttcctaatttgtcttattatggcagtctcagtattaacaacaggtccagccctctttcagaaaacaaaatattaatagtgacctttttactcctaaatgcattctagtttggatagtaaatcttatggttagcctatctagaataaaagaatatactttacccaattcttaaagttgcaaaggaaggaattctggtaaatgcatacataggaaagtgtagccttcttactttttgttttgtataatgtcttggtatagggaaaataagctaccaaataaccaaccaacattttaacttctcttattttcttccttttttccttccttttcttgttacttttcaaagtgcaagtaaccaatattatggaatgtctaccttatgcatggtgcagtgccaggcaatgggtatgtagtagttaaataggcaggaattagaacaaaaaaaaaaaaagaggaaacaagatgaatttgagggggtgctttgagagggcatgagagcagctataatatgtgctctggttaggagaagaaaaacatagtatttttaagatactgttggagactagtgaccttttcttaacgtttaaaaatataacaagagagtcagttttttctgattcttcatgtcctaagacacaagaatctcttgggcaaggtaggatcctccttggaggacagaaattagaaagtctgaatcagaatcctcagtatttggcagagggaaagaagatactggggaaaagagcatggcttattttcttttcatggtgacactacttttctattgggttgcaactaaatttgggaggttgacacagtatcataaaagcaaagaaagatatccagccctatagtctttttttttttcttttatgatgtaccttcctaggtcaactgagttttgcatattcctcattgctgggactgtagtcacctctctttttattctcactacaatgggaaataactgtcttcagatatcaacagtgtggattccttttaggctagatttcccacacttaaatatcctagtgttatatcagggacgaggagacaagacaaagagacatgccattttcatatttatatttttcccctctccaattctttattttccctccaattccagaaaactcctagcacttctcaaatgggaacatattaaaatcctagcaagtattttaaaaattctattgatagtctcaaggcttcagctttcggaaattaaaataattttgcttctctatttggttcttctttctttttcagtaaaagcacctacttgaagacatagagatcttttcccctactaagttgcccaacaggagatgatcagtttaaagaaaatgtggaaatacaaattcaatctgtaatgcatcacctggttttttccaacacacaagtaattgacctctttatattctgatttaagttcctaagtatttgtgtttgacaagatctgtagtgtctgacatagggcatcctcaaacagcacggtgccaaaaaatatggggtcagaatggttgggttttaattgtgactctgatagttactgattacggaaccttgggcacagtatttaactagtctatatatctgcttcctcatctgtaaattggaagttattataaagccttccatatagacttcttatggaaataaaatgaaataattcatacgaataccctggcacatattaggtactcagtgaatgttagctagtattacaaatgtctatgacaatttaattagcatgatgtctagaaccgccattatttgattagaattagtttagcaggaggatgaaaaaactgagaaggaccctaaaatgagtagccatgctgttttatttactcctttctttatttaagacatgaacaacactctaggtacagttttatattttaatggctatgttgtcttctcttcgtccttacatgaaataccctcaccctctcccccagaaaaaaagaaaagaatcattccattgttagaatgcagtttagagattataaactccaaactctgtacgtcattaaaatttatattcactgggaccttgaacttagtcttcaacttttacatgcaataccattagtttatttaagttcagttgattcactgtttgtctccctccacaaaccaacctcttgcatcagatgttctccttaacttgcttagaggcctgccatttctttggatttttttttccattttatcacctgaaacctcatttccatcttaagtaggcctcccatgcattgtctaagtatctccctaataattcccaacattttcttgtcccaactgcagcctagttctctctttaatagaattgttttacatccctctcttgttgcagatatgatttctctccaactccgtatgtaaaaaagataaggtgaaaagaggatattgtgagcaactcagtttcccttgccacttcccagattggtagtccaaccccttctctgtgtctattccctccagccatgctactattaatttattcttgtggtctccttgtatattcacagaggactttgcgttgtggctcatagtcttcttgttcaccataatttatgacatcatgagggctccttaagttttcttgagccttttggtattaacgtctgtcaatcccattctgctttagcaaactcactgtctgccatcacttctgggttttcttcctttgtttcctttgttctgcctggaactcactgcctttccaacattttcattgtctttatcccattctgcatctgtaccattatccctaaaacttgtcttcatctaataatttacttggctagtactatcctgagaagtctattagaactgctactacaaatttatggtcttaacttttttttttttattattatacattaagttttagggtacatgtgcacattgtgcaggttagttacatatgtatacatgtgccatgctggtgcactacacccactaactcgtcatctagcattaggtatatctcccaatgctgtccctcccccctccccccaccccacaacagtccccagagtgtgatattccccttcctgtgtccatgtgatctcattgttcaattcccacctatgagtgagaatatgcggtatttgttttttgttcttgcgatagtttactgagaatgatgatttccaatttcatccatgtccctacaaaggacattaactcatcattttttatggctgcatagtattccatgttgtatatgtgccacattttcttaatccagtctatcattgttggacatttgggttggttccaagtctttgctattgtgaataatgccgcaataaacatacgtgtgcatgtgtctttatagcagcatgatttatagtcctttgggtatatacccagtaatgggatggctgggtcaaatggtatttgtagttctagatccctgaggaatcgccacactgacttccacaatggttgaactagtttacagtcccagcaacagtgtaaaagtgttcctatttctccacatcctctccagcacctgttgtttcctgactttttaatgattgccattctaactggtgtgagatggtatttcatagtggttttgatttgcatttctctgatggccactgatgatgagcattttttcatgtgttttttggctgcataaatgtcttcttttgagaagtgtctgttcatgtccttcacccactttttgatggcgttgtttgtttttttcttgtacatttgtttgagttcattgtagattctggatattagccctatgtcagatgagttggttgcaaaaattttctcccatgttgtaggttgcctgttcactctgatggtagtttcttttgctgtgcagaagctctttagtttaattagatcccatttgtcaattttgtcttttgttgccattgcttttggtgttttagacatgaagtccttgcccatgcctatgtcctgaatggtaatgcctaggttttcttctagggtttttatggttttaggtctaacgtttaaatctttaatccatcttgaattgatttttgtataaggtgtaagggagggatccactttcagcttcctacatatggctagccagttttcccagcaccatttattaaatagggaatcctttccccattgcttgtttttctcaggtttgtcaaagatcagatagttgtagttatgcggcgttatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcaatgcgggctcttttttggttccatatgaactttaaagtagttttttccaattctgtgaagaaaatcattggtagcttgatggggatggcattgaatctgtaaattaccttgggcagtatggccattttcacgatattgattcttcctacccatcagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtatcctgagactttgctgaagttgcttatcagcttaaggagattttgggctgagacaatggggttttctagatatacaatcatgtcatctgccaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccaggttttgcccattcagtatgatattggctgtgggtttgtcatagatagctcttattattttgaaatacgtcccatcaatacctaatttattgagagtttttagcatgatgggttgttgaattttgtcaaaggctttttctgcatctattgagataatcatgtggtttttgtctttggctctgtttatatgctggattacatttcttgatttgcgtatattgaaccagccttgcatcccagggatgaagcccacttgatcatggtggataagctttttgatgtgctgctggattcggtttgccagtattttattgaggatttttgcatcaattttcatcaaggttattggtctaaaattctcttttttggttgtgtctctgcctgactttggtatcaggatgatgctggcctcataaaatgagttagggaggattccctctttttctattgattggaatagtttcagaaggaatggtaccagttcctccttgtacctctggtagaattcggctgtgaatctatctggtcctggactctttttggttggtaaactattgattattgccacaatttcagctcctgttattggtctattcagagattcaacttcttcctggtttagtcttgggagagtgtatgtgtcgaggaatttatccatttcttctagattttctagtttatttgcgtagaggtgtttgtagtattctctgatggtagtttgtatttctgtgggatcggtggtgatatcccctttatcattttttattatgtctatttgattcttctctctttttttctttattagtcttgctagcggtctatcaattttgttgatcctttcaaaaaaccagctcctggattcattgattttttgaagggttttttgtgtctctatttccttcagttctgctctgattttagttatttcttgccttctgctagcttttgaatgtgtttgctcttgcttttctagttcttttaattgtgatgttagggtgtcagttttggatctttcctgctttctcttgtgggcatttagtgctataaatttccctctacacactgctttgaatgcgtcccagagattctggtatgttgtgtctttgttctcattggtttcaaagaacatctttatttctgccttcatttcgttatgtacccagtagtcattcaggagcaggttgttcagtttccatgtagttgagcggctttgagtgggattcttaatcctgagttctagtttgattgcactgtggtctgagagatagtttgttataatttctgttcttttacatttgctgaggagagctttacttccaagtatgtggtcaattttggaataggtgtggtgtggtgctgaaaaaaatgtatattctgttgatttggggtggacagttctgtagatgtctattaggtctgcttggtgcagagctgagttcaattcctgggtatccttgttgactttctgtctcgttgatctgtctaatgttgacagtggggtgttaaagtctcccgttattaatgtgtgggagtctaagtctctttgtaggtcactcaggacttgctttatgaatctgggtgctcctgcattgggtgcatatatatttaggatagttagctcttcttgttgaattgatccctttaccattatgtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcacatgagatggttttcctgaatacagcacactgatggatcttgactctttatccaatttgccagtctgtgtcttttaattggagaatttagtccatttatatttaaatttaatattgttatgtgtgaatttgatcctgtcattatgattatagctggtgattttgctcgttagttgatgcagtttcttcctagtctcgatggtctttacattttggcatggttttgcagtggctggtaccggttgttcctttccatgtttagtgcttccttcaggagctcttttagggcaggcctggtggtgacaaaatcggtcagcatttgcttgtctgtaaagtattttatttctccttcacttatgaagcttagtttggctggatatgaaattctgggttgaaaattcttttctttaagaatgttgaatattggcccccactctcttctggcttgtagggtttctgccgagagatctgctgttagtctgatgggcttccctttgagggtaacctgacctttctctctggctgcccttaacattttttccttcatttcaactttggtgaatctgacaattatgtgtcttggagttgctcttcttgaggagtatctttgtggcgttctctctatttcctgaatctgaacattggcctgccttgctagattggggaagttctcctggataatatcatgcagagtgttttccaacttggttccattctccccatcactttcaggtacaccaatcagacgtagatttggtcttttcacatagtcccatatttcttggaggctttgctcatttgtttttattcttttttctctaaacttcccttctcgcttcatttcattcatttcatcttccattgctgataccctttcttccagttgatcgcattggctcctgaggcttctgcattcttcacgtagttctcgagccttggtttgcagctccatcagctcctttaagcacttctctgtattggttattctagttatacattcttctaaatttttttcaaagttttcaacttctttgccttcggtttgaatgtccttccatagctcagagtaattcgatcgtctgaagccttcttctctcagctcgtcaaagtcattctccatccagctttgttctgttgctggtgaggaactgcgttcctttggaggaggagagacgctctgtgttttagagtttccagtttttctgttctgttttttccccatctttgtggttttatctacttttggtctttgatgatggtgatgtacaggtgggtttttggtgtggatgtcctttctgtttgttagttttccttgtaacagacaggaccctcagctgcaggtctgttggaataccctgctgtgtgaggtgtcagtgtgcccctgctggggggtgcctcccagttaggctgctcgggggtcaggggtcagggacccacttgaggaggcagtctgcaggttctcagatctccagctgtgtgctgggagaaccactcctctcttcaaagctgtcagacagggacatttaagtctgcagaggttactgctgtctttttgtttgtctgtgccctgcccccagaggtggagcctacagaggcaggcagacctccttgagctgtggtgggctccacccagttcgagcttcctagctgctttgtttacctaagcaagcctgggcaatggcggacgcccctcccccagcctcgctgctaccttgcagtttgatctcagactgctgtgctagcaatcagcgagattccgtgggcataggaccctccgagccaggtgtgggatatagtctcgtggtgcgccgttttttaagccggtctgaaaagcgcaatattcgggtgggagtgacccgattttccaggtgcgtccgtcacccctttctttgactcggaaagggaactccctgaccccttgcgcttcccaggtgaggcaatgcctcgccctgcttcggctcgcgcacggtgcgctcacccactggcctgcgcccactgtctggcactccctagtgagatgcacccagtacctcagatggaaatgcagaaatcacccgtcttctgcgtcgctcacgctgggagctgtagactggagctgttcctattcggccatcttggctcctcctggtcttaacttttatgaactcttatacagccacttgtccaattttccaaaacagcaattctaaacttttctctccagctaattattaaacttaatatcctatcctgatgctattggaagattgtcactccagagaccctccagaaacatgatcaatccaacaatagcatgcaattgcagcatcaatttttagaaagccagtttttcttctgtgtgtgtgtgtgtgtgtgtgtgtgtgtgtgtgtgtgtgtaagttgcttgaaaggtagtcagctattgatagaacttgaggtgagaatttaactggggtttggttgctaccagtacagcatttttgcagcatcccttgggttcattggaactaggaaataaagagtatatatattatctaaaatagagaagaattgaggataaccgtttatccatttatataatgtgtagctaaaatctctctcatatctccttgaactgagaaccaaaatgtttttactaatttatttatttaatgaaatgtattatttaaataaattgtaatgtgtgtatttaaggtatacaacatgatattatgggatacatatagatagtataaaggttactgcagtgaagcaagttaatatatccatcatctcacatagttacccattagttttagtttgtttttgtggcaagagcagctaaaatctacttatttagcataaatctcatatactgcacaattttactatctacagccttcatttgtacattagatctctacactcttgcatcctacatatttgctactttgtatccactgatctacatctccccattcctcctgcctcctgccccttgtaactactcttttgcgttctctctctctctctgtgtgtgtgtgtgtgtgtgtgtgtgtgtgtgtgtgggtttagatttcacatataagtgagatcatgcaatactttcctttctatgtctgacttagttcaataagcataatgtactccaggcctatccatgttgtagcaaatgacaagatcttgtccttttttagtggcaactcaattgtggaaaaacaaataaactgatttaaaaatgggcaaaagacctgactagacattttttcaaaagaagacattgaaaatggccaacagattaatgagcaccattaatcatcagagaaatgcaaatcaaaaccactgtgagataccacctcatacctgtcaggatggctattatctataagtcaaaagataaggaatgttgaaaaggatgtgggaaaagggaactcttgcatgctgttggtggcaatgaagattggtacagccgttatggagaacagtatggaggtttctaaataaattaaaaatggaactaccatatgatcttatgggcacatacccaaaggaaatgaaatcaccacctcataaagatacctgcactcccatgtcatgttcattgtagtgttatttaaaaaagctaggatatggaaacaactcatggatgaacagataaataaattggtacatatatataattttactaatttcaaaggcttattttctaagacaaaatttaaaggggcagtttcaccccagatatgcccaatggaaactagcaagtgtgtgcatgagagatgactggtgccttgccacaatggcatgtaccatcatcgtttgcctcagctatggcaatagcttccctactagacttccagcttctcccctcaggccctccagtccattctccacactgcttccatatcctcctttttagataacaaaactgataatagcaggcctttctcattagtgattgggaatttggtaaaatgaaggtttctggactacatcctacggagttagattgtaagcttgttctattaatctgtgttttaattaagcattctgtggttttcaattgctattgctccacaagttatattttgagaaaacactgacccacagtatgatatcaaacatatgtatgcatttaaaaaaaaacctttcaagatctgttctttagtatcattttttactactggcccttaggcatcctgtgccttagccatatgtattactcatcttcccatgtcctgtctctcctctgtgcctttaattatgctctactgtttcttttgctcagaatatctcctgttctactgctatctgagacgcgttctttaagtaacctagccaggttagacacttgtcctctaccgctctagctttgtcttcataatccttgcaaactagttttcacattgtcttgtaattatctctctctcccctcctcacctgtgttgactgtggtcttcttaagcaaatatatacaggtcactgctttcatcttctgtatctgccacactgcctggatagaggaggcattcaattcattattgctaaggcaatgaatctatcttcaaatctgtatgtctcagattccttacctgtaaaataaagattgccagagagactttttcaccaaacaaggtcttattgatccggctcgcttgcgcttgctcgctgtctctctctctctctctctctctctctctcacacacacacacacacacacacacacacacacacacgtggttcaatatattttaagtttatactgaaactatttaaaataaataactctatagaatatataaactattagttatagttttcttttgctttttaaacctagtttgtttcccaaagctaatgttagataaaaagataatcaaagtagccagatggtcgttaatcatgagggctttttattctataaacataaaaattccatcacctccgaggagtttcacatgtatcttggattcatcctaatgtggggtatgaaaaattggtttcaattcagatgtacgatttagatcacttacctttttcttccttatttttcttgagtagggttgtgagaaatggctcaatgtaaaaggcataaacatagaattcttgatgtaaatggatgtagtcagcctcaatctaattaaagatttctctctttcctttaccctttgtcagtatctttgtctcttgcttctagaaattaaattggaaattttactatgtttctgtccttttctaacctttacttttatttgctcacacacatatgctaagatgcacacagatacacagagacacatacagtgtaatttgcagataaaggaattcacacagaaaacatatatagggtgaagttactttgtatagtataattaccatggtaccctctactctacatttcctaatttatctgaccaacttggcattcaatgtgaagtatattgtgtgagttatgtctattaatacattatgacttataatttataaaccacctttaatgcaaagcaaatactatttcaaggggaaaaattgcatattcaatttttctttatttatacataccctaggatttacttacacatggatgatttatagagatttccccattgttttaaagtaatttatggcaacattcctttatctaatgaaagccaagcaaagggaaacaaaaccaaaaccccttttgatagagaaatgctgagtgagaggtactaggaaggggcacgaaaaagcatattctatggcttaatgctctaggcttacaaaagcatggtgttggaatggtaattggatttctgagcattgcttttgtgaatagactgcttaaatcattgaaaaggaaatcattgcagaaaagaagcagggaagaattgcacaggctgtttgagtacttacaaactaagaataacatacgaacaatgaagaactggtttagtgctgttgagatttgacatctttaaaaacctgatattgtagctgtagttttgatcttcgttcctttgttgaatgaagtcccaatgcattttggaccagtactttcaatgagggctgaaacaaatgagatttttaaaatgctttttccagaaaaataaaattttcccccaagtccacattatatttttgtttgaaaaacacagatacagatacatatgcatctctatttttagtttgtttcacatgtttatttctgcggtggttgacttgccattcttaaaatgttaaaagtcctctatcctcccaaactttcatgttaatagagtgactgtcacactgtaagcattcaaaaattattttgatgtgctagaagaggcttgggaattggaggtggtgtctgggtgttagcctcttaaatctgcatgtaaatttcccatcagcaattataaaaggaaaacatgtcatttactagacagagttaaaggatgtccactatctgctttttcaacaatacctatccactatcactggggaatcgtgaacatggacacaatttttaccttcagataacttatacgtattgcccctctgcccagtttttgcattttactctgaaaggtgcagaaagaaacaagaaaagataggaaatagacttctaggagagtttgcttaaaaaaaaaaaaagagttccatttttcttggagataatacaacacagatttttacttgtccttgttaaatttgccacagaagataaaacatttgttgagtgtgtaattccatgctaaacaacttgctagttatattaatcatatattaaatatattggtcagaataaccctccctttattttatggtgagcaaatggaaaacatagtgataaaaatttttcagggtcaccataactagaatttcaatccagttcttttggactccaaagcatatattttcctctaccgtgcagtaatttattttaaacattagttatttgaagacaattgaagtactgtatacttttctttggggaatattcattgctttatggaatttcttttaatttttgtactctgttgttaagttcaaatacaattgtacttttctctttgttcaaatagaggaaagaaagtcactcacaaagtggcaatgtgcaaaggactacaaaaaacatctattctccatctgagacctagctttatagagacaataagaaccactgggaggaaaccagtgagtgtcagtggtttactctagtgtaaaacatttggctctggaaaaaatcatgttttttataaaattgcacagcacaagacacagaagcactttttataaaattatgaatgacaattttgaatttttaatgttttaactatttatttttaaaacatgccttactagatagcttcagaatatatgaataaaaatatgtaaattatttactaacattcaaagcagattatggtggtaaggaaaatgttcctgtaatataaccttcaatagcaggtgttaatttcactgatttctcactgcttatttagatggaacagtgccttccataccgtcaatgacagagtgtgagtcccacagtcactcagctgggcttcataatgtcctacttatttcctgtgttatgtgaggtttgtcacttaacattcctgagtaagaattcttcttctgtaaagtagggcactaataccgatctcataaaatctctgggagaattagctgactgatgtaggaatgtaataatggtagccagcttgtcctgagtacttacagtgtgcctgggatctcctcagatttacaggcattagcatctttagccctcacaacagcctataaggttttactgttaagcctccttccactggggagacaactgcaaggcaggaaggggcatcataaaaagataggagtgtcagaaccagtgctggaagccaggcattttgactccacaaattgtgcacttggccaatatactatactatcctgactcccaccactcaccacaaagttaggatttttttttcgttcatggccaacaggtctatgaaaaattgctcaatatcactatgagggaaacgcaaatgaaactacagcgagttatcaccccacacttgttaggatggctattatcaaaaaatgaaacaaaagatagtcctcctatctaactgaaattctgcatcctttggccagcattttctcaactcctactaacacaaccacccaagacctttgtaaccactattctgttctctagttgtatagtatcaaccttttttgattccatatttgagtgagatcatgcagaatttgtctttctgtcctggatgaactcacctacaataatgtcctccaggttcattcatggtgaggcaaatggcaggatttcctttttctgtggctgaatagcattccattgtgtgtctttaccacattatccattcatccatttatggacttttaagttgatttcatatcttggctaatgtgaatagtgctgcaataaacatggtagtgcagagatctctataacatactgattcatttcctttggttatatacccagtggggggattgctggataataagaaaacaagcattggtaagaatgtggagaaattagaatcctgtacactgttgggaatgtaaaattctgtagcagctatggaaaatagcatagaggttcttcaaaatgtaaatatgggactaccatatggtttaacaattctacttctggatatgtatccaaaagatttgaaaacagggtctcagagattgtttgcgctcccctgtttgtggtagcatgattcataatagctaaaacatgaggtataaatatagaatggaatattattcagcctttaaggaaaatcctgtcatatgcaacaacatggatgaatctggaagccattatgctaagtgaaataatccatgcaaagaaaaacaagtactgcagtatttcacttatatgaggagtctaaaatagtcagacttacagaggcagagaatagaatggtggttgccaggagttgaggggaggggagaaatagggagctgctattcaatacctgtacaaattatacgtggttctagaaatctactgtattaaatcatgcctaaggtcaataatactgtgttgtatacctaaaaatgtgttaagagggtagatctcatgttaaatgttctcaccacaataatctgcatgggttgaattgtgtcccccagaatgatatgttgcagcactaaccctggtacctcagaatgtgaccttatttagaaatggtgtccttgctgatataattagttaagatgaagtcatgctacagtaggctgagttctacatccaatatgcctggagttttataagacaatgtgaatttacaaaggaagatgccacgtgatgatagaggcatagattggaattataaagttgcaatccaaggaataacaaagatgaccagcctcctccagaagctaaaaaaaggcaagaaaggttcctacccagagtctcacagggagcatggccctactgacatcacaatttcagacttctatcctccagaactgtgaaacaacacatttccattgttttaagccacccagttagtggtcctttgttatggaaactcttacacacatacatatatatatgtatatttaatagatattttaagaaatattaagcaaagtattaggtacaataattgctcaaaagcgattgttcctattttatatagtctaatagtggggaagtctgtgcttatgggaaacttttaaaaacatcaaacacttcctgtgtgtaatttgctaaagttaaaaatctgtaaaaccacagtgttcttgtgtagtccttcaggagacaaatatgtgcctttcttgacatggaagtttctttccacctcagccagtagcacattcactccaaacttagcattcatcatttatggcaatcagatcagtatttaggtctatattgccttgtagtatttatttttattttaaccatcttattttctttatgtatgtagattataaattcttagagggagagaattatattttatagttttgtaacatagcacctaaaacaggacgatgtttgatatggtttggctgtgtccccacccaaatctcaacttgaattatatatccaagaattcccacatgttgcgggagagacccagcgggaggtgattgaatcatgggggctggtctttcctgtgctattcttctgatggtgaataggtctcacgagatctgttgggtttatcagggggttctgcttttgctccttcctcattttcccttgctgccaccatgtaagaagtggctttcaccttccaccatgattctgaggcctccccagccatgtggaactgtaagcccaattaaacctctttttcttcccagtttggggtatgtctttatcagcagcatgataatggactaatatatgtgtgcatgtatgtgtgcgtgtgtgtgtgtgtgtgtatgtgtgtgtgtatatatatatatatatataataccatgtgtaacatttgaaaatatatatattcaaatttcagtctctggcattcatactgaaatttgtttgtgggtacctcaattggtcagcttaatgatgtcttcccttctcaagggaaggtaggtatattagttttctagagctgccataacaaagtactacagactgggtaacttaaaacaacaaaaatgcattgcctcactgtttgggaggctacaagtccaagatcaagggttggcagggctggtttcttctgtggatatctccttggtttgttgttggctgtcttctcactgtattgtcacatggccttccctttgtgcctgtgtcctcatctctactttttaaaagaacactagtcatattagattagggcccaccctaatgacctcattttaacttaccccttttataatccatctccaaacagagtcatattttgagatatcgggggttaggactttaacatatgaatttgagggagacgcaattcagcacaaagcacaaggcataaataacttgtttttgtacagattcttagctaaggaactacctttctagaaagccctgtgaaatattcaaaagtatatgaggtgacagatacatgaattagcttgatttaaccatttcacaatgtatacaggtaccagaacatgctgcacactgagaatatatttcatttgtacgtgccagttataccttagccataaattcatgtggatagataacgtttttctttaaaagcaaacttaaagaatattaatcaaagagtattcatatcaaataattactgacagtgttgttttccaacctgataattttcttgaggtaagaaaatatagatcacggctgacttcagcctcgactacctgagctcgagtaattctcccaactcagcctcccgagtagctgagatcacaggtgcacaccaccatgtctggcaaattaaaaaaatatatacatttgtagagacaaagtcttgctatattgcccagactgaataatatgcttgatcaaactgctaatattgatttggatttgaatatagtaatccctattatttcaagtaataatatcttcaaagtaatgaatgcaaaggagataaactgatatttgaacacactaacatgaccatttcaagaatatgacatgacctcttcaattgctccattcggcttttagatggaaggagaatgcattagtctcttacaggatgtactgtctttatctgaggaactttgaagagtatgaaaaacagctactagggaaaaaagaaagcttttatattctttgatgtggaggattctgtgattctaacactgtgattatttctttctgtaccagagcttactagcctacacagatattagaattcatagctatatgtaattcaaatttatttctgtatgtgagaaggaatgtgattcccttctctaaaaatcatttactgtatagacataacataacattatccctctattattggtagaaatattacaaatcttggatgaaattttttctcaaagcacaaatttatgctgctaaatatattgattcagatcagtctccaaaaacaacactaaataattagtagttttcagaaattttagagaaaaaagggaaaaatattcagaggggactttttaatgaactctagagacatacattaatgtaagtaactgtaagtcggtgatgttccacaattactttttactacccaccatataacaagattggatcatgtgaagtgctgtgcttaaaacttaatcttaatctcaacatatcacagaactacatttgccttgtttgccagtaattgaatattcagggtaatcactaccatactcaccaaagaaactaaggccagcctctctttcctgaatcttactagattgtagttctagaattggccttttctttcactcctgaaaataaggcattgaactgtgtttcagggcaggacccagtctttcctactcaccctactgtctctagatttactcagagctgtcccctgatggagatgcaggattggatagaaaggatgctttcttctctagaaatatggttgttgtggattaaaagtgtctggaggtgagggatagaagacttcacatagggtacagtgtatactgctcaggtgatgggtgcaccaaaatctcagaagtcacctctaaagaacatattcatgtaaccaaacatcacctgtttcccaaaacctattcacgtaaaaaaattagagattcccaaatccatttccagtaagtctgaagtagttgatctaggcaatttgaagaagattaaatattattaaatactctagatgattctgatatggatgactaagagccctactccaagacaggctcagaactccagaatgctgacagctgaatgaaaagggaacatttgcttctcagtagaaaccaagcagtattgaagaggtagagggctagagaggaagccaagaataaaattccttaaaaatgaatgggtgcttctgatccaaaatgatttttcagaatttactacatatataaggcagcctatccccttttttatgagatcagttttatattgggaacttctcacattatcatgtctttaaaaaacaaacaaaaaataaaaccttcgcagaggcactaaaaagagagtgtcttttcaacaatcatgggagttttttttttttttttttttttttttttgaagttttaagctacttatttattgtttgggaagacagtggtggatgtacttcttggaacattttaacttagtttctaaaacagctttattggggtataattgatataaaaacagcatacatatttaatctatataatttgatgagtttgaacatacacatacatctgtgaaactttactgcaagattataataaacatatccatgactctcaaaagtttctatgtgccccatctcctattttgttgtaaggacatttaacataagatctaccctctaaacaatttatttatttatttattttaataatttcaagttttgttttagatttaagaggtatatctgcagatttcttacatgggtataatgagtgatgctggggttgctgcgattgaacctgtcacccaagaagatagcatagtacccaacagtttttcaacccttgctccctcctccttacccccttgtagtagtcccaatgtttattgctgccatttttatgtccatgtgtgtccaatgtttagctcttacttgtaaatgagaacatgttgtatttggttttctgtttctgaattaacttagaatgatggcctccagctgcatccatgttgctgcaaaggacgtgatttcattcctttttatagctgtgtagcatttcatggtatatatgtacaatattttcttcatgcaatccaccatcaatgggccataggttgatttcatgtctttgctatcgtgttgtgatgaacacacaagtgcatgtgtctttctagcagaacaatttactttctttcagatatctacccagtaaagggattgctaggttgaatggtagtcctaagatctttgagaaatctccaaattactttccacagtgactgagctaacttacattcccatcaacagcacataagcattcccatttctttgcagcctcaccagcatctgttgttttttgactttttaatagtagccattctgactgggatgagatggtatctcattgtggttttgatgtgcatttctctgatgattagtgatatagattggatatttgtccctgcccaaatctcatgttgaattgtaattcctagtgctggaggtggggccaggtgggaggtgtttagatcatgaagatagatccctgatgatttggtgctgtcttcatgatagtgagctcttgagagatctgattaaaagtgtgtggcacttctccttccccctttctttctctcgcttgcacctgctttcatcatgtgatgtgctccctctttgcctttcaccatgattgtaagtttccagaggcctccctagaaaccaagcagatgccagcatcatgcatctgcagaactgcaagccagttaaacctcttttcattatcaattaccttgtctcatgtatttctttatagcaatgcaagaacagcctaatgcaattagtgatgttgaacaatttttcctgtatttgttggccattgctatgtcttctcttgacaagtatctgttcatgtcttttgcctcactttttaatggggtgattgggttttgcttgttgaattaactttcttatatattctggatgttagacctttgtcggattagttgcaaatattttcttccattctgtaggttgtctgtttagtttactccgttgataatttcttttcctgtgcagaggctctttagttcaattaggtcctacttatcaatttttgtttctgttgcaattgcttttgaggatgtatccataaattacttcccaaggctgatgtccaggattgtgttttctaggttttcttctaggattattttacttatttatttatttatttatttagagacagggtctcactctgttgctcgtgctggagggcagtggcacaatctctgctcactgcaacctccacctcctgggctcaagccatcctcctgcctcagcctcataattagatgggactacaggcataggccatctcaataagctatttttttaaaaattttttgttgagccgaggttttgccatgttgcccaggctggtctcagattcctgagctcaagtgattcgcccaccttgacctcccaaagtactgggattaaaggcatgagacaccgtacccagcccttctaggattcttatagtttgcggtcttatatttaaatatttaatccatcttaagttaatttttgtatatgctaaaaggtaatggttcagtctcattcttctgcatatagctagcctgctattccagcaccattgattgaaaatgaagttctttccccattgcttgtttttgtcagtttcgtcaaagatcagatggctgtaggtgtgcagctttatttctgggttccctattatgttcccttggtctatgtatcttttttttttatcagtaccaacgtaggccttggttactagagccttatagtatagtttgaattccattaatgcaatgccttcagctttgttttgttttgcttaggattgctttcgtcatttgggctcttttatgtttccacgttaattttagattttttttttaattctgtaaaaaatgatgttggtagtttgacaggaatagtgttgaatccatagattgctttgggcagtatggttgttttagtgatattgattcttcaaatccatgaacatggaatgtttgtcgatttgtttgtgtcatctatgatttcttgtcattgtgtgttgtaattctccttatagagatctttcaactcacaggagtcatttttattccagcttgctccctttttttctgatgtgttctcctttctgcctggtaggaatgttcctgctgtgtacaatacaggggatgtgtttagaggtggcaaacttgattaaatatatactagaaataaataatacaaacaagtgcacttagatagaagacttttccaatctgtattttgtctaatataagcattcttttaatttgtcttttggatcatcatttttgagggaatcttattccaataagctacatgcatcatctgtcattttgttttcaggatttattttctgcgtcatggagattagcttaattgtgatagatattttgttgtttttttcatatatatgattttcttttgctcatcatttctattgatctatgctcctgattttagtaattaaaacacagttcagtatgctagcattttcttcagccaaatttaataacctgtcagattcttatggtcacaattaagagaaaggtgtttgtaagtgtgttaatacttagatttctttataattaaaaaattatttgattggctatgctggatttatacttaataatcctttgctcatgcatgtcggtaatcttcactggttacccaaggttcaaacccttttaactagtgtaagcataatgatatgtgcagttataattggtttcagtaacaaaatttaagtcagaattgtagtataataaaatcacagttaattcttaatatctccatattattttacatttgtaagtcattatgattaaggcagaatgttggagcttactgcaaaatttctttagaaagaaaatacttttcctaagttcatacagacaagtttagatattagagtttgaggcaggtaataattggaattcttcagttcgctgacaatattgatatttattttcataactttatgcaaatattttctttaagtactaaaaagatgtaattgataatgttcacactggtcactttcatgacatctgaaattttggcatgtccctaactttgtgagagacaaaatggtgaagtgattaacagcaaggggctaagttcaaattgtgactttttaaaacttcagtggcttctgcaaaatggagaaaaaaatcgtttgtactttgtacaggattgatttggagggattgaataagatgcaggtacatagaaatcactcaggaaatgcagcaactcttataattaatctgctatgtgtcccagcccatagtaatgactgattagttttctgtacctgtaattttaccttggcaagaatgttataaacataaacctactctcttaagtcttgcttcttctttcactaagcataatgcatttgagattcatctactttgttccttgttccacatattaatattattttcctttttatgccaagcagtattctgttatatggatatgacacagtttttttattcattcctgtttgagggatatttgagttgtttccaggtttggaggattatgaacaaagctacattaagctacataatagctacataaaagtttttaggtgaacataagttttcatttaacttgatttaatctctacaagagggatttctggtttgtatggttaagtgtatgtttaataatataaaagaaaaaaatccttattcccaaagtagttttactatttttcattcccaccagaaatgaatggaattttccattgttccacattctctttgttacttactagtttcaggattttgtttgtttatatgttttgccgatctaataggtatgtagtagtggtgtatttttttaataataaatgatactttaaagcatattaatgtataaaacagtctttaaactaacttggaattataaatttgtacattttcttttaagaagacttcacattttcttctttagatatttccaggggagaaactttttgtgtttaattttattttctgtgctaatgtgagatctctacagattcaaaagtaaataagaaacggtttctgatttcaagttgttcataatttgtcaaaggcactgaggtggagcccaaaattttggcctcggaatatattggagagaaaacagagtccagtgtagcaactgaatggataaatgttgctgattggtgaataaggattagaaaagtagttgtgatgttcataacaataaagtggaagaaagctttgaaaggtcagatttagagattgaaaaataattttatttttgagctagctacaaaaatgtttattcttttgagtttgctttaaagccctcaggcatgaacgatcatgtatttacatctgtgggaaaggtggcatagtgaactgtcggagctagaagaaccaaaaagaggaaaagagcagtgcactaaataaatccttagacctatgtcaaatcagatcggcaaattttgttcacattatgattgatttaagtatcaataatgtttataaaagtttagtagcttatctaaattcaaaataggggttttcattgttttctttagacatatacgtcaattcctcatcccactgcccatggcaattcatatctcaggactagtattggggcatttgtaagattggctttggaaattcctctctgggttataatttatacaatgctttgcccacagccacatataggtatatttattcccttgttcacatcataaaaatgagctgaaattaaacattaagtagaaaatatgagaacaatgaaatgctatttaaacaaaagggaatatcactgaacatttggataacagggagcaccaacaaaggcaaaaagaaagaaatggaggaagaaccatggaaatgcatttgggatgtttgttactctcctatgtggttttccttttctatctcctctaaaatttaaattttcttgttatactcatttttgtgtaaatatgaaaaaagattataaatatacatcactgtaataacatagctaaatttaaatggtaacaaactattttatggctgttcaggttttaaattaggatcagtttatgttagcacttgcaatttgattctaattaaatgcttccaatttaaatgccgtacatagagtctattttctctagtattaaattctttatacaacgtttattgtctgttctttttcttttcctacaaccaccatttttgcttgccttctacatgggaggaactatgaaaggctgtgaagacacaaaaccaaataagacctagttcctaacttcaaggtgcttacagtcaaagatgggatagtttccatgagagctcctctggaaggagagacagatgttgagtcaataattcctgtgctgcattgaagggtgggtaggaatgcttcttccctcacaggaaacagcaaaaggaagctgtgaactacatttttggttgcaagcttggaggcagaggatactctgcgtattgtttttgtattggaaagatcaaagcagggaataacagaaaacaggccacaaaagaactcacgtgtcatgctacagacgtaccaatctacctgccacttaccgagtgacagccagcatcttctgttggtcaagggtaaaatataatggtttgtggaaccaaaatgcctggctttcagaacttgttctcacacttctcttatatgtgacctcctgttctactcctcaattttctatctgtaaagggaagtgatgtgaaagagcctacctcatgaagctgttgtgaaggctaaatatgtcaatgtttgcaaagctaagaaggctgtggccacattgtaaggacttagtacaagtcagctatcatttttatattactacattggtcagttaattcttcctacaattttattaggtgagtgttattgcctactttacagaagaggaactcatattcagagactttacctgataaagctaatattacatgggaagtaaacggtaccacctaacaaagagctagtagagactgtctttttctgcagtaaggaaataacgtctcaaagagtattacctctgtaactgtttggattagggaatcattgaccctagttacgtaaaaaactccaaatgaagacaaggaaagtaactagcacattgcagagatttttattttcagttaatgtttggaaactcacatctcacagcccaaaatgtccatctaatttatcagcgagcattagagctgattggatgccttgtcatgcaaatatgaacaaggaatctcatcacagttgaagagcttggaatgtatgagcttaatgcatgtctactcagtctgtacatatgaaacatttagtcccttgcttggtatagagcgtgctctcacatgcagccttgtgatcacaatctcgatgcctgtaggagccaggcatgagggcgctaagtgaagcagctggcctaattctatgtaggtttcttaaatttatttttggggtacagtatcttcttctttgaatttatcttgatgcacgtaccccctgtgtttagctttaaattttccacttctgacgtaggcatggatataaaaaatgcttcacctacttcttaattacatactaataaataaaataacacaaactcgatgatagcaacctccagtggcagcaaaatggtagagaacagggcaagtaatgatgaaacagatactatgtgtccaatattgtcagttttcctaacttttacccaaagccagaggagtgaattttttgttttatcttattttcctttgtgtgaataagtattcaaataaaaaacacaaaacaggctgggttcagtggcccatgcctgtcatgtcagcactttgggatgtcaaggcaggagaatcacttgaggccaagattttgagaccagcctgggcaacatagtgagactccatctctacaaaatataaaaatgttagccgggcattgtggtgcgtgtctatagtcctagatgcttgcgaagctgaggcgggaggatcccttgagtccaggagtttgaggctgcagtgagtcctgatcatttctctgcacactagcctgagcaacagagcaagagcctgtcaaagaaaagcaaacaaacaagcaaaaaaacaacaatgaaaaaaaacaccacacacacccaaaacaagaacatcaagacaaaacattatatagatcaagggtatctgaacgagaaaaaacaacaggttgtttgatctcccagttagccttcttctgtttaggtaaggagaataccagcagagttttcagcaggaaagagaaatggttaggtatgcacgctagatacatcattctagcagatccatttgtctacctgttttatcactctagaggtggtactgaaactatggaagaagatatttctagaaaccacagatatagtggaacaaacaaggaggctatggcttaactctgggtaaagccaataataggagacaagcgtccatgcaaaaaacaataggaatgatcagagaggaaaagtaaatttaagtaatttaattgcttaacacacttcagaaggacccagtaagataaactttgaaaaatgccattttgttttggcaccttgaatttactcagaaatggatatgagaacttttggtagagtgaaagaattataatggctgatgtatgctattcttttgagaacttagattagaaagaaaccagtgatgaaaatcaatgcttagacagtgaattaagtaccaggaaagggtttatttttacaaaagggacttaaaagtgtttattattagagttatgtctctaatgtttacccaaaaggtggaaataaattgccattttttagcaatgaccaaaatccaggtactgatgctccaagtgttactagattatcacattaattctcacaaccatgttgaaagatagcttaacattctgttttagatgtagaaaacttaatttcaaagacgttaaatatctttcaggaagttccatgaagctttttaattttaatttttaaagtgacataaaatgtatgtatttatcatctacaacatgtttgaagtctatataaattacaggaagttacatgactttataatcagtattttttcttttgtttgccatccactcaatagtggttctagaaaaaatgtaagtgaatttagaaggatatctaatatataattatgaacagaagacaactcgtctcttttttcatcgcacactgccagaacaatatattttacttttaaactttagtattaaaactgtagtacgtgttttatttccttcctgcatatcatagttctatgtttgtttggaaattaaatcattaaaaagtttttctcactttccatccagataaacaaaaaaaagaatggttaatactgatacttaataataatttatattttgttatcaataatgaattatattataacatatatagcttcacattttgtcaggattaaattactttcatttcatttacttgcaatgtgtttgcattaattgaaaaacgtgggctccctcttgtgacaacatcaatgattctatatttcttttggagccacactaagtcacctgtctatgttctttaatttttcacaagtaaagttatatataattttatataataatgtaatagtattctttttttgataattcattctacttttttaaaaggaggccaatatttgataatatttgattctgattattgtttaaagatttatataatatttaaaaatattgattttcaaatttatattgaaaatatcaaggaaaacaggaaatgacaaatttagatttccttgttttatattttatatgcgatattagctgttttggttggcattccaagatatgcacataatttactttatattctacgtgttccctgtgtttgatatgtgtgcttatatttctcaaaatgcatggtgctcctctctgtttttctctgcaaactattcatgtgtattatttccacatgcctcaaggaagtagcatacatattgaactacccataatgggaatacccataatgagatcaaagaaagaaaaaaaatcatagttcttttttaaaaatgaaagcattatgtgctgtttataaatgtgattgtgtttgtgtgcttgaaagagtatagtgggtgcaaaaaaaaggaaaaatacagaatcgttatattcatggatctagctctggaagggctttttagggttatttcaatagtacgctgttaattaagagacctggatttaatctttgctgtctcatggaccatctgtatgggattgggcaagtcatgtttcttcctggtatgtcaattttatcatctgtttaataagataattgcattaaatcaacttattctctgcatgaacacatctgtaggaaataacatattttcctggctcagttgagtattgattattaagaatatgtctgtggggtgatggaatagggactttggtcgtggcaggctgtgaatataaagttgtcaagagagagggctgtccaaggtgaatatgaaatttcaggagctgagggggtgccatgcagggggcattcccattccccacttattaattataaataagcttgattctcagttctgttatccaagattctgtaaggccaaaagcattttggcaatgccatactgataggtaatatgagaaccaaaactgcaataaaaattgttaatattttttatttctataattcacacgctaccgagcattttgccagagtcaaaaaatataggctgcaaattgcgcactaatttcaaaagcttaaaatgcagttcaggagttcccctttccaccccaggtcccatcagtccacatttttttgtcacaggtctgctttagttcattatattacttgtctgattccaggagacatctgagtttgtggccctaattaacatatccgggactgttttttatgacctatgtaactgttgttggatttggttctgaggacttctgtgccacctgctccaataagactgagacacagactcttctagggagcagctgtcactttcttcacctactcaggaacacattccggttctgaatcttcgtgtctggatcccttctttcctttctttcatattcctgcattcctctctgttttgggtgatacctaaatgcgtggcctgcttggtcttggagctcacttttgtttcagcatgccatgtctcaggtcacacacaggcccacagtgtgtggcccacagcccagtctctccctttaacctctaccttatcctaggcctgatttgtttgagagagtaaatcagtctcaggctaggaatgaacaacagcaatgggtggctgtcctctcatggttaacacacttccatccattcattccttcatttacatcaaaaatatttattgaatgactacggtgtattcattacattctcgttgcttcaagaaatttgtgattgaatgaggacactttgtgggaagctcaggacagagaactggttctgattgctcaggcagatgtgacaaagtaacgtggtactttatttgggtatattagtgtgaatagtcagagctgaacttgcagttatgtgtttgttcattaaagaaaatctatggttcaccttctacatgaaaactgttttaagattctagtgagaaagactgacatggaggaagtgaacgcattataatgtataatattacaggggctaggggaagaaaatgtaaggttttgtgtattagcaacagagagagcgagagtgaggagagagagagagagcactgcctggtaatctttgagagaaagattttgtttactagatcatttgtcataacatatagttaaatttatacatgagtgaccagggaataatgtcagttttctgttaaattactggtaagggactccaaaagggaaggagtggcctctcatattatctttattagcaaccaccctccagcccacccttccacacatacctagtgtcatatcctaagtgttatgtatgtatgtatggcttgtgtttgtgtggaggtgtacaagcatgaatgagtctatgcacaaatacaagccatataacgttgtgcctgtggtgggcagagagtttaagcatgctccaattttagttgttgagacgtttgaaattatgtgcaactcatggacaatttcaatttgataactcgttaaaaataatgttagtttttaaaaagatacctattctcttgcctcaattgcatttctgcccccgcccccatatagtgcaccacttatgaagagaggtgatgaaaaaccttcatacaggattattcacttgatagaattgttgtcatttaacaaagcactgctacacgctttttcttcagtaagtaactaacttcaaggagtattgcctctattaactctctgaattgtgggatccttgactctagttaggtaaaaactgcaaaatgaagacaaggagaacaagtagctgtcttttttgactcatagagattcatacattttgtttttaggacctcacctcttatagcgtaaaaatcttgggatatatgagctttgagtatgtccattccctctatggattaaaaaccctgagtgccctgtttggtatagagtaggtgttctggtcatgctaggttcttctcctttctttttactttgcattcttcaaaaacaaaacaaagcaaaaaaccgtcagaatctgcagcctgattataggtaacttttatcctcaggtgtcatgttaatatgcgaatatccagcaagcatgtggtccaatcccattcagataatggaatgtgagtattaagcttgtagcacagggctttgttagctgttagtttttttgttttttttttttttttgctggtgtgctaattgcaaagtgatctcctctcaggacattaaaaaataagtccttaaaaaacataagtttgggtcacctaaaatctgtgtgtatttacatttcttttatttttttcttttagttaattgctattttaatacagggcagagcaggactgcaggaggtgaggtccccttagcaaatggcaacagtggggagctttgaagcacttagcacccactacagcaggaagagcagggatgtcatgttccttgattattcctggaaaagaaaaagcacaggatcctccttgagtgctgcttgcaaagctgtctcttaaaacccctttcatttatggttgtattgtgccttccaccttaagtgtccctgtatgttgtttgactaaatctaggggctgaaaaagggattttctccttttaactgtttagtgccttcatatagtggttcccaatcctggctccctggcttagcttttggaagctttgctccccctgagactttctaaatcagaatttctaaacttcagcctcttgaagctaaggttcagagccaatgcattttcatagaatggatgtttagtaaatctcaactgagaaacatggactgaattaaatttttatattttacctgaaatatactctctaccttgattgatttgttttataaattgtattcctctcatctaatcttttgaatttgttcataatatgagaaggcactaagatgaggtgacatatggtagtatgttgtatacatagagtttctctcacttgcatcattattgcatttaccacattttttgcaaatatttaaatcttcagtagactaagaaatctataattcagggaccatattgtcctcatttcatgtcccaggacacaggctcatgtctgaacgcatagaaggcgttcagaaaaaaaaatgaacaaatgagttatagcattgttgtagatttgtgtctaaaatatatatgaaaagttctataattattttaatttttacatataattaaaatttatagatattgctccagaaactactactaaaatgatacagcttatgttattggatcagaattctataaaactaataaaggaaatataatttggttttgatgcagtttacatatatattagggaatgattactaaaaagatgctttttagtaatctgggagaactgggaaacttttgacaggggaaatcaaaaatttgcagtccagtgaagaattaaactactgggagtaataatatgggctgatgcactcaatatagcagtaatgccctctgagaaggataggaaataattcagttcctccaggctgcatggaagctaaatacagtatgacaagaaatagtagcagtactcattatgtctgattgctaattacctctttgaatgattcagttatgcctgctactagataattagtttagtaatttatggctgcggcacaaactagtattttaatttttgcagcaccattttcacaatacctacagttcagataatacctttttaattcaatgttaaattgcttttttgaagacctataaaagagcaaatattcttgcatttttttctacttgtatttcatgaaaaagttaggcactttatggaattttatttaactttaaactccagaaaaataacatcttcttaagtcatgtcttattatggttaattttgccaattttgtgggcaaaggggtgaaattttcaaaaagattccatcaaattactcaatataacagttgccaaatttcatttttcaaaaagacattaaaaaattgataataaatcttttctttttacacatttctacttcatacatggggttctgcttatgtctgggtgtctgttcccaatgctcaggagctgcaaactgagtacagcttttctgcattcccaaccaatttggtgtggtccacaggcaagtcaaaagctatcagattaagtaagaatatttcaagtaagcatttccaatttctattcgggtaaataagattaactctagccaaagagaatataattgagtctctatggcttaaagtttggccttgggtcagtatcctcttgaattcacttttttgttctctaatattccaactatatttctgggttttattggtgaaataaatatgtaattatctaaaattattttgtcatctttcataaacattcatttttagttccgtatccccactactctagtgcagttagtgatataaaaataaatcagagcaagagagagaaagacggaaactgatatagtatgctccccaattctgatgactgtaatatattttcaggtcacagcccaaagacaacattgatcaattaaattcacatgacaatttcaacttactcatatatttattttcatttatatacagaatgtacatatttgccaaattgttgagtgatattgtgagttaggaattgattttaaaatatcccttgcctaggtgttggattatcaggcttgaattcttagtagctgatggaaaagttgccactttaagatcaatataattaagactagataattttcacaatgaaagagagcattgaaatgcttagaataacaaataaaattttgcattaaatactgggttttgccatccctaacagatcaaaatgaatgctttaaaattaataaggggcactgctaaacacattgccttatggctaagagtttatacctagcatcttaaaattaagaatatttggcattacttattcccatttgctttctacttggtgctttgtttttctctataactcaattacaaaatgctcatggttttatttgctatgttgttctcatactcgatatttaccagtactggatcaatgttctaaagggcagccctgatatttcagtgaacatcaggctgatgtttattacagaccaaatctgtgccctttattgccaacagtcttactggaaatatgtgttccttgacccatttaataaatggttacccacagatagggcagtgtgactctttttcttccatacatgctttttaacaaaagtttcttacccgtaaggcagtctgtctaaccatcaaaacatcatattgacctttccaactttgctcagggtgacagcttggtttgttgttgatactactttttttttttttcccctaagttgctaactagagctctcacaaagttatgtgctgtcagagtttgaggcaagtcaattgctttagattcataattcattctttttttgcttgttttaatactatttatattctaaaataaaatgtagcccttataaagtgtataaaagtatcagtattaaagtcaaaacttataggtgattacctcattgccaattatgaaagtccaataatatattttctttttgtctatattaggaaacttttttggttctcatctcactagtaaaaaataaagtaagcactggttatcaatataagggtgacacatttataaatgaattagcaaccaacaggtagtactctttagaaggaagatgctataatgcctgtgtttcccttacaagtctcagagagctgaaattttttaaagagttaaggaaatgttgccaaagctttcgtaattgcattgttcagtgaacattgttgtatttagcatagaactgtttatgtatttttgtacatttctttcattaccttcttttctaaatataaaacaggatagatcactggataaaaatatccaaaagaaagtcaaagcctttatttttgaatttgtgtatatatgtatatttatgattaagatgtttgtgggcatttctccttaaagggaaattcagccaatttcctgattttatattcttgatataaaggggctgtgtttacctcgtttgaatacactgcttaaaatagatgcagtacagtatttcctactgcgtctcatcagagcttttaaagaattaattagactatcatagaatttgatactttggagtgctaagaattctcttcataatttcttgatatgtgatattatgttatttcgtttgagcaagtagcaattttaaacacatgtgtatatgtccatacaaatataatagctctttggagtttaaacaaatgcatatatataaacatatacatatatacacacatatataattagagctcttggctatttagaagcttaatagcacatataattctatctcaagaggtgcttaacaatttcctaaactggagagccttcaatatgtctacttcagacatgatatctatgaaggtaataggatacagaaagagaaaatatgtatataatgataggagagaaagcagtattttatcatgcaattgatttatttgtccagttaagcttgttgagctacaaatcaagaacacattttagtataaacaagaccaaaccagagttcaggtccacagagtttaatatctaacgagagagagaaataaacacatataatttacaaacaactcaaaacaagagattgcaatcacagaaatatattcaaagtgccaaggcaactcagagaaaggaaaggacaattaatttaatcttgaacaattgtcttagactgatgctgatattgtctgaattcagggacacagtgtcaatgacattgaacatctcttattcagaaatgaattaaataagctgactagtttcattaatactatctcaaacaacaggttttgttggcttaaaaaataaaatcttggatgctctgagagcatgtaggtagaagcagagaaagaatattttaaagccttaagtggaagcaaaatgttgcctaccattttgcaaaattgggtactattatttttatttgtttatttataccaaatccagatgtaggctaattcaatctcaaacatgaaaggtgggcagattttatcattaaggtataaagtcatgctgaagattacatataataaatggacttcatgtacttccagaattccaatgtcagaagtaatgcatctttggtatcaagtcagtctggacacttctaaaaacaaaatgaatatactgtgatgtggggtgtgtgccacgtgggcatcagcaaggaagagatagattatctttcaggtagggcagagagcatggatggaaagctagctagagcagagtcagagtcatattttagagatgtaagatgggggaagtggtgactagcatcaggtagaaaaatacttagatttctagaagctctgtgtttgtttgaggaggtagggcaaaccttttttaaaaatctggtatcaggtcaactcttcccagaaaatagcacatacatgcacactgctatacataacttcataggcttcatagactacttgcgatctttaaggatcaatgagtttaagtggaggaagggataatggaagtagagtatttaccttcatttataaagagcctcacattttaaatcaactcgatttgtgttcgaggtggggtccttgttccaaatggatactacagttaaaactacgagctaggggccacatgcactggctgaggctttgtggccacctctttggtgctctccttcacttggcattcgccttcgcatctagttaaaaaacatttcatacatctactctttcaggaagctctcttttaacattcaatgttaggtactttctcatcccaaaagtctctcccacaatagagtcacaacttctatggaaacaaacaatgtctcactcatttctgaatccctgttcccaacacagtgcaaggcatgtgggaggaggtactcaggaaatctttattttatgaatgaataaaagctaacaattgtgtatagcaggttttgctatgtactagaaattagaagtagagaatactcttcacactgcagaaagactatatcaatgcgtaaaagattcacataatctgaagcaagttattttatatggaatgaattggggtaactatacatagtataatataaaattctttgccatgcaaaggggaataaaaatgagccaggcgctgcacagaatttgggaacattgattggggaacagttctgaagtagaggcctattgtgtaagtaaatctctggctgagttcatcggtctcctttgattgttcagctaatgtcacttcaaaacagactatgctttcttcatgttaacccttttttaaaaaaattgaaactgttcagggcttcaagactagataaggtataccttatgtctggtataaaagataaggcattcactgtggaatacaaaaccagaaaagtggcattatttttttccaaaaggaaaaatgagctcattatgagagaagaagaaacctttcatcagagcaaagaaaaataggttcaaatagaataaatctgtgatttagccattttccaaaagtactgagtttttgctgaaagaattatcccaaattgctcagattttggtgtttgtagagaaaatatagtttctataggattctgttttcttcatatcaaagaattgagccattcagggtttaaatattgaaaaatgaatttaacctagacctaatagaagacaaagtcaatcacaaacatccataataatcaaatgggcaaagctctcttacatgtatttattttcttaaacattaacaaatcaattcaattattcagtctcttgctttcaggatctctagattaactgggctgaaataatccttaagtccatttctatatacatttctgtatctgttttatcagaattcttggtatcttgggaatttatttttcctgaaaacaatttacatcagaacttaaacatgggcagttcatctagtctgattgcctagaatcttcctggtttcatctcagttccactctatcttcagccatgctatttcctctgcttagtaccccaacctcaacctcaaatctatctgataagtagcccatattgtttctttagaactcaactcaggcataccctctctcttctttcagtctattttagatgtatttttctctctgttccgagggtaaaatgtacacaattataaaatgtagtgaggaagagagaccaatggggcagagagacaagcatgtagctctctgaaacagactgggtgaggtgttgctcactggtgcctagcacagatgttggaccattgcaggatcccccaaaagtttttgaatacattaaaaaatgaccttttaagctgcaatcatatgccttttctaagcactgcacattaattaactcgtttaacacaacactcatccgaatttggtatcactgttataccaacaggaagccaagaggatactaaggttcaccaatggtgtatgacttttctgtagtcacacaactagtaagtggcacaaatgcaatactactcctgggcatccagcccaaaccaaatgttcttctttattatgctccatattctgacctgattatattattgaaggtactggataattgagcttgcttctaaagaaaaaaaaaggtgaatgaatgattcattgtctgtcatgaattccctaagtatttattaacctctctctagtcattaattcaacagataatcattgcgttcctactatggcacaggcactgggcatctacaaaagaataagatacattctgaatacaagtgactgagattcagaaggggaaagcatattatatattgtgttttgttcacattgcatcataggaagtttcagcctacattacatcatcttagaataagtacaattacatcagccagaaaatttttaaattaatattctttatcatttaggcatttaactctgacaaagatactatagtacattttgtagtgaattgatgtaattgccctccttggatactcaattttaggagtcgctttgagcatccacacatttctgcagtatacagtttatgaaacttaccagaaaataaaaggaccaatctaaaataaagaatctctattgtatttttctactgacaatgcaaatgcttatcttaaaacatctaattttttcccccttttcacaggcaagcacaactgtaacacttccagaatctcagttccttgccagttgtcattctgaagcataaatggaatgcagggtttggaagttgtatttgctctgcattaacaaaagaagtaaaagctgtttttccctcacccctaaatgatgtaccataactcatagaatagacaagtagtattacaagatatcattttcatagacactcttctaaacctagctctggataatataaataatagagttcactttaaaatttttaaatactttttgatggcagagtgtctttcatttttgttttcattgataacgttctctatccttaaattaactttaatcatgtaggccatgttgccttttaccaaatgtctttagcagttctaatgatatacaaagtgttgtttttgcagtattttgaaaaagggacatattaatgtttcacctttagaaagtttttttcacaagaattgaatcactttctgattgttctgtatgacatcattgtagatgtataacactttttggcttatttaagtttattttaagcattctctaatatcttacgccttgtcttaacctcagtattaatcctgttgattacataatttgtattctttgaagcctatttcattatttgcacgtctttctcctttctactcatcttgagctgatgaacttgaattacccttttgctctaaaccttaagtcagaccaaattagaataactcctcctttttttctataattatttttcctttcttgtattattactccttaccacattgtattgaacttgtttaggtaattatctgtcttctaaattatgctgtgtcattgacaagatatcaaactgtatcttatttacagaggatattttatgcttttagccccagtgccaagcacagcttctgacatagagcacatcctcaagaagcgttttttaaattgttgaatataaatagcctaaaagaccattggcatctgatcaaaattaatttttacagccaaataaattaacatcatgttgacctcaacttaattctttcatttgtcaggaaataaaatttgaattgtttgaaataatcaacttcatctgtactttgctctaatagttccttgcatgtgacaattgatggtttgctatttaaataatattacaaatgtcaaagatgataaatgtgtagtcctccatcttcataccctggctgagtgtagatattgtaaaaatgtccatttaagtaaaacaatgagggcataaaagtacaattcggtatttccaaccatgactcaaaattaaatcttttcaacacatgttttaaagaacacatagggttctatactgtatctagaatttttcttatattaattgttgattatatcaagtcttgagtcttgtaacagaaattcattttatttcaaatttggactcacatgatactgtgatatgctttcccctaattacagagctcctccattatctttcctttctttcttcttgaggaaaaaattcactgaaacatgttttaaggacaaaagatttcaaacttataaaaatatttcagtcttataaaaagaaaaggtaaatcaaagttggaacctaatggtcttcataatgccactaaaagttcatagctgataggaagaatgatctatcacataaaaagtagtttagttaacctaacaaaacaaaaataggttatattttgcttgtatggtattaaaatataaaattataaacattagtattgataaaggttatttctaaagccatcttatattttaagtagatgattttcagcagatcaccttctgtcttagatgaagtatgtatgtacttttttatttaaatgaaatgagataccatgagaatgaagaatgctctagggaataaaaatcattatgaattattaattttgattatattttaaaattaaagcatttgttactaaaaaatcttgaaacataatgtgacaagaagtaaaaataattaagtcaaacaaatgcaagctaatttataaatattttataacatttattgagtttctagattgtatatgaaactaatggaacagatgtcaacctaacagagaattgtatgtagtatgataaggcaatgattaaagtctacaaaagggattattaaatcatctaaaagggacagttaaccaagactgagaggtctaggaaaactttttagaaaatgttgcatctgagttgaaacttgaagaactaggaggcataacaaggcgaataggaaataaaaggaaatacatttcaaagccatgattagaagattaggacaaacatggtcaatcagggaattgtgtgggagtgtaaactgcaaataaaagtaaacaaacataaaatggggaggcaactgggtttaaatcattaaaggtgttgtaggtcatgttgaggagtttatcatgacagcaatggggagtcattgaaagaggttaaacagaagtaccaacaccagtatatgtcctttgcaatggaggaatggaggcatgggtggtaaagatgtttctaactgtgggaaatgggagccaagggagaggacagtggattgagagagtttctgttttgatggcttctattttctctataaataaaattgctgaaatcatctccagtaagtgagagagaggatagtggagtagaatgtttatggaatgtggtgaagacataaaatatcatctgttgggaaatggcactgagaactcatctgcgaagctataaggaatgattgctgggtgtgttgaacttcctcttcagttttttaggacactgcttcacatatttcttctgcttctttggaagttcataggaaaggacagaaaacacaaattcttaaactatagaaatctagataggttgatacgaaatttagattttactttatataaaaaacaggaacaaggtttaaagatgttgaagtgtagtcgaagcaatgagatgtgagattttggctaaatacagaagggagtgaaatgtatttgcaagtatacaaatatacctggaggttatacacacaggtatgaaaatcttgaaaggataaaatggtattttgaaagggtagaatataggattttaaaatgtgcaataactgaggagggtttaaataaattatggaagatctatatttgtggaagtctaaatgggtagaatgcttatggaagcaatttaaccttgtccatcaacttcaagtgcaaatatcattcaacccaaaaattccactcctacaaatttcacctccaggtatatttgtatacttgcaaagtgaaggctgtacagggtattttgttgctgcattgttcgtaagagtaaaatgcccatcatagagaattgcttaggcttattatggtgcatccataaaaatggcattatgaagctgtaaaaagaaatgcaaaaactctttatggatgtaaaatgttcttcaagatacaaggttaattaaaaaagaaaaacatcaaggttcagaacagtgtggtataatgcaatctaaaaaagggggaaaagcctatatatgtatttgcatacctgtgtataagatactttcaaataaatgtatatgaaaataatataactagttgctgatgagaagttggagggtcggggaacaaaagtggaaaaagaactttcgtggtcatttcattgtatattttttcatacagtataaattttgaattagaatgtattactatggggtaatttttaaaaatcaaactatagatataacaaatataagcatataagcttttgtaaatcttagtagcttggaaatatattcaaaataatgagcttagggcagggaagaaaaaaattacacaagaatatacctataacactgacataatgcaggcatagtaaaatgataagagagtacacccaaaatatcaacagtgtttgctaaaggtggtaggattggattgcaagcaatttttattctttgcattttgaatatatcttagtgcatatgcattatttacatttgagcaagttggcccaatatgctatgaatgttattactaaaggagaaaaatttctaaaagattactctgagataattcctgagactccattcttttaaatgtggaaaccctgtttttgatagtttgcaatgaaatataatacagagaaatgtagaatcttctatgataccttccattttaatcaaagatcaaaatgtgacagatgtgcctgctaagaacttttatctgttatcataaataaaatgcattcactcatctaaattaagagaatattgcaagaatgaggctacaagacaaatctaatgaagggtaatatagaatgtcagaaggcccacggaattcacaagtaaaatgaataaccattcacttttatgttttcagcataattgacaataaaggaataacttccattaaacattcagataaacaaccatattctctaagtacagtgtctgcaaaatcttgttttctggtacaagctaggaattttagtacagttgtaaaatcttctgaaacatgtctgttttttcagttaataattcacaagtctattaaatgtatggtcatgagagaggtcaaaaaagaatgttatacttcttcatggcaaaaaataattatttaaaagttgatgtttaatgtatttactgtaattgggattcgattttttgaaatagccttcaattgaatggtagaaatgtggaaacatctaagcagtaagattacatataagtcttcatcccccttcctcatttctccccctatcattaacatcttgcatttagagtggtacatttgttgcaattgatgagccagtatggatatgctattattaccaaaagtccataatttacattaggattcactctttatgttatactttctgtgagttttacaaatcataatgacatgtatctaccattacagtatcatacaaaatagttgcccagattgcagcagtgccattttgtatttctaccagcaatgaatgagagctcctgtagtcatacttccgtgccaccttttggtgtaatcagttttttttttatttttatttttttttattttagccattctaaggtgtgtagtgatatcttgctgttgttttaatttccaatcgcctaatgatgtatgttcattgcttatttgtcatctgtttatcttctttgatgagatgttcttcagatattttgtccatgttttaattagattgttatcatattgttgcattttaaaggttctcaatatgttttggacaccagtctcttttcggatatgtcttttgcaaatgttttcgtttcttcctaatctgacttgttccgtcctctgaattgtatttcaaagagcagtttttactctctttgtaaaaaaaaaaaaggcagtttgaccttgccaaacctaaggtcacctagattttctactaggttatcttataagagttttatacttttgcatcttatatgcaagtctataatcacttttgagttactttttgtgaaaggaataaagtatgtatctagattcatttttttttttttttgcatgtggatatccagttgttctggcatcatttgttgtaaaaggcttcattttgtaaaacttatttttcttcatttatttactgagtttctagtcccttcataaaatatatggcttcaagctcatttttctctctctactctgtttcctccaaactatcccacacttttaaaaggaatcttccatatttttctagccacttttataatggggaatgtcttccataacatcctgaagttcatcatcaaattcacactaagggataggtgatgattttataaagcaacccacctttgttttgtataacctgagttattcattcattcattcattcaacatatattaagcacccatttttaaacagatattagtccaagaaattattatactgaagctaaaagtactatatcctggttcatccttttgagaaatatacaaatatttgtactcttaaatgtcattgactttcatatttgttagagtgtctttcactctttctcatagtttagcagttttctgttcttccaaacattcctaatgtgacattgatatacttgtatctgggtgtaatttcacttgtctatgctcctctcatgacactgtttactcagttacagacaattgctctagaggtcttccattaagtgtagtgtaaaatgggtctattactttctgtgacatggacaacatcctgtattaagctttaaatcactggtatttttgctgccaaaatagcatactgcactatcatattaaattcattataaaattaacatttgcctgttggtcatattcaatatttttcaagtgtggaaaatctcaatatgaggtgccttgagggaatgtagtagtgggggactaattttaattaattttaatttaattgtgtattataccaaggtatccaaagaggcaatgtactataatagaaaaatgctgcatttggcattgtgaaattcagatttagcgtgtgtctgatacatattagctggttgtgctcagtaagttatttaacttctttaagcttatgtttattcctctgtaaaataatgatgataacaatgcttgccttttctactttctaatgtgttttgagagattaacattgaaatatatatgaaaataattctaactaaggtttactgggaaataatttacataccttaaaaaatcaccctttttagtgtaccattctattgattttaacagatgcacatagtcatgtacccacaatcatggtgtagaacaatgccatcaccccatatatttccacttgtctctttgttttttatgcctggcaaccactggtctgctttgtatccctatagtttcgccttttctagaatgtcatatcaatggaatcattctgggtgtggcttccttcacttgtcataattctctgatattcttccatgctgttgcatttatcagtagtgagttccttttttattaatatatttttaaagtttttaattttattgaagtccagatcattatttaaaaacattaaaacaagttttttttttgtttttttttttattatactttaagttttagggtacatgtgcacattgtgcaggttagttacatatgtatacatgtgccatgctggtgcgctgcatccactaactcgtcatctagcattaggtatatctcccaatgctatccctcccccgtacccctaccccacaacagtccccagagtgtgatattccccttcctgtgtccatgtgatctcattgttcaattcccacctatgagtgagaatatgcggtgtttggttttttgttcttgcgatagtttactgagaatgatgatttccaatttcatccatgtccctacaaaggacatgaactcatcatttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcctttgggtatatacccagtaatgggatggctgggtgaaatggtatttccagttctagatccctaaggaatcgctacactgacttccacaatggttgaactagtttacagtcccaccaacagtgtaaaagtgttcctatttctccacatcctctccagcacctgttgtttcctgactttttaatgactgccattctaactggtgtgagatggtatctcattgtggttttgatttgcatttctctgatggccagtgatgatgagcattttttcatgtgttttttggctgcataaatatcttcttttgagaagtgtctgttcatgtccttcgcccactttttgatggggttgtttgtttttttcttgtaaatttgttggagttcattgtagattctggatattagccctttgtcagatgagtaggttgcgaaaattttctcccattttgtaggttgcctgttcactctgatggtagtttcttttgctgtgcagaagctctttagtttaattagatcccatttgtccattttgtcttttgttgccattgcttttggtgttttagacatgaagtccttgcccatgcctatgtcctgaatggtaatgcctaggttttcttctagggtttttatggttttaggtctaacgtttaagtctttaatccatcttgaattgatttttttataaggtgtaaggaagggatccagtttcagctttctacatatggctagccagttttcccagcaccatttattaaatagggaatcctttccccattgcttgtttttctcaggtttgtcaaagatcagatagttgtagatatgcggtgttatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcaatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccatcagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtatcctgagactttgctgaagttgcttatcagcttaaggagattttgggctgagacaatggggttttctagatatacaatcatgtcatctgcaaacagggacaatttgacttcctcttttcctaatagaataccctttatttccttctcctgcctaattgccctggccagaacttccaacagtatgttgaataggagtggtgagagagggcatccctgtcttgtgccagttttcaaagggaatgcttccaggttttgcccattcagtatgatattggctgtgggtttgtcatagatagctcttattattttgaaatacgtcccatcaatacctaatttattgagagtttttagcatgatgggttgttgaattttgtcaaaggctttttctgcatctattgagataatcatgtggtttttgtctttggctctgtttatatgctggattacatttcttgatttgcgtatattgaaccagccttgcatcccagggatgaagcccacttgatcatggtggataagctttttgatgtgctgctgtattcgttttgccagtattttattgaggatttttgcatcaatgttcatcaaggatattggtctaaaattctctttttttgttgtgtctctgcctggctttggtatcagaatgatgctggcctcataaaatgagttagggaggattccctctttttctattgattagaatagtttcagaaggaatggtaccagttcctccttgtacctctggtagaattcggctgtgaatccatctggtcctggactcttttggttggtaagctattgattattgccacaatttcagctcctgttattggtctattcagagattcaacttcttcctggtttagtcttgggagagtgtatgtgtcgaggaatttatccatttcttctagattttctagtttatttgcgtagaggtgtttgtagtattccctgatggtagtttgtatttctgtgggatcggtggtgatatcccctttatcattttttattgcatctgtttgattcttctctctttttttctttgttagtcttgctagcggtctatcaattttgttgatcctttcaaaaaaccagctcctggattcattaattttttgaagggttttttgtgtcactatttccttcagttctgctctgattttagttatttcttgccttctgctagcttttgagtgtgtttgctcttgcttttctaattcttttaattgtgatgttagggtgtcagttttggatctttcctgctttctcttgtgggcatttagtgctataaatttccctctacacactgctttgaatgcgtcccagagattctggtatgttgtgtctttgttctcgttggtttcaaagaacatctttatttctgccttcatttcgttatgtacccagtagtcattcaggagcagattgttcagtttccatgtagttgagcagctttgagtgggattcttaatcctgagttctagtttgattgcactgtggtctgagagatagtttgttataatttctgttcttttacatttgctgaggagagctttacttccaagtatgtggtcaattttggaataggtgtggtgtggtgctgaaaaaaatgtatattctgttgatttggggtggacagttctgtagatgtctattaggtccacttggtgctgagctgagttcaattcctgggtatccttgttgactttctgtctcgttgatctgtctaatgttgacagtggagtgttaaagtctcccattattaatgtgtgggagtctaagtctctttgtaggtcactcaggacttgctttatgaatctgggtgctcctgtattgggtgcatatatatttaggatagttagctcttcctgttgaattgatccctttaccattatgtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcatgtgagatgggtttcctgaatacagcacactgataggtcttgactctttatccaatttgccagtctgtgtcttttaattggagaatttagtgcatttacatttaaagttaatattgttatgtgtgaatttgatcctgtcattatgattatagctggtgattttgctcgttagttgatgcagtttcttcctagtctcgatggtctttacattttggcatgattttgcagcggctggtacccgttgttcctttccatgtttagtgcttctttcaggagctcttgtaaggcaggcctggtggtgacaaaatctctcagcatttgcttgtctgtaaagtattttatttctccttcacttatgaagcttagtttggctggatatgaaattctgggttcaaaattcttttctttaagaatgttgaacattggcccccactctcttctggcttgtagggtttctgccgagagatctgctgttagtctgatgggcttccctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaacgttggcctgccttgctagactggggaagttctcctggataatatcctgcagagtgttttccaacttggttccattctccccatcactttcaggtacaccaatcagacgtagatttggtcttttcacatagtcccgtatttcctggaggctttgctcatttctttttattcttttttctctagacttcccttctcgcttcatttcattcatttcatcttccattgctgataccctttcttccagttgatcgcatcggctcctgaggcttctgcattcttcacgtagttctcgagccttggttttcagctccatcagctcctttaagcacttctctgtattggttattctagttatacattcttctaaattttttttcaaagttttcaacttctttgccttcggtttgaatgtccttccgtagctcagagtaatttgatcgtctgaagccttcttctctcagctcgtcagtcattctccatccagttttgttccattgctggtgaggaactgtgttcctttggaggaggagaggctctctgctttttagagtttccagtttttctgttctgttttttccccatctttgtggttttatctacttttggtctttgatgatggtgatgtacagatgggtttttggtgtggatgtcctttctgtttgttagttttccttctaacagagaggaccctcagctgcaggtctgttggagtaccctgccgtgtgaggtgtcagtgtgcccctgctggggggtgcctcccagttaggctgctcgggtgtcaggggacagggacccacttgaggaggcagtctgcccgtcctgagatctccagctgcgtcctgggagaaccactgctctcttcaaagctgtcagacagggacatttaagtctgcagaggttactgctgtctttttgtttgtgccctgcccccagaggtggagcctacagaggaaagcaggcctccttgagctgtggtgggctccacccagttcgagcttcccagctgctttgtttacctaagcaagcctgggcaatggcaggcgcccctcccccagcctagctgcccccttgcagtttgatctcagactgctgtgctagcaatcagcgagactccgtgggcataggaccctccgagccaggtgcgggatataatctcgtggtgcgctgttttttaagcccgtcggaaaagcgcagtattcgggtgggagtgacccgattttccaggtgccgtctgtcagccctttctttgactcagacagggaactccctgaccccttgcgcttcccaagtgaggcaatgcctcgccctgcttcggctcgcgcacggtgcgcgcacccactgacctgcgcccactgtctggcacttcctagtgagatgcacccggtacctcagatggaaatgcagaaatcacccatcttctgcgtcgctcacgctgggagctgtagacaggagctgttcctattcggccatcttggctcctccctccaaaacaagcttttttataagttgtttttaaattacttgattaaagatgtacacatccacttgcatagaatatagaggcaataacattaagagaatgattattctcttaaggcctacactatcatttttggaaatatttttctatttatttcagatgaaaactgaattcccaagggcatgtttttcaaaaaatataactttgtaatgtttgtgatcatatagtttgaaatgaaattaaaaacaggaggtggttttcttgaaaagtgtggattgaaaggccaaggtgtgactgattgtatgggttttttttttttctgttgccaaaaaaagcctttttgagctgaacaagaaaggtataaaattaaagtaaatgcactcttcaaattttagtagcaacatgaaatcttgctggcaatttgatgttttactgacattgtgtcctgccagcctattgtgaggtacatcagatgtgaatgctgcttattttccccagtgacttctaaatggtcttgtggagtagctcttatgatatgccagcagtgtgtcagcagaataccagtttgtgttccagagcctgcctctttaaatctgaaagttatcccatgtccttttcttgtttctgccaaattctctactcatagtatataattatatgttagagggatgattacacaccaatgaattacaatcaaacttggcttgttagtatataaagctttggttgttaatcacaatcatttaaataggagctcaccctccctgaaatgcagatgtcatgttactatgggttagccttccccaaattggaacctgttatatattagaaagaacactttggagtcatatgttcatcattgcctcttttctgtaacattgagcactgcctcttggctctgagttactttgtgaaactggaatcaatataagagtttatcgaaagaatgacttctcctacaaagtaagtgttgattttctaatttcttggacagagaaagtcaaatcacaccatgtctggtagaaaatatattgaactaatatattgcaaagttattgctattaagagaaatgcaggtttttaaaattagctctttgtttaggctttttcaaaaaagatagaaaacaacaacaacaaccagccagggacagtgtctcacacctgtaatcccagtgctttgagatgccaaagtgggaggatcgcttgaggccaggagttctagaccagcctggacaacatagcaagaccacatctgtacacaaattaaaaaaaaaaaaaaaaacttagctgagtgtggtgttgtacacatgtagtcctagctactctgggggctgaggtgagaagatggcttgagcccaggagtttgacagcctgggtgacagagaaagactctgtctccaaaataacaataacagcaacaacaagaagactggtttctcagtctcacacaggacacacagaattgtataacagtcaacattgtatgaaaataaacaaataagcattatctaatgcaaacttcattagatagatgcagcataggcctcatttatcataacactgtgaccttgacaaatttcttaaacattgggtatgtcatgttctgcatctgtaaaatggcaatactaataaaacatttcccaatggattttgtgagcaggaaataagttaatattgctaaagttcttaggacacttacttggtacataaaaaataccatgaagtgtttgttatataaataaacttggtaatcctaacattatattgaattacaatactttggacaatacttacacatagaaattagaggctcagtgtttgtctagtaaacagaactgcaaaattctcagtaggaacactttcattactttattcataaaatagtatgaatagtactttatttttttatcgtttaatctaaacattctaattctttgttcaggatgggctaatttctcatctgctgcttatctactgaccattcaaataccatttgtaaaataatgcttttcattcctttatttgaccattcattcatttattcattattcagaacttcctgtatccctggctatgcaaatttgtgtgtataaggtatgcttcctcttatttcctcttttaagggagataggtatatgaatttttataatacaggacaaaaagaggatgttggaaaacagatggagagcaaaatccctagtgagttcaaaaggctgggactgttaattctctctgagagatggaggaagactctaaatagcgcctgaagaaatgataggatttggacacgcaaagagaaaattctagagaaaaagaactatgaaatctcagaggtcaagaaatgtaccttagtatctttgtgtttagagaaactagtccatttcactggaatacataaagtacagctgggggatatgagattgggaataaaatttagaccagatcatagggaactttgaatgcaagtgaaggtttttactttattcattggacagaaagggaccttccttgaatgtaaactcaagcctgaaaaaaaaagtagacaagttcagatccttgagtgaaataaatctggctactagttagagtttgaatgatgaagaaaaatgtttttgacttaacagtttttactttttcaaaatcttcccttcattctaacagctctgaaagtattattttcttcaggaaatggctctatgcggactgcctgctagcttactcccatgcagggatttattttcatggaataatctttgagactggattgcaaaactcttcttttagaagtcatcagaccaaaattcttaaccttgctgagcctcagctttagtactctgtcactcaaaagtggtgaaaaaattaggaagctttaaataaattccttgtagttctttacatttttgtgcatatctgttgggggaaatgggcagggctacccaggtttatttagaataatccaaatagtaatagtgtggtttatttttgaagctgactaaaatatttttaagaattaaactcttaatatataatacatgtgctgaacattcttaacgactctaatttaaattacatatgtaaaagtagaagaatattagagaaaaagttttacattcatcagataatttagttaggcaataatattagatttaaaaatattagtttttaaatttaatattgatttattagatttaatatttaatttaatattagatttaaaaacatcatcatgatcatctttaaagtgcttttaccaagagctaaacaaaaaaattgaaagtgaattcatgtaattagcaatatttgatatagaataatcaaatgccaattaaatttattacttttaagaagttatccttaaatggttttttgaatgtgaatgttataaagaataatatctttcactttatttaagctttttctttaaaaaaatagtccttatgtggcaaattagttttagaacaatatacagcattgtatgtatggaacatttttgggtatgttcattttgtgtacattttttcttttatcagtgtcctttgggttttcattggtaattagtagaaatattttcagttgagaaaatgtgatcactatgtcacttaatagtgttatttttaataaataaattattaatatgttctacactatatctgatctatcatgtgaaaccatattaggccaataaactcctcttatatattttggttattagtattaatattactatacatacaattatcacttttcattagaataaaatttttaaattctttgtctcaaaaataaaatggaatttggttcattatatgaaattcttgttcatattacttaaggtgacttgtaattcagagagttattgattctgatgcattaagtagcaaacccatgacattctctttattatgagctctgatatcaaataaaagatgggtttacttgctctttcaaaaattgatttattgccagtttcaccactgtagatactatctttaaaacaaaattaaacatgcgaaagaaatggaggtttagtaatgaaataaagtgttgactaatgattacttcaaagcagaaaggttaaatatgatatgagtaaaattttaacagtacatgctttccacttgattagtttcatacttgttcatgcaaaaggtcatattgtcatttaccaaaaatatggaaatctttcgagttgtttgtgtaagcaaggtttaaaaaagttactttaaataaaaagtagtaagaatactttagggaaaagtaaatttctaattatttttcctactacaattttatgttaattggttataaactatggggcaagtgcaagtttctgagaaaatttcatagtactagagtatatttcctagccctttagagcattgtatatgtggaataaattcctcgatggaacttcaagctctgattattacctaagagatttctttgcaattgtagtgtgtaataatctctcaagttttatcttggtgggattctgatggtgaaagttcagtctcatgacattgtaaagagacgtccctgtaaatgtacctgaatcaaatttttctgctaagaaacttggatatttcaaactatctgcatttatttagactaaattttgtgtggtgaatgtgaaacacactgtactctgatgtctatttcttcgaaaaaaggaaatagaaaaatcacaagtgtaactgcaattccccacccccacccccagccccaccccaccctttttggtttgtttgtttgtttgttgttttattatactttaagttctagggtacatgggcacaatgtgcaggtttgttacataggtatgcatgtgccatgttggtttgctgcacccattacttgtcatttacattaggtatttctcctaatgctatccctcccccagccccccacccagtgacaggccttggtgtgtgatgttccctgccctgtgtccaagtgttcgcattgttcaattcccacctatgagtgagaacatgtggtgtttggttttctgtccttgtgatagtttgctcagaatgatggtttccagcttcatccatgtccctgcaaaggaacagggtctcactttcattgcccaggctggaatgcagtggcaccatcttggctcactgcacctttgacttccagagctcaaataatccttccacctcccacctcagcctcctgtgtaactgggactataggtgcacatcaccatgcccagttaattttttgtaatttattggagacaggttttcaccacattgcccaggctgtttaaacaacttatttttagagacatttaaaaatatataaaacaagtgttttaggcagattagaaaactctaatataaaatttttgaaggcaaatacctttagcttaatcaagggctagaaagatagaaatatgtgtttagacatacaccaaagaaaagggtttataatttattttcttttatgagaattgtgaattatcagaaattgttagctggtagattaaacaattagtgtttacgaagaaagtgtttggtaaaagaaaaaaaaggcttttgaatcttgtggctaagaagttattgaaggtatggtctccagaatttgtttaaacctactatagttgctgttgtccctttactttggagtggatcaaatctgttgcattaagattgtcgtagtctaggctggcatagtctaggttgaatatatgatatataaaaatactatttcatcaaaggaattacaatccagaagtttttaaatttggcattaatgttgctaaatgatatgtggagaaatacaaatccaggttaggaggtcagaaggattatagtaataacaggcattcattcaataaatatttgttattactacatttcagggataaaatggtgaatgaaatggatacagtccttgaagtcctacaacttacagtctgagatagatgtggtacagaggggaacatttcataaggaaaattgccagtaaagaaataaggtagtagagaaggcttctagtggaagttgttaaccttaaacagggaagccagattctatgctaatttcaatgtgagatgaatctaattctatttcatatatccaattcattatatctatatcaagggaaagctagccttgaatgatttcttgccagtacttttatattccacagacagtacatctagtcaaaactcttttcaagcttccactcccatacacaatgctttgactcttatggaaaacctcttttgctttctataaaaagcaaagccatgcaaggtaaagtattttattcttaatcttctttttatcttatcaaattgctgctacttcagctcttactgttcttgccttaaggttaacagaaaggtttactttttaataatctcttaaaatgttgagccaatgtcttattcctactgatacctgaaggttcttgtctcatatttactctctcttctaaccatacatatcaatattagtatatttattccctcgttgccaaatttctcaaataatctgtttatacagacatccatggaatcagggcaaacattttttattatgctctcccaggcttctgatgtgttaatgatttaggggaaatgttggtcctatgcagtgatgcagcagatgcggaaaggagcacaacattaaggagaagttttaattcaattgtgaatattttcagtttgaagaagtccaggagctgactgcaataactacacttggggctcatctgaatatacattcatagcaaaacagactctgttatatcagatttttatgtggtaatgaagacatggttttggaagacgtggcagagaaataataatatggaataaaaggaacacaaagtagagctccttgatcctcacacagggcaaaaaacatggtgataaatttgaaatcatgctatgaggctttcttttctttggtgtcattcacttattgctatgtaaagtaccaatctgactcatactttattttctaggtaaaatttcaagtctttattctcattgccacatgttagctgtattcatcattttgacttaactagcagatagccctaattctttacaacttcttgcatccatgtcctatttttaactaaattggatcgggagttagggtatctcctttagcatctaacgctgttgctttttcatcataagcactgtgtgtgtgtatccatctatctattgatttacatatattttaatataatgtacatataaatatatatttatttattgatcatttatataatgctcattatttctgccattgcagaaagtgaatatgatagagaactggaggttatcattattgaatttatatatacattcaatatatatatcaaatgtatatatatcaaataaaaatgatacatgtatattaaataaaaatacgatatatatttttgcttacagatttattataaataaataaatatatacataaactcaataatgatgacctccagttccctctcatattcactttctacaatggcagaaataatgagtattatttgaaagttgaattttagtgaaaagaattaaagcgtcacagaaagtaatttttaccattttatcctgatccttagagcaaaggtaataacatttctagctttatttctcataaaatgagtggaagtgatatccttaacacccttatggagtaagaggaagatatgacaccagtcaaataggcttacatgaaaattgtatcaaaccatgcaagtgtaagaatatcagaaaaagaaactccttttttaatagataagaaatagttttcattaatttttaatgtccctaaccaaaatacttgttgaataaatgaacagtttttaaaatttcagaagtcaaacagtatttttatttatatttttaatattttaagactcctgtctcatttcttcaagcgtgaagtctcagtaaaagattgtcaataaaagcctttgtgatacagaatttatattaatattgtagattttttaaatgagttaaaaacccaacaatttactttatgttgatacatgcttatttgtaatgtttatgtcttaatgaaatccacctatatatctattcaaatatactgattgagcactactaagaccacaaatacaacctgataaaaagattgtcccagagagtgagaatttgtcgcgaaatggaggaaagacaaagatgaataaattaaaaattacaaatgagtataatgtgctctgacagaaggcagcaattgagctgaataaaagaatagaaaagttaatgtaatgaaatgtctaaatgaaaacactataacatccagttttctatactaatcactttctgcacaagaaaaatactaagcagtccatggatattctctacatatcagatcatatatttcagcttttaaaagttatatctggccttaccctaaataaaatgaaccagaattcctgggtatcgatactgctcctctaatcttaataaaaccctagctattttagtgagtattccacatagggtaaccacacatcttttcatcttgtttgcctcagatggtctcaaagctcgtgttctctcttccttgcatagtttttgcacagaggctgtcttcagatattctctttagtttatcttgccttaggaatcaatacacaggctgggcgcagtggctcacgcctgtaatcccagcactttgggaggcggaggcgggcggatcacgaggtcaggagatcgagactatcctggctaacaccgtgaaaccccgtctctactaaaaatacaaaacattagccgggcatggtggcgggcgcctatagtcccagctactcgggaggctgaggcaggagaatggcgtgaacctgggaggcggagcttgcagtgaaccgagattgcaccactgcactccagcctaggtgacagagcaagactccgtctcaaaaaaaaaaaaaaaaaaaaaaaaaaaaaaaaaaaaaatctatacacagggttctgtatatcctttaggattctcctttaatctcatatacttttgtagataatccttttattaaactttcctaaattacttgcttttcccgaagattctgttcatcatcattatacacaaatgttacatgagaatttcatgcttaaaataagttttctcttttgaatgcaaaaatcaatatttttctcttcctttcatagacattgtaatcaaagataggcaacatagcctaaacatttatatattaaagtgaaagtttgggcaaaccattttattaaccatgaaaatggcacagatttgttttcctaaaatgaccaaagcacgtgttttaggattaaaatagtgcctgaaattccaaaggaccaattttaccctgagaaacaagttcagttattttcaaatcattttatttcctaactttaaaatgatcaattgattgattgtttctgtgtctttgttctggaaactattatatcgttggtatatctaataattattcttacaaaaaaggaaaaatgtactgcagtgagaacacatactctttttaagattactgggctactgcttacattcttgcctcctccccttgaatctagttttcagacattagaaaagtgtatccaaatattccttaagtattctcttaataaaaatcctgctgttttctatttgagcttcttttcccagggtagattacagaatctacctcatctacagaatttagaaacattaatgacttcagatcaccagggtatcatgtaatgtccagcagtaagttgttagagactgaaatatgactgaaattaaaaattgcttcctgagatttggagtttaaagctgatttgagcaaatggatttgatccatagtagcatcataggctaatttaatcttgctggaaaaaagtgtaatatctgatatgtgtcgaatacatatggacgagtagaccagtgagttccaacctgactcgttattcttattgtgtcaaataaatagtatttgattattaattaattatattttaagctgagtataaataatattctgaactgatcaagaaatatctatctaatgtatctgctaaatttagaatatcattaatatctggaaaagatgaaatacaaagagtgcactttgttctgagtaactcattactgactcattatcatcatcaaaaagaaactaaagtgggttaatgaataatcttgcctttgactgtactttgtgcttctaatgatcttacctcaatgagaaaataaaaatgcttactttaagatctgtttgtaggattcccttaggaagacaaccttctttgtttaggaatacaccttaatgagtgtttttggttttgtaattaaggacttctgtgcgtattctaaattggatagagcaagaaaaacagctgaaatgctttttgggagaaaacacagaaaagtaaacagggatttttacaggatgtaagcaaattaatcaagaggagatgggaagaagaaagccaagaaatgtggtgataagagagcgttcaagataggggacttttggagttcctattgtgttgaaaaaagaagccattttctggagatcctagtagaaagtagaaggactagtgatagcagagatgacttttatatctgtacagatttctcattctgagtaataaagcacagctatgaaaatatgcccaaagtagacttaataatatttgttgtaattaattttatctgcaactgatggatgaccttataaagtaaggagctcataaaatagagatattcagagaaaaaaaagtctaaaataaatagaaaatttccatattcctgcattgtttttatactattttaatgtttagtattatctgggcttacagatctctgaacatatttactacaaaatacatactttgttatcatagccaagtattataaatagcagaaacaaagttcagtgtgctagcaggagatgtagaagccttggccaaagcaagataaaaagaagaattaggatctgagaacaggtcaatttttaagagatgattaatgacttttataaattacgttcttctaaatttcattgttccattttcactagattacatagaaatacaattttttttgtatattgactttgcatcctgtaacattataaaattgaagtatttgttttttaggtttgttgtagaattcatgagtattttgttgctgttgtttgtttctgagacaggatcttgatctgttacccaggctggagtgcaatggcaccatcatagctcactgcagcctcaaattcttgggctcaggtgatcctaataattcagcttcccaagtaactaggactacttctattcctattttgaaatttatcaaacagactttattatgaatgttcatagaaattctatttacaatgcaatttaaatataatttcaacttagaatctgaatatctatgagacaatggataaaaaatgattggatagtgatgatatattcatacaacagcatactcggcaataaaaaagaaagaatagatgtacaaacattgataaatactacaggcattatgcaaatcatacgaaggtaggcacaaaagagttcacattatatttcatttgtatgagtatctaaaacagtaaaactaatatatggaaatataagttaaaaagatgattgtctgaaggccaaggatgagatttcactgggaattgacaagaaaatattctcagtggtagaaatgttctatattgtgattggatgctgtggtatagatatatacaattatcaactctcataaaattgaatatttgagtgttatatattttaatgtatgtaaatgatacctcatttgtaaaagagaaaaagcaaactaaaaattaagaaaggaactttgcaagaacatgttattctaatattggtctcatacttatatccaaagctgtgaaaggaaaattggtaagtttattcagtagtagattttctttaaataatatgcttacacttttagtacttaacaaaaccagaaatttttaaaaataataaattgatgagtagaaccacattgttgagagcagaggaatacagctctcctttgtttaattttttcaaatgaggataaagacaatatcccataatagatagcattagtgaaaaagtatcctgtgtaatcaagttatttctatgtttaatcctgatctttagtaaaaatgctttgctgatctggttatagtgaatatttagcacaaccaattttattttgtttatgatatttttgtgtgttcatttatgcttaaataatagctttctggtttcctttttaaactgttaaataattgtcctgtttatttgtccttgtttgcaaacaagtagcctctccaatttcactcaacatttaacaacttaaaaaatctccattagtctgtaactggccacacttaagccactcaaaatggtcatgaaaagagaccataatggtcatgaaaacagaacacagatatccaaaacaaagagctgtataccccaaaatatatgtttttcagtagtctttacaatacttgtttttactttttaaatttctctagggagctgtgtgtctgtttcacctccgttcttgtagattagatgatctccactaatgcactcatcattaaaaaattgcaagataaccaaattgtttggtttgccatggcataagtttaatagcttgtgcactattatcaaaaataatgacactcttgtaggtcactgattcactgttgagacattaaagtcctatatagccatgaagtgaaaatggcacatttgattttgtgcctagattgttagatacagaatataaaaattatgcttagtactatttttctgcattgggttcaaattaacctctttatgtaaaagttaattttgtgattttttattgtacagtacactttgaaaagattttgaagatatataagctggagaattagaatataatcaacatgaaattcactattcaatgagagctagcatttaaaatagagataacattgtttcaatttctaattgcaaattgcagtgttacctctaaatgtgattttatttttctctaacttgcatggctacataacatgctatgatacttttctaatactctaaaaagatataacttaatttttttcctctggagattagatataaactttgaaatactagacttggtgtgtaactttttactcttcatcttcttctggaggtgtagggtattcattgctattgcaatatagaccttgtgaagttactgaaagcctctgagtacttgtggtcaattaggccatgttgtggtgactgatcgatgactttcataggatggtgatattctggaaatttcaactttgccttaatagtcctctgttctttatttaataataacacaaataattgcaagtcccttaaataatgtacctttgtccttaagcttaattttgcctatatgcaaccaagcaaagatatcttcaactcaaaaggtggaaaatgtaataattgatgaaaagatgagacgattaattgggagggcagatattatcaaactacaacagagatatagaagctattgtgtttttgcaaagctgttcagagacaaagcatgctgagttgcaattgaaagccatctctgatcaaaagccagccatttttacatgcagtgacattttctaaaacagaatatacagttttactttggaatatttcacatcttgttttattcatttgttttatacattctctgttctgttttaatatgtttagctctccttttgggtagacattagtgaattacatcaattgagatatgtaaattttttttctattttaatgtttcttaaattaagatgtgtttttaaaatcggcacatgtttaatgcagcttttcttttttgaaacactttcattgagttgacaggttttcttgcaatagatagcaccttagaaatcaagagaaaagggttcaataaactaacaaattcaataactttaacattcagtaacttttacattcaataactttaacattgaataacaaattcaaaaactttaacattcaataaactttaacaaatatttattgagtgtgtctgctctgcaagggataaggctaggtactaagaaaaccacagcaagaaggacaaaccaggtcttaatcttctcagagttcttgaaagtagagtaaattaaataggctatagtctagtaaattaccactgtggtatgacagagatatattttaaatgctataggataaccagagaggcaatgtataattctgtctgtgcttttcagaggagaaggaactctcaagtggaaggataacaagcggaagaaagaacgtaagcaaaagcaggaaggtgtgaaatgtcagggtgtgtgctgggaatgatgagtagtctagtggaactctagttagggcactttctctcaaacatgagtaatgaacagaacacgttaaaagaaaaaaagatcttgccaatctacagtattcattcaaattatttttgttaactttacatatgtaatatttgtttttacaacagttaaactccaaaatacatctattcattaaaaataaacaacctcacaaaaacaattaaaatttaattatcaacattaactaaagtcatatgtgagtttttattttggggcatgatgagcttaaactaaacaagaaactagctttttcactagtttattcactgatctgtgaattgaataggccaatcaatttaagtacatgtcaaaatatcacaccataataatgcttagcagctagtgttattgagttattatatgtcaagctctgtaacaactgttttaatccagtatcttattattctttaaagactttttcaagtggcttcccctacggtacttatactttaatggatgtcctcttacctctctgccgccgccttcttgagcatcgttgtagctttatcctcttctaactttctaatattggaatatttaagggttccattcttagttctatatactctgtcttttggtgatctcatttagtttcatgagttttatttttctttatatcctaacaaccaaactcatatattaaactagctccttgatgtcagcacctgggggcctagcaaacatctcatactcaatatgcccagttttaaactactgatatgactgggaacggtggctcacgcctttaatcccagcactttgggaggcggaggcgagtggatcacttgaggtcaggagtttgagtccagcatggcaaaaccccatttctattaaaaatgtgaaaattaaccaggcatggtggtgcacgcctgcaatctcaaatactcaggaggctgagacagtagcatctcttgaaccaagggaggcagaggttgcagtgaactgagatcatgccactatactccagcctagacatcagaacgagactgcctcaaaacaaacaaaacaaaacaaaaactactagtatctccagacctatttatgtttcagtcttcaccatctctcagttgatggcaattccatttcagttattcaggacaaaaccttggaatttttcttgatttattttttctctcatccaagattcaaaatctttggaaattaatgagtttatattcaaaatatatccagaatatgaagcctcttctcacgacaccctctgttgccattcatatccaagcagccattattatcattacgtcttgtctacatttttacaatagcatcttcctaatcagtgtccacattctactgttgttctcccacaattcattgcaatggattctcaagaaagttgccagtgtcttcattctattatgtaagttatatcaggatgtgactcctgtaatttgaaaatcaaaagctttttttttttttttttttttgaggaagagttagaatttagacagtagcctacaaggctccacatggtatgattccccaactttctttttatagaatacagcagcagtgtacctagtgtgcatttgacacatacattggattattgtttagaacttctctcacctatacaacaagaatataattaataataataatgaaataagtaatcagaatagccaggaaataaaccaaaacaatataaaaattattcaacttttgtcatgattatatatacatatatataattttaaaaatattcttagaaaagcaaatagttaaaaatacttaaaagcttaatattttaaaattatatttatacttttttgaaaaaaaggaagcttgtatctgcatttatttggttataatcataaatagtatcattctgttttccagctttaacctctgcatactgtcaatgactttgtctagattactctgctttgcatattcataattaatagaggatttaaacagatatgttgatctgtctatgctcatatttggtcagaggatactttttattggttttaattttttatagtttctttcatatcaaataagagatacacaaaattagaaaaacatttaatatgcagctaaatttgaaagagatgtataaaaatcccacttcacaataaattccagaaaattcataaaaaacaataagtggttacattgaaagtgaaataaattttgttttctttttataattacaatataatttatgtttatatagaattaactgagtttttaaatgtattttgttgtggttaaaaacacttaacataaggtctaccctcttaaaaaatttgtaagtgtactctacagaattgttaattataggaataatgttgtacagtagatctctagaatcgattcatcttgtatcattgagactttacgcccaagggggagttgctgacctgatctactgtttaaattcaggcatagttaggaccaccacaggcactggatttataaactgtgccaagtgggtttaaagaatctcagaacttcatgaatttactcttgattgattatataatgaagttgtctgaattagcattcatatagaatacagtgctttatttcattttagtgatacataataaaacatgacagtttgaaactaataagcaaagtattaaaattcaaaaaataaccaaatcagttttttagagcttagatcaataaataattttttcagaaaaataatttttcactgaccttgttttgagtcgcctgcaccctgttggactgttcctactgttccacctttggtaggccactgaattttgagataagaaattcaagataaatgttccgtatttaaaagaattttttaatacatttgcagaattcaagttctgcttcactgcacttctactttagctgaacctttggcctataataaatatattctggaaatggtggttggttaatagaaaaagtcctttaaagtattagatttgttgccagtttttaaatatatgataggggtcaagaaaccaagaatcacagaacaaatatggcctgccaccagtttctgtaagttttattggaaaatggccatgctcattcttttacatattgtctatgcagctttcgagctggaaagaagaattgagtaattgaaacaaatatcaaaaaatggactgcaaagcctagaatttaaactatctgtcctcttatagaaaatacttgcaaaccccttcttattgtgtagaaagaatttggtgttaaagtttactttataatgaatttatttattgaactgtgttaatgagaaacagaaaagcaaataaaattgatctagtttggccagattgtatgcagtgaatgatttactatctgagaaaagtgttactgaggcaacagtgtttttaacatgactgtgaagtcaacagaggaaagatgtttatatccatggtgtgagattatgaaacattaactttgcattttcattaatattggaaccaaaatagcttttattgaggaagaatgattgaagtgttagcatccatacaaggtagagtaacaggaaataatttatcatgagatgatttataactccactttatagagacgaatattttcatggtacaaatatttcatatctggaaatgattgtaacaaatatgattttcccccttcagcataagttgtatgagcagcttcaccagttcagtgatacaaatacggttgaatattgcacttgtccaattaattgcatgagttatcccctatctattttaccaagaaggttaatatcaactttttgaggtctcaacatccagaattgctgtttgtaggctttcttagtctaaagaacacacagatggatagttagagagcccaggaagtacacaaaagttcccattttcaaaatgtctctgcatcctgttgttgctccatgttctgctgtaaattgctcctgaattttcagtattctgtgggttctgatgtggacctctgaaccttgctccctttcttcccaataggctgcttgaactctaaatttatctagttcctcctgtacaatcatttccatatacaaaggaacaactgtgtagagcagatgttagtcaaaccactgaagttcaagttatcccatttcccattcatagaatggtgattacttgcatacatttgtgtaagtgagagggccactgagttggtgcctaaaaagaacattttcaaagtaatactgggcccaccttgccaaagtggtgggcaagagcttcttgtttccaaaataatatttaatatctacctcataagatatattttaagtggtattactaggaattataattttatatttacaaatagcatgtgtgttttagttataagagctgccaaaatattttaaaagaactacttctttaattgagaggaaacagtgaaattaagacaaattataataaaggaagccatgtaaagattgaataagctttatttgcttaatgatatagtcacagatatccacgtgtattcactattttcacatattgtgcctcgctattatttgtgtgctcaaggtctctatcttcaagtgttatatactgtagagtttcctatcaaatatgagcataaaggaatgtttcatctctatctttacagtgtaatcttaaaactgctagctactattggcttttctttctttttccttttcttccctttggcttttgtgttattgttgaaatgatgtatctattccttttagcatggcttatactaggagctctgaaacccagttcagaaacctgtgagttatttattgatgttaacaaaagttaaaatcaataagccagacataaaaaagaaacttctagatctaagacgaatgtttagttaactttgaataccgtatatgaaattctcaatattttcctgccagatgttcatgtcatagagttagcaaacagttattgaaaacttactgttgcaaagttcttgggattcaaacctaagacacaaaagaccttcaggcaatttgcagtccaattgcagaaactggcaagctgaaaaggaattactgtgtattatatgttttattattggatagaagtaacagagagtgctatgggatcacctagaaagagcaactgaggaaattgtagatagcaataagaagagccaattgtcagaacacagttgtcaggctgactcttgaaagatgagtagtaatcagatagacaatgccatgccatgagaaagcaattaaaagaagttggaaattccatgttaaggacacagaaagacccaaagtgcatggaaataaacaagtgttggccatttagagagcacaagtggtttggaataactagaattcatatttttgttttaaagtgtcaagaaacaggccgaattagggagaaggaaccaaatcatgaaagaccatatccagaaataaaagtttttctaaagataaagaatgaagttgaattttaatgacagtaacacaatcagatttacttttgtaagaattacattcagagaatagtggaagtcagagtgcttgcgtgcatgtgtgtgtgtgtgtgtgtgtgtgtgtgtgtgtgtgtgtgttgagtggggagggaataattttcatactccaataagaaatgttgaagacttgagctttggcaaaatttattaatttatgaggattttgagcctttcatctcaccctgcccattaaaaaattttctaaatttgcctttataccatctcttctgcttactggggcgatttcagagctgccacctggctggaaacttactcacataaagcaagcaaatccctcaaggggccatagcaaaggagataatctgctcatgggtcaatgggaggtgaaataaaaaagaatatgcagaagaaaagattgaaggttgttgcctggaatgattcctgaagccaagcatcttcggttgttattttaatacttcctttggacactgaaggttggaactgttaaaaactgttaaataagaacatagagtcaatgagaatagacaaaactgttaattcatttgtctgtggaaggaaagaaggaaggcaggggctagaggagtgtttggaaaaggtgaatcaatatttattaaaggaaggaagtgggcatttccaagaatatattttaggataaaaaagatgtgggtatttttttataaatatatatatttttattattattattatacttttaagtttttgattgagggtgaatcagagagggacaattttaagttctaggatggtaactgactgtggaagatttctgtggggaaagcaaggacatctagactattggtagaagaatcctggagggatcattcaatgtgatttaaatttatattcaaatatacttttaatagcaattcatatttttagaaaccgctcatgttggaggaaggattccatttatttttgtggtattttttaagcagagttgaagacccctatgaagaaagtatgaggaagcatttatgatcaaaacggggaagaacgttttttgcccaaagtgacaatagctgtattgtttcctctgtctatataagtaatatatgctaattattaaaaatgaaaaaatgacatagaaaatacaaatacttttgaaatttcaatgcaaaaatctttttgttgactatctttaatactacttgctcactctctgtctctctctatcccctacacatacagcttaggtaagtggcatctcatcatatgtggtgttttcaccagaaataattttataaaaacagcattcaaaatatggcttattttatttttcccctttttcttactctctctaatcttacctgtttttgaaacagataaccagaattaattacaaagagaaatgtatttaaattcaatgcctgaggtggggtatattctctaggtagtcaatgtttgtttatttccatgaactttgggtctttctatgtccttaacatggaatttccaactccttttaattcctttttcatgccatgtaattgcctagctgattcctactaatgtttcaagagtcagcctgataacattctcaaaagtgattttgagctgattttctcagaatttccccttgctttaacgaaaacaaaagaaggaagctcaggaaaaaataaacaaacaaacaaaacaactttttgctatctaagaattttcctttaaaatgaatttggatttcttggatgtcttataagataaatagtttcctactatcagaattagtcttagatatatttgatgataatctctcgtacattccatagactcaatttctaaattgagaaggaagttgtcctagagcacttgtaggtttctttccaattttatgtttttattggagctttatatccaaccctatatccttagaatcttcattatttgtaaaattatgaaatacagcaagtgatgggcaatttgtgttatcccagttttaaaagaaaaaaaattcatataaataaagcattttttagaagtcataaaacagttctattatggaagcagaatataacttaaaactataaaaactataaacttttttcagtcttctaatgtttccacttgcaaaataactgagagaatgcaaaatttgaatatagtgtacaatacagtttttctcagtcttttccactttactttttaaatcgcaaaagtaaaacctgtcatggttaattttaaaaagtatacaactaaaagtaactttccatccccaaaccagaacaccaatccctacatttagaagaaaccactcttaagaaacctaatttatgcatataattcaattgtgtaactatagcaaagcttttaaaagagatttgattacaaaacattttttgcaaaatttactgtatcatatccatgttccaaaagcaaactaaaaagatctcaataaatcttccctgtttactgaattacattgaaactcctttgcttagccttcaaagtctgcagtctgaccttactttatctttttagtggatctcctgctgcttttttatatgtgtgtagtgcactcatcaaactgaatattttatgaaactgctcatgcttttttaatctgttaaaatcccttctttttcactaacctttcaaatgcaactatctccataaaatgtactggataccagaaaaagattgtgttttcccctcttgtgattaaccataatacaaatgggtacacattatgcatataaatgaataaatatatctttcaaaaggtattacataatgtagtttcttgcattatatttgtcattatggttgtatttgtcctttaataaattttacattttcagaagagtcccattattttacattttgcacaccagagcacctacttagagtagacacaatatatatccatctttttttaaaaactctaagttctgggatacatgtgcagaatgtgcaggtttgttacatacgtatacgtgtaccatggtggtttgctgcacctgtcaacccatcacctaggttttaagccccgcatgcattaactatttgtcctgatgctctcccttccctcccctgccctgctgacaggtctggtatgtgttgttcccctccctgtgtccatgtgttctcattgtttaactcccatttatgagtgagaaaatgtggtgtttggttttctgtacccgtgttagtttgctgaggatgatggcttccagcttaatcaatgtccctgcaaaggacatgatctcattctttttatggctgcatagtattcagtggcatatatgtatcacattttatttatccagtctattattgatggtcatttgggttggttccatgtctttgctattgcgaatattgctgcaataaacatatgtgtgcgtgtatttttataatagaatgatttatattcttttgggtatataccaagtaatgggaatgctgggtcaaatggtatttctggttctaaatccttcaggaattgccacactgtcttccacaatggttgaactgatttacattcccaccaacagtaaaagctttcctatttctccacagcctcaccagcatcagttgtttcttgactttttaataatcaccatcctgactggtgtgagatggtatctcgttgtggttttgatttgcatttccctaatgataagtgctgttgagtacttcatatgtttttcatatgtttgaccacataaatgtcttcttttgagaagtgtctgttcatgccctttgcccactttttttttcttgtaaatttgtttaagttccttgtaaattctgtatattagatctttgtcagatgggtagattgcaaaaattgtctcctattctgtaggtcacctgttcactctgatgatactttcttttgctatgcagaagctctttagtttaattagatcccatttgtctattttagcttttgttgccattgattttggtgattttgtcataaaatctttgcccatgcctatgtcctgaatgctattgcctaggttttcttctagggtttttatggttttgggttttacctttaagtctttaatccatcttgagttaatttttgtataaagtgtaaggaatgggtccagtttcagttttctgcatatggctagccagttttcccagcaccatttattaaatagggaatcctttccccattgcttgtttttatcaggtttgttgaagatcagatggttgtacatctgtggtcttatttctgaggtctctattctgttccattggtctatatgtctgtttttgtaccagcactatgctgttttggttactgatgccttgtagtatagtttgaagtctggtaacatgatgcctccagatttgttctttttgcttagaattgtctttgctatgtgggctttttgggttccatatgaattttaaagtagtttttttctaattctgtgaagaatgttcatggtagtttgatgggaatgttattgaatctgtaaattactttgggcagtatggccattttcatgatattgattcttcctgtccatgaggatggaatggttttccatttgtttgtgtcctcttatttccctgagcagtggcttgtagttcttgaagagctccttcatgtcccttgtagctgtattcctagatattttattctctttgtagcaatcatgaatagtaattcattcatgatttggctctctgtttgtctactattggtgtataggagtgcttgtaacttttgcacattgattttgtattctgagattttgctgaagttgcttatcagcttaaggagttttggggctaagatgatggagttttctaaatataggatcgtgtggtctgcagacagagacaatttgacttcctctctccctatttgaatacactttatttctttctcttgactgattgccctggccagaactttcaatactatgttgaataggagtggcgagagagggcatccttgtcttgtaccggttttcaaagggaatgctttcagcttttgcccattcagtatgatattggcttggatttgtcacaaattgattttataattttgagatatgttccatccatacctagtttcttgagagtttttaatgtgaagggatgttgaattttatcgaagctcttttctgcatctattgagataatcatgtggtttttgtcattgattgatatacagaagaaacactaagacctccatttcagcatcatctttgaagaataaatttcttttgaaaaataatcacctggaaattagcatatggtgcatagtttcatgtctttgttagatgacactagagtaatacacaggttctacctcttttcgggataactaaaacagtgtcagagggcgtaaaatactttgagacatcaacttgaaaaatgtcattttcattttgtgatgatttattaaaagcccaattgatttaaaattttttattttctgttttaattgtatttctcaatttatattttaaaaatatctaacaaaaatggatatttaaagaaatacaccttgaaattaaaaaatgtgcagatttcataatttttcacattttcctggcatacggaagcttttagaaacagggaactaattcattcatacaaggtatgtgatatttgaaaataattttaactatctcattgacctttcatttttgtttacctttactctgaaaactttgggtactcacctttcttttttgtcttacatttttacagtcttaagcagtttaatattttcttttctgcttatttgtaacctttgacgctttttcagcattacagccagaagcaaatgcataaagtgtctcttcagatgtaacaaggatagcaaaaccactgggctaccggttacaagttgttattagtattttgtaatggaaagatagtagactttgaatatagccaaatagaccacttaactactcactggccatatttttttaataagttgtacttctctgaattttgtcttttatttgtaaaatattttatgtcattttgtgatatttaagataataagtgaaagcactatgcattatacaggtagatatttatttattgaatactgtttgcctgttctactagaaaaattgatctttgttcatggtatcctagaggtttttagttaatgagactattaatagcagcaaaaaaagaactccacaactctactaaatgcttattcagtttattgtttttcttttaggtttagtcatggtgttagtgtatattggtccatttggaccccagtctcatctacatgtgaataagcaaggtagttaaataacaaataaatatgaaatatcaacaatagttgtggtctcaagtttgcaaacatgttggtaccatcactgggtgtttagtttcagataggatggcagcattagaatgctgcagattctgtctgaaggaagatttacacaactgacaggatattcccccttgtaattctggtttggtacccctataatgtgatcatctcacaaccatggcattattggcatagttctctaaccaagcaaatgaagctgctatatatacacttaaatcatttggaaacatgactgtcatttacagactgaatccccttagtagtgcaaacataagtttacctatatgcacaacatacattattattcttatgtgtatctatgaatatatttctaaaatatatctgtatctatcatctatctatcatcaactatctatctattacatataagttatgtaatccaaccctcacactttccaaaaacacttcaaaccacagtcagtgatacactaaataatgtaattgcagttttgtcttcaaccttatcccatttttaagcatttattataatcaatatgtgttaggataattttggaatgttttccatggcattatgacccagaaatgcaagaaaacagaaatatctccctcttgtttgattggaatttctaaagaagctaaacatatgaagaataacctgtaagagcccaagtatgttttttattagtaactgcttgagtactcaatattctaatgcaaaactctaaaaccatgagtcctggaaccacttaggcttatggtctaagatgaggccgcttaccatccatgaaaacctccatccatatcttagaattttcctaccttgttttagaaagtacagaactgataggcactacagaatcatacagaaacatgtctctgatggctactctcaagcatgtagagggaggcaaaaccagagagaggaaatctgcaaggtcttttatgagggtgaaatcaatttattcactcaggtccataaaactggagcaaagtgtgacttgtacctttcacaatatggtgactataccttctagtaactatgagtaactatggtttatttgatgaaccaaaattagctaattggttcacaaatttaactactccttcacaatatacacgtgcttgtggaatgcaaagaatacagcttgggtagagaaattaactttccacttttcataatatgccaaatttctaagatttataagtgaggatagtatcatataagttattaacaatatgtttttttcatacacacaatttcagaaatggaaatgaatgatttttaaggttttgttttttttgttgtttttgtttttgtttttttttttttttttgagagacagtctcactctatcacccaggctggagtgcagtggcatgatctcagctcactgcaacctccacctcctgggttcaagcgattctactgcctcagcctcccgagtaggtgggaccacaggcttgtgccaccacagccagctaattttttgtgtttttagtagagacggggtttcaccatgttagacaggatgttctcgatctcctgaccttgtgatctgctcacctcagcctgccaaagtgctgggattacaggtgtgaggaaccacgcccagcctaaggttgctttttaagttttttttttttttgttttcaactttattttagaattgagggtacacatgcagctttgttacagaggtatattgtgtgatgctgaggttggggtttgattgaacccatcactaaggttgtgaatataatacctaataggtagttttttaaattcgattcctttttgctggaagccaacataactccattctaaccaagagccacatgcttaccatgtatcaaccagtagctacaataatacacagatgtataaatttgaaatttataaaagagttttgcggtccaaatgaatatgctctcttcagcttgcgagttgtagactatcattatcctaggatattgttcccatcatatgattagctcttcaaaattctaaccactttattgagcaatatcaagtcttttttatattcaatgccatttcctattattaaattgaataataaccattattcataattccattaattacttactttgactaaaaagcctcatcgaagctactaatggatctcctttcaaggcttgttaacatggcacctcaaataaaatactcaatgcctgatagctagatgcacttctaacctttctagtattgaatatacctcatcaatagtatttttaactgctgctgaggaaagtaggagatgcttgaattgctgtatatttagtttaatcatcaaagtttccataaagctgtatacattctatcttattcacatccacatgaaactgccctttcctaatacactcttttaagagaaataaagtaatgataacacacttttcaacagatgactcttatatattatcaaagatgtaaaagaaaatcataaacacaatgctatgaaaatcatatgattaaatttcctgaggagttagaaaaaattttaataactttaaaagaactagaattaaaaaaaatccagcataataatattcatagtttttctaacctagttacaattagttaactcctatttatccaaggaaataaaggaaaaagtgatttggaagttattcccttggataaataggagttttctttagggaaaactataaaatacccactgggggagcagtcttataagtaaaaggtgaatgtaacatataaagactatgccatctgttttcttttttttttttttaattattgattcagagagtaaatgcgcaggtttgttacatggatacactgtgtaatgttaagacttgagcttctagggcacgcatcattcagtgaacattgtacccaataggtaatttttcaacgcttacctccctcgcgcctttatcattttgctttcttaagtagtttacaattatgtattttttaaacatcaccccctcaaactagatgtttgtctttgttatcaatagaatacttgttttgggaaatgggagtaaaaattaagttagtgccttgtgaagtttatcaccaaatcttagagaaacaaaatgggaaacatcgaaaataactgataagatctgaagattatttttaattttaaatcgtatttgccaatattattgtcatttaacaagttaagcagttgcatgtggcaaacactgagcagagacaacagagacctgttatataatgtacttctgtagtgtgattcaggagctcccaggtaaggcaaagccaccccagaagtcatggtgtttcctcatgtttctagcaaaaaggtctaaccttggactcctgtgaattgagagaccttaaaacacattggcatttcttggtgggaatggggagacatattttcttgatttaagagtttataaatgatgtgattatttatttatttatttgaaatagggtctcactctcttaccaagtctgcagtgcagtggcaccatcatggcttactgcagcctcaaactcccaggcataagtcatcctaccagctcagcctccagattagctgagactgcaggtgcatgccaccatgcccgaccaattttctctattttttgtagagctaggatctggctatgttgtctatggctagtcttaaactcctgggctcaagtgatcctccagcctcagcctgccaaagtgctggcattataagcatgagccactgtgcctggagtgatttttaaataatttattttctaccacatttaggcctatatgacaccgtataaatttatcaccatgtatgtaatacttaagacaaatttctataaaattgaaatatgatgatttaaaaactgaaactttaaaatgttgcaaatggctgcttttcagtgtctttgagagtggcggtgtttattttgcaacctttttctggccttttacttcgtgatatctggtaaactttactgataatcaaggctgaataacataacatctacaatcagtatgtaatcaaatctgatgaaaaaacatttacacacacttatcacatatctatatatgtttttaaatgaactgtttttaagtactgctatttaagaccttacgcagtagctcttgaactggaaaatttattttttgttatcaatgtcctagtatgaatgggaatattcaaaattattctggtattcatgatgacatttagaatctaggttttcctgtttattttgcttgtctttgtctccagtctgatactaatttggaagttaatatgaatatttgtaggaaaaaactgcattctgaggagtcacttctaaatacttgcatccaaaatgttactaaatgaaaattaattgcttttcatgaaaaagggacattttacaagactgtgtaatcatattagaataatgactggcctcactaatggaaattaaatgtgatgctgggtgttctggcagggtggcctgggagctaggtttgcatgtaaaagtgtaatttctatccccgctgagtagattttgaatctcaaaataattagttctgtcaaataattaattttgttgacaggattaagtagagaatatacaacctcacacacatatattataattatttggaatgacaagatgatataaaacaataatcttcaattctggctctcaaacttgatcagatcatttctgtgagtacttttgagattcatgttaataaaccttgaatgtaacatataagtcatcatctatggcgccatttacatatggaattcttatcatagtcattaaatgtgctttatatgtgggtgtatgtgtttgtaggaaagttattgtttttataaaacactgcagttcaccaggaggtagttctaagcaaatgttaattttctgaaactctttaagaaagtgcagctatgtaaattgtgtgtttcttttgctctccgaagttagataacatttaaaaagacatattgtttaaaaatgcgtattgtttgcccttcaaatgtaattacatatctaatttaactttccacatagattttctagaacactagaagaaataacatttcttaacatacacttacatatgcacacaattaattttaataaatagccagtgtaattctctataaaactgaaatgttggtaatattccaataaaaatcacccacatgtatcctatttgacatattctgtgatgtcatggtcatttccataagatataaacataatatatatttcagagcaattatttgtagcagacagctggtaaaccaacatatacaaattggaaaatcactaggataaatatgagtgttcaagaaatttagattatatcgacccatgtctatatttaaatctatatttatttataaatctacatttatctgtctgtctctttctcttaggaaatatctctggggatggctcacaaatggcaatttttaaaaactcctcagatggttcttttgtatagccaggattaggacctatattaataaataatatattaataaataatatagatcctaagcctatatataatatcatattatgttattcataaataataaattgggatctatattaaaaatcatagaattttactcaagaatgaaacatgaagccttagaccattgaaaatatagtagccacttttccagaagacaaaattgattattgtaaaggtgtagatttttttcacaaactattttgtaatttatataacaatccaatcaaaataccattttttgacaatttggcaaatgacaaatgattctaaagtttttaagagtaaatagttatatttctatatgctattttgaaagaatttcagtaagaagaataaacgtttacacagatacatatatgtgtacatgacaattagcataatctttacatatatgtgtgtgtatatatatctatgactatataatatcttgtgggatacattgcagtccattaactgatcaaataattattcaataagtagtgctagaacaactggctacttttagaagaaacatcagatgtagtctcactctgcatgaagaagaaagtctataaatcccaagcatcccttgaccaagttctttttattctgagaacaaattctgagactaaaaaaccaagatttatacttaattgctatttgcaacaggagaaaaataagcaactctaaatgtccaataataattaaatgcttgtgataggagataaacctataaaaaatagaataaaaaaggtttctttgtaaaaagatgactaagaaataaattggaaagaaaatatgacaagagttaattatatttgtcttgaggttatttttcttcctgtgtgttttcagttttcccaatctccatgaataagcaaatatgaatttataatgagacaaaacaaaacagaaaaaaaattataccaactactatttattggagttaatttgttcataaaaacttggaatttcatcgagtattgtaaaattacctaaataatggcttgataaattttgctgtatagacatacttaatagtattgaaatgcccttttactttaattaatatatttatttctgcttcaatcaaagacccactctttaaaaaaaaaaaaggaaaaataatttagagtataatttgaagaataaacccgaaagaaggttttgaaaggaaaaatactggagaatcatttgaataatcagttttagtaatggaataagaagaaatattggcacgggaatagagaaaaatatactgataagtattaaaaattccagagcaaaatctatgtgagtttttaatatgtaaaaaggcaaaaagggcctcactcattacttttctttctctttttttagagacaggatctagctgtgttacccaagctagagtgcagtggtaggatcatagctcgctgcagcctcaaactcctgagctcaagggattcttcagcctcagccttagactcccaagtagctggaactacaggcacacaccaccatgcctggctaatttttttttttttttttttaacagacagggtatcactatgttgcccaggctagtatcaaagtcttggcttaaagggatcttcccaccttggcttcccaaagcactgggattacaggcatgagccaccattcatacccacttcacttcttttcaatagaataaataatattgttaatagataacattgaaatattgggccatctgtcagaaatcaattttatttctaagcctatagaaaatgaaagcaaggccgggcatggtggctcacacctgtaatcccagcactttgggaggccaaggagggtggatcacaaggtcaggagttcaagaccagcctggccaagatggtgaaaccacatctctactaaaaatacaaaaattagccaggcgtggtggcaggtgcctataatcccacctactctgaaggctgaggcaggagaatcggcttgatgatctcctgctgaggcaggagaatcggcttgagtgcagtgagccaagattgcactgcactcaagcctaggcaacagagcaagactctgtctcaaagaaaaaaaaatgaaaacaaaccaaaaatatagagaagattataaagatccaaaagtaaagacaaaataatcaaatattagaaaaaatatagggatattaattcagacagacatgaaatccaggtgatttaaagaaaaagatgaccatacctgattgcttgggaatataaattccttgcagatgaaagtcaccataaggaaagagagagaatcctgggagatacttaactaaaataaaatagttactataaagaacaacattaaaattgataggaaaaataaagttttaaaataggtaaatgttgtttaacaggcaattcaaaaaagaaggaaaagcaaatggatactaaagagatgaggttaaatatgtttaatagaagaatataaaaggaaataacaatgacctattcatttcaccaatcagattgatagaaactaaatttttgttcatattgaatacttttgtgggaatggggaaattggtaccctcatgtaattttcgtggaactgtgaaatgctatgaataataataattttggaatttaagagagcagcatctaataacattttgactgtgcatataactttaccctataattacttttgataatttttgtacataaataaaaggccaacatattaatatacatgtcaaatattctaaaaatattaattctgctggcaaaaatcaagaacagtttccatggtggttacatagggaatggctaatcaaataatattttatctcttataggaaaaaggcaagatttaaaaagaatgagtaactgtgcagtagcctgaaaagatgtccatattacattgttaagtaatgtaagcaagttgtacataatgtatgtgatatgatgctccagggttttagacactttatggagtgttgagacacacagatggacacataccaagtaaagctatattaaatttcaaatttagttagttaaggataacaaatcagtgcagaggagtaaaggcagaatacttcagtatgtatactcttggccccagggtcacaagctgggagattgaaaaagctcaattattgctacgcccgcacccctatttttctcaacatgtaagtcaccaatggggaagaatttaaaccatccatctaagtgatgctgtgtatgggaatgttacagatattgggctgtcttgcttgtgtcccaaatttagtatcagcaatacttcactctcatcttagggcagaaaggggagtcagatgccatgagtgcacgaacaatacacctgcctccatcttttcagcatcctgagattcctatttgccatcaatctgcaccttacctcggtttagtatccagttcattttctttctcatatcacagtttgatctgggctctgagattccagaaacattttccttatgtgacaaatttttgccttaaaatttgataccttcttatacatgctcctttatgtttatatgtgcttcaaacaagataaacaaatactcagttcatattttaatctggggaggagagaggcatgttagtattggaaggagtcatttttatttatacattttctgtgttgccatacatattatttaccaacaataaattgtgttatttttgttggttaaaaatatttagaggaaaggaaataactaaaataaaaacacatacagaataatgtgaacattttatatatttttaaaatttcaactttgattttaggttcaggggatacatgtgcaagtttgtcacatgggtatattgcacgacactgagggttagggtatgaatgattccatcacccaggtagggagcatagaacccaataggtagttttcgatgatttaatattaaatggaaacaatctaaaactgcatgtgattagacatatttttaaatggtaaagttagaatagcatgctagaagttagaatagcaagctagacgagcaagcattaaaattttaataatattattagatggtaaggttaaagatataaatttcataaaaatgttggcatattacctggtatagggtgacttttgatttattttgtcatttttactcatattaaataccatgtgtgctaagtttttctgatttttgtactttccttacacatgctagtgtactgtgaaatagaactccataattagtattgtaatggtaggattgacaaacctaacaccgattaaattgatcacgacattagaataccattctctggaatttctggtttatttctaagcatcataattacttttccctgttttctaactaggtcaccatgctgtcagtaatattttcagtgttacagctacccaggttttataataattgccttcatctccactgcagctttataaagaaagtgataccattatcccaattatattttacaaatagggtaaatgaagatcaggaaagttaaataactttcataaagacgcacagcttatagagtacattgttgtcatttgaaccaaggccacctgattccaggttctatgatatcaatattctgtgattacatccataagttaattcatagaaaaatgaagttcttctaaatttgctttctgtaatataattactatgaagtttataattcaaattactgttttctaaaatgctaataatcaaaatattttgtaaagtattcggttattggatgtttcaggcttggaaatgtatttagttgttctaaatgaaataatggaaaggaacttaagtgtttagtttttctgaatatcataaaaattttaaaaataattttaaaatatcacaacagactaattttgagttactttttattttatctaaaatatgataaattttaaattatttagcatattaagaaatcttcataatatccctgtactgagtttattttaaatagtttagttgaactagaatacaagtaaaattttacctggttgaaatattatttttttgattgacccctttaagcctaagcaactgtgcactttaaattttccagataacagatattttgctctcttctgaaggtaacaaaggtaatgaaagtttttacatctgaaacctgtcacggcacagcccaatttaaccataaattgtatgtatttatgtaatcagagtaagactgtcatctagctggcacttacctagaaagtaccatatgtactttcacaaagtgcctagaacttactataatcatttttattgacctggtaaattgacaatagtagagtttttattgttcaccactgtttctactctgcacttttcctgccccatctccttttcttaaacaacaacaaattctgcagttactaggatactatcaccaaagcctatttgtccatcagatataaaactacaattatttgtgcataagtttctcttttgattttttcttattgactgcaggtacacagaattaaattcataataattctgggtttgtgaaacatgaacatcattggtccatgcatgacccattttactataattaattatttaattactagataccaaagtataattatgaattcagtaggtatgcagttctaaagtaagacaacgcccagaaattgtggttcggtgagataaacgatcaggcttttagtctgaaagtcaggctgtagcatctggttagtatgttgcaattaggaggaaataaaaaggtctacctaagtacgaagtatattaatttgccatcaagtataaattgtcaagtctcattaagcacgtagagtttttgtttgctccttgttgctctgtgacacaggagataagctcaaatgactttatagctaacagaggtttatttttccctccaaaggcagagcacatgtttggcactgagaagatctcaccttgtatccacagaggtttgcactagccaatggctgtggacactgttgtcaataattacaagcagtttatttgagtttacatttcatacagtgattattaggtcctgaggacagtacatttcacaattagctgaaagacagttgtagccttttgttctggcagaccctaaatacattgctaatcctttctgaaggaggaaaattaagtatgtatttaatgagttgatagctggaagtagataaatgactgacatatctaagcgtctatgtcaaagaatcgaaataaacacttgttaacttgatgcattagagtcaatatgttcttttcactatcattgtaaagggaaataattagaaaagaataaaagaagttatattagacacatgtaaaggtcttacagtatttcaaagagactattttttagagattattatccctcagatttgaattataatagcatgtgttgttcaagttcacatgccttgaaaaaaaataagatctctaatttataaacaggataaacactcatccccctcaagtgcttgagactatccttagcaaacagtgattgagttaaccctatggcttatactaagctgcatcacacataggaaggctgtgtaagtgctaagttaggtcttagttggtcttggacttagccctttagctggatgatcaatatctccaaatattttagccttagttcctttctgtaaaaaacagcaccaacaatacaagttccatctacttcacgaggttattattagaatcaagaagataataatggtgaagtattttgtaagatttgagtgctatataaatataaaacataatttaaattaaaaatcttgaaaggatctgtagtgtggcatatatgctgattattaaaacttcttaagttagtactgcatgccaagtactgcacaaattatatacatatatatatttttttaaaaaaagatgaatttttccaagcgtttatgattgggttttatcaaaaaaagtgttaaccatttctacttggaggaaattgagaatacaacgttgttaaacattttgccttagattatgattctcagacttctgctattccccttataccaggctgatgatgcattataaaaattataataaaaacaatcttttcaaaaagtcgtgtatatttttatagaattgaaggattaattgtcactaggtttttagaaaggaatgaataatcattaatatgtaaatgaacataatgactgtttcttgaataactaaatttgcgattccaaaaatatttttctgcttatacttttgcttgtttgtatactttaaaaaaatgtacaaagcatgttgactacatacatattatatcaaaaaagatattctattggagaaagagaaattcctaaaaataataccttgtattgtgtactacgtttattgaagtaagggaatatctgcctggatgaacacattctttgatgtatagaccacttgggttcatgcatttgatttaatttgctgggtagcaatttttttcccttattttcaatgtgtctttgtagaaaaatggggtgcctcaaagagaagaatcttctgagaatgagaaaaatatcccttgattaaatgcatttatgatgctctgaacccttgtcaaatcctccaatattgaaattttgaaataaattgtactgctgtatgaggccataattgcatgatggaattgcagacttttgcgaacattttatcctaggctttggtttgtcttctcattctcttgacaatgtcttctgcagagtaggggtttttaaatttaataaaactcagcttatcagttatttgtttcctggatcgtgccattggtgctgcatctaaaatgtcatcaccaaatccaaggccatctgtatttcatcttaggttgtcttctaggtgttctatagttttccatttcacatttaggtcaaggatccattctgggttaatttttataaagggtgtaaagtgtttgtctagattcattttttgtatgtaggtgtccagttattccagaaccatttattaaaaagactatgttatggtctatagttttgcttttgctactttttcaaagatcagttgactgtgttcatatgggtgtatttctgagctctctattctgtaccactaagctatttctccattcttttgccaataccagtctttattactgtagctttatattgagtctcaaagttgggttgtgtcccttccaactttgttcttcaatattaggttgcccattctgggaacttagcctctccatgtaaagttaggaatcattttgttgatatccacaaagtaatttcctggaatttttattgagattgcattgaatctatggataaagttgggaaaagttggtatcttggcaatatctatgaacatggaatatttctccatttatttagatcatctctgatttctttcatcagaattttgtggcttttatcatataagttgtatacatattttgttcgatttatacctatggtaaatttacacttgatcttagccaaaaggctgagaagcgatccctatggcaaatttaaatactgtatttttaatttcaactcctctgcactgatttgttatccttagctaactaaatctgaaatttaatgtagctttacttgatatgtgtccatctgtgagtctcaatactccacaaagtgtctaaaaccctggagtatcatatcacatacattatgtacaacttgcttatggcttccaagaaatcctcggtagcaatttttcaccatgctctgatcaaaaacataccagcttcagccaggcacggtggctcacgcatgtaatcccaccactttgggaggccgaggtgggcggatcacctgaggtcacgagttcaagaccagcctgaccaacatggagaaaccccatctctactaaaaatacaaaattaactgtgcctggtggcacatgcctgtagtcccaggtactctggaggctgaggcaggagaattgcttgaacctgggaggtggaggttgcggtgagctgagatcacaccattgcactttagcctgggcaacaagagtgaaactatctcaaaaaaaaaaaaccataattgtataaatttatggggaagcttgtgatgttttgatatatgtatacaatgtggaatgattaactgaagctaattaatagatcaatcacctcactcacctatcatttttatgctgaaacatttgaattttacttattttggaatatacaatcatttattatagtcatcctgctgtacaatagatctcaaaacctatttctcctgtctatctgaaacgttttaccctttgataaacagctctccatttctatcttttccctagcccttaagcctcttgtaaccatccttctactctacttccatgaattcaacaacttattctgctttcaggcatcaattttcttcttttaccatgggaaatagcaagcactgtgcttatcaaagatgtgcttaaagtttaggcttctagtgagacagaatatcagactctcaagctgaattgctggagttaaacttaggcatttgcttgaaatatcttcagtttgcattcatgcataataggtatagaattaagtgaattaataatgtcaagttattacaacaatgcctggcacatagtacattttcaataagtgttagaattctcttattttttatttatacatggtagttgtacatatttatggggtacatgtgatattttgatacatgtgtacaatgtttaatcatcaattcagggtatttagaatatccatcacctggagcatatataatttgagtttggaacatttgaaatcatttctactagctcttttgaaatttacaatatgttattgtttataatagtcattctactgtgctatcaataattagaatttccttctatctaactgtatgcttgtatccagtgaactacctctcttcatctcacctctccccatacccacatatgcccttcctagtccctggtaagtatcattctactctctacctcccttagctctcatgtatgagtgagaacatccaatatttgtctttctaggcctggtttatttcacttaacataatgacctctagctccatccatgctgtgcaaatgcaagatgtcatcctttttatggctagatagtattccattgcgtatgtacaccacatttcctttatccattcatctcttgctagacacttaggttgattccataactttgctattgtgaatagcactgcagtagacgtggggatacaggttcccctttgatatgctgaattccttttccttctataaatacctactagtgagatcgctggatcatatggtcattctatttttagtttcttgagaaatctctgtactattttccataatggatataatcatttgtattccccccaatagtgtataagagttcccttttctacacatcttcatcagcatctattttttgttgttgttattgttgttatctttttgataatggccattctaactaggtaagattatatctcattatgattatgatttgcattttcttgttaatgatgttgaatgtttttcatatacctactggccatttttttggttttcttttgataaatgtctattcagatcctttcccttttaatgtgattgttttctttttgctattaagttgtttaaattccttgtatattctggatactggtcccttgtcagattttatcccattcaacagattgtctccccactctgttaattgtttcctttactgtgcagaagcgttttagtttaatatagtcccatttgtctagttttgtttttgttgcctgtacttttgaggtcttagccataaaatatttgccttgaccaatgtccaggagtgattcccttatgtttcctttaagtggtttcatagtttcagttttacatatatttatttaatccattttggtttatttttgtgtatgataatagacgggtctagtttcatacttctgcatatggatgtccaattttcccagcaccatttgttgaagagggtgtactttctccaatgtatgttctggcacctttgttgaaagtcaattggctataaatatgttgatttatttctgggttatcaatattgttccattggtctatatgtgtgtttttataccaataccatgctgttttggttatcatagccttggaatatatttcgaagtcaggtctgtgatgtttccaactttgttcctttttctcgggtttgctttggctatccagggtcttcttttggttccatataaattttagtattccatttctgtgaaaaatgtcattggtattttgatagaaattatattgtaactgtagattgctttgggtggtataatcatttaaaaattaacttttcattcaatgagcatgaaatgtcgtccatttttttgtgtgtgttctcttcaatttctttcatcagtagatgtttttccttgtagaactcttttacctgcttggttaaatttattcccaaatattttttgtagctattataaataaatgctattgctttctttgatttattttttagctagtttgttattattgattttttgtgagttgattttatatccagcaaactgttagcaatttttgtagctatttgtcagatttggttaagattcttgttcttatttttttaatttttaaaaatattagacacaaaaattatttaagaaaaagccataacacaattgaaatattaacctctggtaagcacattcaattatgagagataaacatgtaatctcaagtaaaaatttacaccttgattaaggactccaaggtttaaatccattggaatggactttgttgctgacatttaattaacatttgtaacttttattatcttgttatatttaaataaacgtttagtttttttaattagatgcatattctataattgtttcctattgttaatcactataataggtaggtaacattgactcttaagatacaaaatatagaagaaacaacatgaatgaaatggtacctataaataaactcctttgaagataagaaatgccaataggaccaggtgcagtggctcatgcctgtaatcccagcactttgggaggccgaggcaggtggatcacttgaggtcaggagttcgagactagcctggccaacatggtgaaaccttgtctctaataaaaattaaaaattagccaggcatggtggtgtgtgcctgtaattgcagctccttgggaggctgaggcaggagaatcacttgaacctggaggtagaggttgcagtgagccgaaatcacaccactgcactccagcctgggtgacagtgagatttcatctaaaaaaaaaaaaaaaaaaaaaaaaagaaagaaagaaagaaaaaaagaaaagaaaggaatacctaaatacctatgttgtgacacctagatcttctgactcactttagctttacaaagtaagaaagtgtgttgctacttctaaaagtaataacacagtaatctgttgtcattgaagagtcatgaaaaccatgaatgtgttaagatgttttgaatgttacattttgtttggtctccaatatgtttaaaatttaacaataggtaagtggccgtctatctatgctggtataacaaagtatttgagatagagtaatatataaatgatagaagtttgtttctcacagttttagagtctggaaagtccatgattagggaaccagcaagttctgtgtctgttgagggcccactctttgcttccaagatggcaccttgaaagttgtgtactcacacagtgaaaaagagagagaagcaaaagggtctagtttgttccttccaactatatcacaaggtcactaattccattcatgagagctctgcctcatgaatcacctcctaaaggacacacctgttaatactaccacatacgggtctaaattccaacatacaaattttgaagagacacatatagcagcatcagtttattctcaatctaagaatagtcattatgtgcccttagcccgaattgtgagtagactttgtgttgtatgtggattgttgcttgtaggtgtgggccaccccagtaataggtttttgcaggtgctagtattattaaagatgagaaagtcctctagagagctcttatagttctagcagttggttccctagaagtggctgttataggtaaagtgttttatagaaccttagagataatcagataacactacaaataatgcctgctgagtatgcagtaggttagagagtatcagcactcttttaaaaatcagtttggcttctggtctctcaagcctataaaatctacttatgtagttgcaataattgtgtttttctgtataaatctctgcaaagttaaagtcattactgtttatgtttacgaccctaagcaatattccactttattttaccaaataaacttcacagtgttcacctagaaaatagctacatagtgacagtgattatttctaaatatactttagtaaaatacaggctttttctttatgcatgaagggaatcactccctgtctaattttttaaaaagctctattttcctgtgtaattaattatattgtatatagtgggcactagcatgtttttgcgtggaggaatgttatatatactgtcttaaaatgagattcatttgaaataggaattacatatcccttaattcagtaccacagcatatattcctttcaatgtggttcctaaaatttgtgaaaaggcttaaaataacaccattaacaacagtagtcaaaactattttttacatatctctgaatctctgattctcaaaattgtgctcctgctctttccagaaatgtgataatatcttctagatggtgtctttcaatccatttaatttacatagtctcttctatttgatttagattgttggtcttgccagaaaggacagtgattaccatctttgcatgtatagtacaaaaaaaattattaatatactctgtctaaaaatggaataaattttcagttgacacaacagggaaaagaaaaaaatatttttccagcccaagaggtatgacagatccttttacaaatgttaacctaccagaaagatttctcctctggtagaatctgtgattgctcctgttcggaattttgactctcaacaaaattcatcgtatgattattaaaggcaatggatttaccagtgaatgctgttgctataagattatctcaaatgataaaaagaatatattccagatgctatttgcctggtttgtggtggtcgggggcagggtagggggcggtgtggggtggggctgagagtgggagaggtgggtggggatatagttaattcaaattggcaatatcaataagaactaaaaataatagtagacatctgggtttccagtcatacattttagatggttgtaaacacatttaatgaactcagcaataattaatatctaatatgttcaaaaccatgagctaaattatatcacagggttaaaatgtgtatgacatatacacatagagtttataatatatttcatccatgcacttaataagaaaaataatatacctaatatgcataagtggagagatatacaccagaagtattttacttttttttgtataatatttccttaattaaaagccaaatccatatatttaaatttcataaatgaaaccctagtctgaagaagctactttgtggctcgtttttagagctgtataatatatttaagcactacagtttgaagcattttaaataataatatagtactgtaagaataatttatgtatgaagttcattttgaaactctttggtgacaactctattggaccaaaattgatatcaacaaaccaagcaaagttgtatttttaatatgaagaaaggataaatgaacttaaatataagcaggagacttcacacctttctccactttgctggggtgaacatccctggttatcaagtctgcattaagatatcccaatgcaagagggtatctgtctctgttcagggtggatctctcttcagctggggattctggtttcttattctgctgagaggtctagagctgatatgggtattctatcttcttattttaataccgatatttgtaaattaaaagccagccatatcagtgtgtgagtgtaatttactgtttgaatactactttctgtctcatcagcgttgaagttaataagacatacattgaatatttctgcaaaaataaaacagcctgcatagaattggccaatctctggaatctgacctctcctgagtattaaccctacagactgtctcattatttgtattgtaatggtatcaaatttgtagaagaaatttctgacataaattctcaaaaagataactggccaaacactgttacctgagtgcataaaatatacactccagttgaatcatagatccatgcagtcattctggccccaatgcaagctatcacaggatttgcttgcaaaatcaaggagtcaaagagaatatgcataaaatatggaagtcattcctgagagtatatatatgggccataacaaacaccaaagcttatataacatcataacttgattatgtatatgctggtgatacccaaaggctaggtcataatactgaaggaaagatacctgtagaatcacaactgctcctgagtacaaggtaaatatcaaccaaggctgttatatgtcatttgtgaattaaaacactctccagcaatgttgatccacaagaaactgttgagaccaacatgcttacttcaacattaaaattatatcagataaaatactagaggctgtgtcatatatccaaaggaaccagcaaatgcatctgggaaggaacttatgtaaagcactagtaatcaaagtccaaattcagcttcagagaagttatcagattgctggaaaattgcctgagaatgtggaagtattcaaaagggagatgtaaaacgtccttggataaactcaatgtacctgaaaacatttccactgaagaaaaatagtctagggcatgaatttctaacttatccatgtattctgaataataactaagctaatattttaaaattacctcttatatgccaaatactgtgcttagtaccttagtgcatctcatttaaatttcttaaaaatcatattcatagtttctatcaccatttttaaaataaagatgggaatctcaagatcagagagcctaaataactgccaaaagttactcagctaaaaagaagtagttctgagcctggaatccttgttggcataactctaatggttaaacattctaaaaaactaaggtagacttattctccgaagtttgaaaatcttctatgttatactatttatgctaacattaaaatctagtgcaaagtctaaggcctaagtggagacaacaaatgtctagtgaactaagacgtagtggtatagttatacctatagtcaaccatctccttactattatttctggagtaagatcttagcaaactttaaccttgactaagcttaaacattagcttttattagagaaaaagcatccataatttttaatttctacatttcttagaattttccaaagttttagggaaattctgctttctatagctaaggggaagggagaagtggaaactcactcatggatatcatgatagactattgcatcaataggaataagatttattttaccaatgagaaattacattctaagtcagtatttgcaataatgcattgctagatgctatcatttatgacattgcatctacagtcatagcagttgaatttaaggaatgtgtaaaaaggaactttatcttatctagacatacagtaggcattttcactgtatcatttttgtttgctgcctaatgcaactccaaacattcaagttggtaggaagaaattcaccattgcatctattgtagcacgtttatttttatcttagaagaattcaagaaatttcaggggattgattatgggatttaagacctttcactttagggccagtcttccaaagctgcatcagtaatgactgaaagttgtgcatctctgtggccagtatagtagcctacatgaaatcacttagcgatcttaactcctgagggagctgtcatgattgacagtttgaacaaagaggacaagaatagaatggacctattaactaggactgagtgaatttctcctgtgggcatgacaatgtttacctcctgcaatttagctctttgtgacagagagttttaaaatggagaaagatgttttattcagtggaggaataagagggatacagcagagtttgattccagtgaatatacaagaacagtcttcttattctttctacattgctgtcttcatatactacatcaattataaatgaatataatgatgcttttgccttgactctccagatttgctttgttcaagttcattaatgtgaactgtcataccatttattattaagtaacagaagaaggtgaatatacagttatatgtcatatactctattttacatattttagggaaatttagctggagtttgtagatttgcggatcttataatttaagaaaaatgataacagtttctgggcattctcaggatactttttaaacggccatcctctctcttaatatgaatcatataaatcacaaagtcttagcagtttgtagctattctcaacatgacataaataggtttggcagtaaataagtccctcattgtagactccttgggttctgtagtgattggtgtcttctctaagtaacttagaacactatttgaaaataatccagatcccagaggaaacaaaagaagtgaaacccttccctcactgctgtaagtgaatgagtatttcataatcacttagaccaatggcagatataccctaagtgttttgtgcttattaaatataaactaagcatttcagaattatttttgagatagttttaatggcttctagaccttcttttaaaatgagaaatctcctaaatggaaccccttttagcaatgtctacaacaggcactaaaacaaggggatgatatgaataaagaattaaagtgtcactgatttcttcttctccactttagtctgacttcccagtctcagcccagtaagggatctttccaaatgggttttgatttttacaggatgttgctgaccagtcaccaaacaatgtaatggagtcccatggtcctcggccctctgccaaatatgattcaaatagcaatcagtgacacagggttgcatctgtgcttggtgcacaaaccctgatagtgtagacatagcaccagtcacaacatcaccaatcactaaaggaagcttgtttattaattgcttcatttctcaagatccttatatcacaagtgggtactgaccttgactgatctatttcccgcagtaaaacaaaacaaaaagtctaattattgttcatttgacttttctatataactcaaaactatcttcttactaggtcatcttgatgagcggaaagttatggaagcataattgcggtcagtgtatttagacaatatgtatgatttaagctttgttttgcagaggaaaaatgcttttcagattatcacatgtgctacatttcctagaattatatcagtttggtcacattccagagaatatggagagaatatgaatgtactttaggagaatctcttgaaatgaatacttcttagtgataccaccgtatgatcttacttctttaagtctcttttatttttaaaattgatatttaacttttcttctttgtaaaaatttcatcggaatattttatgtgatcttagtgattggatacatagacattctttagataggggtccctaatccctgggctccagacaggtatcggtctgtcacctgttaagaacagggctgcacagcaggaggtgagtggccggtgaggcaccattactgcctgaactctgcctcctgtcagatcaacagtagcattagatcctcatagaagtgtgaaccctattgtgaactatgcatgtgagggatctatgttgcgtgctccttacgagaatctaactaatgcttgatgatctgaggtggaatggtttcatcctgaaaccacctcaccatctctcacccttgtcccaccacctgcatcctatggaaaaattgtcttccatgaaatcagtccctggtgccaaacagtttggggaccactggtttacacgagccctcacagaataaatatagcaacaatcacattgcctcttatggctcagagggagcttattccatttccccaaagcttcaaaacgaaaagtgggttcttactgttggataatatgaactgctgtggattgaaatatgtctcctcaaaattcatatattgaagccctaacccctaatgttatgatatttgaaggtggggcctttggtagataatttggtttagatgaggtcatgagcgtgaagatcccataataggaattgtgcccttataagaagtggaagagaggccagagctctttctctcttacatgtcagacacagtgataaggcagttatctgcaagtcagaaagagagctgtcaccagaacccaaattggctgtcagcttgatctgggacttcccaacctcaggaactgtgagaaataaatttctgttatttaagctactcagtatggcatttttaaaaatggtaatctgaacagactaatacatcaacatagaaaggagttccattggttatttgttccattggttatttattctctatttttggcctgacccagccagttgtgttgtttcatctgcatgaatgtgtttaacccccttatgaaccaaggtgatggttccttatagaatagaaccctctgccaaattacatttggatcttcagcacttcattaaatgttccccaagagatagtttaccacttattattactctttgtttacaaaatgtcagtcatttaatttatatttaacaaataattgtttaacatggaagtttattaatattccaaattctcaactaagttttaaatattgacttaccaatatccattgatttccaattttgtagttaaaataaccaataagaaattattaactttttataactatagttgtaacattatctacaattatatatttatttttgctttccaattacttaatctcaatctccagatgaaaacacctctttcttagtacctaattgttctattcaaacctagtctctcctattaagatatcttagctaacattatttgctctaacaaaaattaatgcattcccattattctacagtaatttcatttttatgttgcttacgataattttaataaattttgatgagctgttgaaggaaatactatcatttgcctaatttttaaaatatttctagattccatttagtggtattttaagctatttttatttataaaatctcttacattaatcagtttactgtgaaatttatcatgtgacctctattttcagcgggttcttaataaaatattttatatctttaatgctttatacacaaaatgatagaaaggaaattttttttttttttttttgagatggagtctcgctctgtcgcccaggctggagtgcagtggcgggatctcggctcactgcaagctccgccttccaggttcacgtcattctcctgcctcagcctcccaagtagctgggactacaggcgcccgccactacgcccggctaattttttgtatttttagtagagacggggtttcaccgttttagccgggatagtctcgatctcctgacctcgtgatccgcccgcctcggcctcccaaagtgctgggattacaggcgtgagccaccgcgcccggcctagaaaggaaaatttttataatattgtttaattcaaatatcactcactttaagagattttctctgatatttttcaactggatatgatcactttctctttcaaaagtgacaactttagtttgtatttattgcagcattttccatggtttatcttaaagtactcacttgagtaatagctctagacttcagcagattataacttttagtgtatgatccattctttcttagtcatttttgcctccctttcatcctttcctgggtttttgaatagtgtatatattaatattgctggtggactctcatgaatacttgatgtattattccattctcatgctgctaataaagacatacccgagactggttaatttataaaagaaagaagttccatggatacacagttccacataaacagggggcctcacaatcatgacagaaggctaatgaggagcaaaggcacatcttacatggtggcaggcaagaagccaaagttgcttccacattttgggtatctttacagcagcaccccactcccagtaccaatttactgtattagtccattctcgtgctgctaataaagacatacctgagactggaattgataaaggaaaggggtttaatggactcgcagttccacatggctggggaggcctcacaatcatggcggaaggtgaatgaagagcaaaggcatgacatatggcagcaggcaagagggcatgtgcagcgaaacttccctttataaaaccatcagctctcatgagacttattcacactcatgagacttattcatgagaacagcatggggaaaaaaaaacccactcccatgattcaattacctcccactgggtccctcccataatacatacagattattacaattcaaggtgagatttgggtggggacacaaggacaatccatatcacctgggtgttttttgatatttctgttgttgttttttatttttttatttttttattttttttattatactttaagttttagggtacatgtgcacattgtgcaggttagttacatatgtatacatgtgccatgctggtgtgctgcacccactaactcatcatctagcattaggtatatctcccaatgctatccctcccccctccccccaccccaccacagtccccagagtgtgatattccccttcctgtgtccatgtgatctcattgttcaattcccacctgtgagttagaatatgcggtgtttggttttttgttcttgcgatagtttactgagaatgatgctttccaatttcatccatgtccctacaaaggacatgaactcatcattttttatggctgcatagtattccatgttgtatatgtgccacattttcttaatccagtctatcattgttggacatttgggttggttctaagtctttgctattgtgaataatgctgcaataaacatacatgtgcatgtgtctttatagcagcatgatttatagttctttgggtatatacccagtaatgggatggctgggtcaaatggtatttctagttctagatccctgaggaatcgccacactgacttccacaatggttgaactagtttacagtcccaccaacagtgtaaaagtgttccagagtgaacaggcaacctacaaaatgggagaaaatttttgcaacctactcatctgacaaagggctaatatccagaatctacaatgaactcaaacagatttacaagaaaaaaacaaacaaccccatcaaaaagtgggcgaaggacatgaacagacatttctcaaaagaagacatttatgcagccaaaaaacacatgaaaaaatgctcatcatccctggccatcagagaaatgcaaatcaaaaccacaaagagataccatctcacaccagttagaatggcaatcattaaaaagtcaggaaacaacaggtgctggagaggatgtggagaaataggaacacttttacactgttttttattttttatacaatgtaagtgtcttagtgactctatcatttagatggaaattcaagaccactaaatcagcagaatggtagagtttactagctggtgattttgtctgctccaaaaaaatattttatctaaagcacatttttgagctgcctttaatttataataaatgtatcatatatggatccaaaggtaaaaatctctctcaaatagaaattaaaaggctttatttattctgatcacatttctttataattttacagagcatttaccacctcagcctgatatttccggaatgaacccttaatcttttaaattagttatcatatgacagatacttgaactttttattcttctgaaatacagctacactattgtatctttcctaagttttcaggaccaaaaacagccgttctctaggtttgaatgaaacataaatagctagatgtatttctgatttacttttatcctatatgtctagaaggcaagatccctgttagcctttcggggtagagcaattcattaaaatacggcctcaattttaactaagtaaaattaaaaatacagtgtcttaatcatactagccagatttgaagggttcaaaagtcacatgtggttattgactaactttttggatagtatagatatcaaatgtttccaccatcatagaaaattctttggaacaacagcaacagtagtttacagtttatcttttattttacaggagttttcatagatagacactttacatgagctccatccaaacttctaaattaaaaacagacagtttgtttgcactgaaaaattcattttcccttgtcatttgttttttagttgtaacatttctttgactgttatacaccatttttgtgtcaaaatatagatattttttccaatgcctgacagctctctattttttctttttatcacttgtttttagtaattttattatgatgtgtctggtgtggttatatacatatttattctgcttgaggttcattgagattcttagatctgtgggattatcatttttatcaaatttggaatattttggccattaattttcttgaatatttttctactagctccttggagactccagatttatatatgtttaacggcttgacagagttaaatattaactcactgaggctctgtatattttttcaatgttttatccctatactacattttacatattctctatttctacaacttcaaattcacaaattcgttcttctgcagtttcatcaccattcagtgatttaaaaaaaagttttagatattacagtttttatctttaaaagtcccatttgattcattttttaacatctttaatgtctcttctggtcatgggtcatatttcaattcttaagatctgtaggagtttttgtgtgatggtgaaaatagtgtattttatgtgattgaatgacttctattttctcttttcttttttcttttttttttttttttttttttgagacagagcctcactttgtcactagaatgcagtggggcactttctgctcactgcaacctctgactcccaacttcaagcaattcttctgcctcagccttccgagtagctgggatttacaggtgtgcaccaccacacttggctaatttttttgtatttttagtggagatggggtttcaccatgttggccaggctagtctcaaactcctgacctcaagccatctgcccacctcagcctcccaaagtgcagggattacaggcgtgaactaccacacctggcccaattattgtttttaaagaagtgttatacttttctttgacagacatttgggttgtttctggtttagttggatcatcttaagccttgttttcaacttttgctagggtggtcacagaatacctttacctattggaatctttaatctccattactaaggctcacccttctgatgcctaaatttaattctccaggtagtcaatttggactctgcactgctgctggtaggaacttgaatgattcttggccttctgcagttcttggaatcattcagttcacaagtttgcaataacttcttgcccagcctcgtgaaattatagcgtttgcatacatgacttagaaatcagcataggttcaaaggactttaaagcagatttctagagttctttgtctgcatagctctcttgtctcaagaaacctgtcacacaaattccaactgccccagatgctctgaactctgatctgtatctcctcaactcagtagggtcactgtctcagtttgcaatatcttccccactccacggacactgctctagacctgaaatatgttttacaggcagaaagcttggctgtcctatgttttactttccttgtctcttctttctcagatgtaatggctctgtactgcctgtagtttaatgtcttaaaaacagttgcttcatctatatttccctggttttctatttctttgagtcaggagggttaatttagtcactgttactccatcgtggctgaaagtggaagtctttcttcaactgatgtaaaagtttatgtaatagaaaagatattaaactatgaattgaggcctaacttttagagaatgttgaaatgacagaatacaatactacaacaaaacttactcttataaacactgatagaaactgacaagtcggtggttgtgaagaaaattagatatatagatatgtatagattttaaggtaagtaagagttattaattagaattacacagttgtcagtttggaggtacaggtatgagtgtcatctacacagaataaaagaacagagcagagtccaagatagcatgttgacattcacagtgaggattcagagtacagctgtaccctcgaattaaatttgaccaagggttatcaatggcagaccaccgggctctgtaaaccacaggtctgatctaatctagcaattcttgtgtttgcattttaaccaatgtatatctgtccaggaaataaaatgtcaactataagaattgtttacccttgaaaataactctatggtgtttctaaaaatatatgtcacatgagatcacaaacaaagtagtatgctttctgtggattgtattactggtgttggcttggaatggtaagaaaggaaactgactctaaattacctatcttgatttttcttgtttcattaattctcagagcatttgtcttgagatatacaatatctcaaattgcaagataaaaaaatatatatcaacttttctttcttcaactctactttgaataattcataaaggaaccacttaaaggtagctaatctgaatcaatacaaggcagtgttataatctttgtttctaatggtgttttactcttaatttttatgtaaataactgaatgtattgtttattaaactgatcttcattataaggagatatttataatgttggctgtccaatatgaagtaaagctttaaaaatcccagatgtaatattgaacaacttaatttgaaacattttatgctacttggttgctcttgatttcaggagtatctgttttaaatgcataataagtacattttcaagcatatccaatttacatgccttaaagacttccaccgccttaatgcttaatttagaaatatcattttaaatgattcttaaaaatcagatgcacttatttttgtagctgtaatattttaagagagccttcatataaaaatatagttgtcactgacaaactgtatcaattagctaatgttcaacaatgatcatcaatgtcagggactgttaccttgttgaaattttagtttagccttaatggtgtctataaattaataggtactgtaaatgatgcatgacaaaaaatgggttgttagcaaatgttgtggaaggaagaaaggaaggaaagaagggaaggaaggaaggaaggaattttcaaggccttaagaataaatctatatgtgctggaatacttagaaataaaagttttgtttaatttaattaaacacagatattctaccaagctcacaaaatgatttttaaaaatactagcaatcattaggcaacataggagcctttagttaagtgaattagaaagtgaagttaagaataaaatttcaacagttacctaatctactaatttgctgatcattgatgaacactggctcttatgttttgttttgttttgtgtttttatgaagctgacatgtactattggttcaaataaatagcatatatagtattctggctaagtcgcttatttttaaaattgtggttttcttatgttaaatttttgaattgaatttctaataccatttttccttttccacagcctttaatggaacaaattgttagtttctgacagaagggttctgatgttgaaatagacagtatgtctacctattacagaaatatagaaataaaaatgcatgtactcaaacagaagatggaggttacatttctttattacatctatcatcagaccttagccatgttggatttttggttgctgttgatagaataaggcagattttcctcaaactttcttttgcaaaatagttagacttaaatataaaaacaactgcaaaatattcagtcattaacaaatcaagaatctttataactgaatgttaagtgattatgttttttctactgtatttagcaatgcaatacttaccttttatattactaaatatattaattttattctcaagaaaatcattaatacttagggattggaggtttcctgagtgtaatattgaaaaactgttaaaaagccactgatacccattcgatctaatgatttaccttttgattatttgttttgtttgtttgtttgtttgtttaaggattaaagcaaggagagccaatcatgactggcaaaacacagaccagcaacgtcaccaataagaatgaccccaagtccatcaactcccgtgttttcatcggcaatctaaatacggcaattgtcaagaaagttgacattgaagccattttttcaaagtatggaaaaatagttggatgttccgttcacaaaggttatgcatttgtacagtacatgagtgagcgacatgcaagagctgcagtggctggagaaaatgccagagtcatcgccggccaaccacttggtaagtcatgctcagacatggatctcacgttattgttcatatatctggaaattgttttatttcacaaaacccaacaccactgttgtttctacctcttctttaaccaattagagtgattttatatttattatttatattttttcatcctcatattgttttgtatataggtatcttattttctgtacaaatttataaatttgagatcaaggctactttgcaatacttattacctccacccatcctaacacagccaggcaaataataaatatgcatcaggtttaactttatttgacttgagatagcatctgtcttccaggaaacactatcctatgcaaaaaataacttcacttgtcatacttatagcatttgatctgagcctaatgcattttcctcatttcctatgttttggaggagaaggggtagaaaatagcgaaagaaagtaaatttttagaatggggaaaggaatataattcacattttaaaaatctagttaaggattttgtgtattatacctgtataatcatgcataataatcagatttctgtctaatgttcaagaaataatatagtttttttcaaagaaaggaaaacaatgcagtctgaaataaaaagacttggaaaaatattttataattaatgtgtagataaaaatcaaaattagataattatttagatgtttttctaccttaggaaaaaaatatggttaatatattaatgattcctcaatttatgtttcttgttctgtctagattaatatatcaaactcattgtacagcatcttctcatggatactcaaaaggcatttcagcttcatatgcccagaacaaaacccatgattttccataccctcaaccttctccactcccaaatttcctcatcacaataaagggaacccccaatttatccagtttaaaaaaaaaaaaaaactttgattcttaacttcccccatcatcaagttcgcttgtcaatatattacaaatatagtccaaacccaatctccttttaaatgtgtgctgaaggccatctcatacagcccatggttgtatctcaggggcactgaaataactccctagttggtccgcttctttttactcttgccagagtgtcttttaaaaacattgatcagattatgttcttaacctgcttttaaacctctaatgcctttctcatacagaataagattcacattctataccatacctacaatgccctatactgccacatcttcaattctatctccttattctctctcccttcttgaaccactctagtaatgctggctgccttgataatgcctcaagcattccaagattgttcctacttcagaggctttgtatttgctattccctctgctcagacaacaggtctttgctaattatttgctcctttctttagagtgtgctgtgctaaaaatttacctccagtgagaggcctttactgaccagcctatctaaaatagaatagtcatcttcctccttctttcactgtctattctattactgtgtgttaatttttttcatagcacctatcagaatctggattacatagttcaatttataatcttacctgtgtcatgaccacaaatataaagatgaagaagcatacaaaagaagcaagttaaaagtatagagaaatcaagctaggagagtgttaagaatattgtgaatattatcaaatgatataacacaattaaaactatttgggaaggtatgaattcattaaaatgtaggagaagtcagagggaatagtcttgagggaaaaaagcaaaagatgttttgggtaagtgcctgatatttaactgcaaacaaatcactatcagataggaatatagtttttatttacattggtcccatcgaactttctatattttaaagaaaggaaagaaaggaagtgctttccaacagacattggtatattttccacttgtctttttgttttccttaatgtctccattctgcttgcttactttgatatgggaattttctgacatttgtgttttcctttttaagttgaaagtcttaattcagggccatatcccagcagatttcagggcaagctctatttactgtctgtatcctgattgttatgaaactaacaaatacttgaggaaatgcatttaattatttttgttgtttgaaaaattaattatcagtttaagatcaattaaaagcctgattcactttttaatgagctacagctaattttctggagttctgtttcctatcactactcagttgattgctgtctttttgagaagaatgcaatgggcaaagataaataccacactaaaaatgtagtgccttacatgcacaaacccaaggaaaaaaatgatgacaccaaattgctttgctttgagaggcacaaagttaaattgtacctcttctaagataccatttctcattctcagtcattcctcttagatcctctcttagttttgtcctcaggtaaatctttagagcatatatcctaatcatctataatcacactttgtgcctgaaaccaagtcttagactttatttctttagttcaaatctcgtctttcactacctctgtccaagctgaatgacttcatacaaagcaagtacattaaaatttatctaacaactttgcttttcaggtcaagtgcttgaatatacccagcggtttttttgtttgtttgtttgttttttactatgttgctagaaactcaggcaaagacatgacttccaattgttccctatagaagttagttcatccatcaggtcccgaagaagaccctcagtttgtaggatgtatatacatttctagctttaagtattatacctttgtttttgatgatttgagcaaaacttaggttcaagtatattaatcacttgcttcttgagttttttgattcccaagtaaactctttctaatctgccctccaacaaaccccggccagttcttaatatgaagtgcatttttatggatgaaataataggctattattatatgaagttattattagtgtcaggtaccacgacctatctaagcattctcctttctcttaagagtgagaaggaaattaatattgattagatcatgcactgcattagtactttacctttattaccttatttgatctcaaataatgcatatttgtacatcattttctgaaaaggaacaatcttttatttactgcatgtttaaaatatttatatatgatttagagattaaaaattaaacatcagtagtaccaggaaaaattaaacactctaatgtcagttcttaaagttttatgaagactatagataacttggccataatttaatttactttcttatacatttccagttgtttggcacgtctttcgcaccatgatagagggtatccatgtttattcttagcttctgtctttgatatataatagaagactgctaaaacctctgtggaaaaacaaaaaagattgcattttgactcatattacttagggattcctaaaatgtcagaatctatctatgaaattattcattattcagaatttttttaaatcacaattcctataatgtaaaaatcctcataaaactttacgtctatatttggttatttaattgattttaatacaatttaaatataagcaggtgaaatttaacatatcctcttaatatttaattgagtttgaattctaagtttgttaatattggaaatatttattgcatttttcaatctaagtgtagtcattagaacttttttcctcaaacacattatatgcgagataaaaacattttaaatgcttaatagagacaatttttatgagtagtcacatacgaagtgtccttttacacaaaatgttatgcagaggttagagactaagactagacagtgccaattttatgtatctattgattacattggcttgattacagacatgctataaataaacatttgcaatgtctttctttatattcggattattttactgttacaatgcttgtaaaagatacaatttatgaacttgagaagccagctgtggatagtaggaggaaccaaacactgaaaaataatttatctagagcaatcatttttgttctgaaacccatatgcaggcccctgtccttaagaagcaaagtgtgctttaggaaaagaatatataaagcagagaattaaattaattgtatcacattgtaagtgtcttgcaaatgcagaaagaattcaaagtgggaacatgatgaatagggatggtaaattttaaagtaaatatggtgaatatacttaactagatcctgaaggaagtaatggaattgtcttagtagagaggaagatgtttgagagagatataagaacaaagaagagaacattcaaatgcttgtaacaattcccgtcaagcatgtgctgagagcaatggatttcaaatgtcttttcatccccaactgttttgcatccagagtgatcttttcaaaatgcaaatctaatcatgtcactgtcttttaaaactttcagggatttctcattgttctcagaaaaaagaatgaaacctttgctgtgggctacaagtttctacctcatttgtttctttgtcacctgcagactcacatcatagccccatcagccttgcttagagctacaactacattcacttctttcagttctttgaacaacttgtgttctatcgcccaacagggcctgtgcacatgctatcttgactgctcagaaagttcttccctatgaagctctgcaccacctcaccctacttccccacttaatcccttttgcctggctaatcattcttcagatctcaaatgaaatttcagtactttagtgaaacctacttgtgtccctcaaagctagctggagtgttttacttcactttctagcaagtatcttcttttcaattgtatttttatatttattattttgtaattgatatctgtcccttctccctctaagctataagttttttagggcacggaatatatatgtttttactcatcttcttagcacctaacaaaatgctaacacttccatggcaaatgctcagtgaggatgtactggatgaatgattggatagatggttagtaggaggaatggatggacttggctaaaggggtccctcacatggaaaagagcaccacaggaagaagacaaagaagcaggaggaggagaaataagaagagaacagggagaagaaggaaggagaagtggcaattacaagttccccagaaagtgaggcgatatagttggggttgctgctaagcgaaggcaaagtgatcatgatcagcttgctaaggagactaggtatttaatcttgaaattcttcaacagacattccaaaggtaactgtttcgtaggcctgatttcagttttttataaatataatccaatctttaataagcatgaaatattaacacatatatactttattcaaaagttagagtgaaggatatattggtttgaagaaagatttctattcatgaaaaacttcctacacattccttaaaatgtcatcctttcatagttttctcttattaatagctggatatttgcatggcacttcatcattgtcaaagttctttcatgcacatattatcttctttgattttcacaacaatgccaataaataatattagtatttacgcccattctgctggttaggagccaaagcacagagaaatgaacttagtctatatcacacaaatggtggtgcaagattgttggctcacattttctgaccgtaattatttttactatttctctttccagaaatttattccatttcagcagagtgatcatcaactctgtcatccaaacagtaatacttttgagagtaaaaagttactctcattgattttgctttgtttgtggagcctgtcctgtgcatggtaggatgttagtagcatccctgcctttttttttttttttgagacggagtctcgctctgtcgcccaggctggagtgcagtggcgctgtctcggctcactgcaagctccgcctcctgggttcacgccattctcctgcctcagcctcctgagtagctggagctacaggtgcctgccaccacgcccggctaattattttattttattttattttattttattttattttattttttgtatttttagtagagatgggtttttcaccgtgttagccaggacggtcttgatctcctggcctcgtgatccgcccacctcggcctcccaaagtgctggattacaggcgtgagccaccgcgcccggccgcatccctgacttctacctgcaagatacctatagtaccccttccaaatagtgacagccaaaaattgtctccatgttaccaaatgtctcctgggaggcaaaatcactccagttaagaattactgttgtagggtaatcataccaaaataaactccattaattttcagaattgttctaatggtcttaggataaactatattaaaacaatgctttgaattattttgacagtaactcataatttataataagaatgtatcttttccaattgttcaggaaataaaactcagtaagtgcgtttcagggcaattttaatgtattcatgaccatagcttacccacttatatcaccagtttgttacaaagccttctgtctcttcacatctttaatacactgacttttagaggtgtgatttttctccgttagatccctccattcaaacatgtctaatcgccactagaaatgatgaagaaaaagaaagtatcatggaagagttaagtgaaaaatacggagtaccaagattactcagaggctcaggacgatcttcaaatatatattattcaacaacaacactaaaaacttgttaagacaaatacagaattgtagtatccctagttgatgttgtctctaacaaatacattagttttaccaagcatccatcctatttcactttggtaagtattattcttctgcatatgcctccagcttcaaattagatggagtatctgagcatctagcaaggacagattgacagacagcctggggtgaaatgagtatggataatcatttttgacaaagtagtctatcacagaacccctaaagaagcacatgaaccttatggagatttctaagtcatgaaaaatcttgtagaaaacatccaaagaatgctgcaggtaataaatagcactttcagcaatgcaccattatgtaattctattaccatttggactgagaaaaaagaagataatttttagcttttgcctcagtgtctaaagaagatattgttatcataatttcttaacttgataggttaacaaaacttccactctcgaagatacaaatcaaaagttagtgcttcagctactttaaatattcgctgcaataagcatacaaaaatatttgaatatgtaaatcttggaatttttcttaacaacctttgaaactattcatcattctagctttttccactaactaaacgttcaactcattcctatattttaaacatccaattttcctaccatattttatgttatacagattatgcaaagtagttcatcaattgcagaatgctatgtagagatggctactatatttgttttaaaaactctattcagggtgtatacgtgcacatgtaccctagaacttaaagtataataaataaatatatatattaaaaaaaaaaaaaaaaactctattcacgggccgggcgcagtggctcacacctataatctcagcactttgagaggccgagacaagctgatcgcttgagcccagcagtttcagacctgcttgggcaacatggcaaaaccccatctctgcaaaaaatacaaaaattagctgggcttggtggcatgcacctgtgatcttagctattcaggaagctgaggtgggagaatcacctgagcccgggaaattgaggtagcgggctacagtgagctgtgatcatgccactgcactccagcctcagtgaaagtgaaatcctgtctcaaaaaaaaaaaaaaaaagtctgttcacaaggctgtggagggacttaaatggtatacaaatgagtgggagtgtgaaaaattacttacgagatggtattcagtacaaatcacttttgtttcatcttttctgagattcatagaaatatattgccatcctgtatcagtggcttgtagtaatgttttttatttatatatcattttttcctcatcaaccttctcaaagaagatcaaggtacacttcattacatttttaaaaaattatctttccagcatccttcaaggaagttagatagtagatttaattaaactcattttacaaataaggggaattctataatgtacttaaagagagcaggttttatgaaaacaaaaatctcagaaatttcttccaatattgtgcataattactgtaagtttccttaattctacttccaaggtttgtatgtatgtatgtataaatctggtaattgtttaagaagtcttcatcctcatctttcactgtcatcaattaataagtaataaaaacaatactatgtgggttataaagcacaacagacatttaaagttttcagtaattaaacagagctacttaaaatgctgtaaacaaatgctaattagcaagcctccacgatagagtgaattgtagaactaacggtctgtcagccagggagatacatggccccacatatgatagaaagcccgggggatttgctttctatttctaaaattgcttatttgactcaatcactgaacctaaattagcgaaagcagtggtagagactgtaaataatttttttcattaaaactatcattggaaacttctgagcaacatttaaagattgtattagttctaacttgcttgttgttacttaattcctactacaaagctaaataatatataaaataaatagaaaaaatcagtgtctcaagttatcctttaatgtggggaataaaatgtctgaaagtcatttatgaactaattttagaatgctctactactggaaatatttattctttcaacactacatttgttgttttagatgcttgccaacatatatgttaaattctaaaagagaataaaaacatagtgcctccaccaaaatgaaataacataaaatataaagtaaaataataaaacaaaatagattacagctcttggaaaatattctaattgtggagtaaaatatttatacataagataacatgcagatgaagatgataaatacaagataaagcatgatgtaatacagatcaaataccataaaaggatgaagtattgtaaatttatttaagaaaggcttatgcgccagttgtggagtaaaatgttcacctataaaacaacacacaataggaagtgggaaactcaaggcattacgtaacacacatcaagtgctaccggaattttaaataaaaagtattataaggttgtttggaaatgtggattataataaggcctgttaggaaatgtggatttgaatttaactgttactctaaaatatgtggcaaacaaattgagtataatcatgaagaaaatctttataggctgcaattcttaagtaattttaattggaaccaaaacacagaattgaaatatagcttgcaatgtttgtgaaagttggtggtttcgagttaggctcaggactcacgattcctatgttagaatcctagctctccacttaggacatgtggaactttggacaagttactaaaggagcagctgctgttgtcttgtctgtaaaatgtaggtatcagaatagggcccacctcatagagttgtgaagattaaatgcatcaatatgtgtaaaatggttaaaaacatttcctgggacatacaaagtgatgtaaaaacctaaaagaaggcaaaagggctagatatccaattaagtcctactgtttaatgccttctaaaaatgaatttagaaaactggagaaacaggtcctagatctttagctttttgaaggtgttggtcgtgttacaagaatttatgttctctggctctaattttctcatttgtgaggaagccatgggactaggtgatcagtaagatcccaaaaaagaccaaatagtcatgatggtttctgctttttctgtcttgttgaaaaaaatctttgcctcttctttggccataaagacatgcttctgtgtttccttgtaagggacttttgtattggttttactattcacatttagactttactacctctggaattgaattttttggtatggtatttgatagtgaaaaagattcactcatttccatgtgaatatcaagtaatcccacaggatttgttgaagagactcttgttttttaactgccctgaaatgtctctctgaatatatattaagtgatcaagtatacatatatatatatatatatatgtatatatatatatatatatatatgtatatatatgtgtgtgtgtgtgtgtgtgtgtacatgcacagacatacacacacacacacatgcacattttaatttacatgtaattaaacgtatgctgcaaatatgatattgtaaataatactgataaatactgtaaatgacaccattttggacatatttcctaattgtttattcccggtctatttattgatgtatttatgaccttctaaaatcacgtattaattttaagcttactctagatttttaaaccagtgtatgtgtacaacaatgtctcttgcaaaaaattgagttttatttattatcttccaatacgtactcatttctttccttgcttattctagaataatattgaagagcaatcatgatggtaggtagctttgtctcattacgtgagaaacctgttaatattttgttattattgtttatcataggatttgtgtgtgtgtgtgtgtgtgtgtgtatgtgtaaactttctattaaattaaggaagttatcttctatttctagttggctaacaacttttaccaggaaatcatgatgaattttatcaagtatatttcatgcacgcattcaaatgaatttttattttcccttttattctgttagtgtgatgaactacaacaattgatctttgattgtgaaatcagtctcatacttctggaatcaacccatcatgataaaaaaaagtgttgtcttgtgtgtttttttttaacctctatgttcatgataaactattggcttataatattttttctggttatgtccatgccatttgtactgtcgaggagatgctggcctcatagaacaaactaggaagcattcctacttttcctgttatctggaagaatctgcatgtgattggtaacatttcataacatttggataatccatcaatgatgccaattgggtctggaatattttgtggaactatctttaatacagatctaattgccttcattgaaaagtactattgagatttttaaaatattttcttgtgtcagttatggaaaaatgagttttcaaaaaaaagtgtacatttgatacacattatcaaatatattagcataagattaagaactttaagctatgtctttttgtttttttaatcagaatagtgataatttttcccttacctctttcattttaagtcagattagtcatctattcaaacacccaaattatggctttgtgtattttctctatggcatgtttgtttttgcttcattactctggaataatatccttttttttttcttctacactttgtgggtttaatttgccactcttttcctaacttcatgaatgaagacatagatcattgatttttagcttctcatgttttctaaaacagcatataagtctgtaattctctctgagcacagtctcagcctcatcccacatgttctagtatgtcatattttcagaatcatttagttgataaatattttctagttcatgtctatatttcttctttgaccatgggttattgagaggtttgttactgacattataattttaaaaattgattttagcttaatttcactgtaaccagaaaataatatataataaaattaattaaaattcaatgagaacttttaaatagccctagatatggtcagttttagttagtgttctatatgcagttgacacacagtacatatattctattgttgttctgggtatccttctttatatgtcaaacaggcaaaaatcgctaactgaattactctgaccttccgcatcgttactgatttttgtcctcttttccatcagttattaatagatgtgaattacgattatggatctttctgtttatcttcttagttctttattttgttttatatatttgaagcaatatttagtaaatacaaacttggaattggtgtatcttcctaatgtagtcatcctttcatatagtatgatatatctatatctttagtaattatttctgtcttagagaaaagcttggtttaatcttaatattccttaactcacttcctcttgatttgtgtttgtatggtatatcatttttcatccgttttaatttcagtgatcctgtgtcttaatatttaaagtgttcttgcaaggaacatagaatcttccaaatacagtaggacaacctttgtttttttaattctaataacctattcacatttaattgcggttatatttgaatttgtgtctacaagtttgctgttttttaaatttgttccatgtactgcatgttcatttgtggccatttttagattaatgtttcttttattgttttgccgtttccactctgttagctcctaagttctgtatactttactgtatacatctcagcttataccattttactttttttatacatcatccgtttcctcctcagtacctggattgttttgaagtaaattccaaatctcagattacatcatttaatctgcaaatatttcagcatgcatgtgtgtatatgtataatatatgtttcagcatatatgtatatatgtaaatacatacattataatttcttaaataaccacaatattattatctgatacggtttggctgtgcccccacccaaatctcatcttgaattgtagttctcataatccccatgtattgtgagggggaccatttgggaagtaattgaatcatggggggcagttaccctcattatgttctcacaagaactgatggtttcataaggggcttttcccccttttgcttgccacatcttgctgccaccatgtgaggaaggctgtgtttgcttttccttctgccatgattgtaagtttcctgaggcttccccagccctgaggaactgtgaatgaattaaacatctttcctttattaattacccagtcttggatatttcttcatagcagcatgagaatggactaatacattatctcactgaatataattgctgtaatcccttagtgtaaatctagtaacaatcgtgttttcacagttccctctcataatcatttaattaatttgtttgaattgaaattcataaaagatacagagattgagattcattgacacgtcccttaagtctcttagtttaaaagctctcctaatatatcccacatccccttgtattttatgttgaaatacattttgactccattgaaagaacaaaatcatttgtcctatataattgtacaggtctacagtttgattattgcatccttctggtatcatttaacttgcttctctgtgtttcttgtacttcctggaaattattaattatatctagaggcttgattagattcaggtggaattttttaaagatttattcctggtgactgtgaacttccatcagaaggtacatgtctgattttctctccttttttggtgctaacagccagtgaatataaaattcactcctgtcttttttattgtttttttttgctggaattattctaaaaagagaaatatttttcattacatatttgattaccatgaattatgattgtatagaaaaataaagtaacttactatttcccctttatagtagtattcaaaatagtaaagtggtggtgtatcactttacaaaatctcacaaatcaccactaaagaacttatttatgtaaccaaataccatctgttccccaaaaatctatggaaataaaaaaaataaaaaaaaacaacttagtaaagtggtttcctagtattttctaaagactaaaaatgagttttaaaatattcttaataattttatgagctcagggattaaacatagtagatatatttcagtaccttgccattatctcaattaatggtcaaattattatgactttggctttgacaccatatttatgttggtttctgggtcgttttgacataactctaagagtctttgatagtttcctttatttctgatatgacaaaatgtttctgagtcataatttcctgccccatgttgggaatcaaccagttctctaaaatactctggtatcatttattggggaatactatttagatccaatattctgggtgctaagaaagctcattaacctcatcaatcttacagtgacatcgatcagcattgtcagaaatatcacttctcaatgacactattatgactgctcatttgctttatcccacaatacacctataagtctcagaaaaacagtaccaccagcaccaacatcattatgatatctgaaaagagtttaataattttttatttgagggctgcagaatattccagagaatattctgttaggtaagaacaacaaaattattatgttttaaagtcacttggagtggttctcctctgtgaggttatgtcaccaagtaaatacacagttttaatgtttgattattatacttgcttttctttaattttttacaaccatatatgatacttacacgattccaaaatcaaattaaaaatatatatattcaaagaaatttagctttttttccctctgctatcctctctctcttcccacttgtaaacttttatttttttaaaaatctaatctatttttctatctacatactctccattttagataaatcatgatgtgttaaacatacttttatccatgtcagattttttatttgtcttttcttgtaaaaatttcatatcttttggagatactctctttttatcattgcatagtattctattgtgtagatgctccatgtgccatagtttattaaaccagactactgaggtgatgactgaccttcaaatgtttccagtcttttcttatcattagttacactgcagaaaataacctgatgagtatgctctttcatattttacatagggtacactgagatagattccaagaaatgagtgtgggatcaaatagtaagaacatattacattttgccagatattttcaactatctatcatattattcaacttcacattttatcatgcaatgtttgacagcatctgttttccatatattccatatatccatatatttggaatatattttacaacacaaaatatatttgtaaaacttgaatttttccccatctgatggatgatgataagtagtatctcatatagttttaatttgtatttctcttattataagtgaaatcagttgtatttttcttatacattaagaaaataattaaattcattaaccttttcactgttgctccttgaatcatatttctgaaaaaaattcccacttctaacatctataaaaacttgcctttttttctcctcatgcagtttatgtctcttatccatgtggaatttacactgatatgcaatataagaaattgatcaattttttaccatatccatacagttatccagctacaccatcatcacttattttataatccatcttttcctctatagtttaaaatcctgcctgtgtggtatttaaaatttccgtaagcaaccagttctatttttggatttgcttttctgttccattggtctgtctgaactaaaacctgtcaatactaaatgattttcattggagaagagtagttttatcatctggctggacagtcctactccatgctgttctctttcaaaactgtcctctctgtacctactagatttttctttcaaataaaatttttattcaaaatttttagatacagaacaatattatattctaattgggcttgctttaaatttgtaaataaacataaagggttgacaactttgtgatattggaactctgcaactaagtacataatatgtatttccatttgtccagatctacttttgtgtcttttggaagtgttttatggtttacttcatgtatgatcctcatgtatatttattatgtttctgttttaatacattcttttaaatttgttagcataaatagagtattttctcacattatatctttttttctttatatcttacaactgattttgttttcatatatgaatgctactgagctttgggggagtaatattataatgacatactttacaagttgtctctttcttaagtggtcctgttgatattttctgcttctcaaactatatagtcatatctacaagtaaagatatcttacattttattatcaaattattatgtttttccttgtcaaactgtattaactgatagctccaaaaggactttggtattagtaacagtgatgaacattcttgtgttgctcctgattttgcagtaaattttctaacatttccacattaaaattctgactttgggactgagtttatgtgtgtgtactgtatgtgagaaggaggaagtggcagggcgggatgagacagtggagagagacagaaagagagaagagaaaaagatatatatttttttttgacaaggtctctgttgcccaggctggagtacagtggcgcaatctcggcttactgcagcctcaacttcccgggctcaagtgattctactacctcagcctctggtgtgactacaggcacatgccaccatgcccagcgaatttttgtatttttagtagaggtagggttttgctatgttgcccatgctggtctcaaactgctaggctcaactgatctgcctaacctcagcctctcaagatgttggaattacaggtgtgagccaccacgccgagccaagagagaaatcttaatgtaaatatgtacttatgtactgaattttgtcaaacgtctttttagcatcatggagatgaccatctgacttttctccacaactctaccaatgagatagatgactgtgaattaatgaatttcttaataataaatgccacttggctgtgatgtatttgttattatgttgctgaattctgttagataaattttacaatttttgtttataagtgagttgattagttgtttacttttttggagaaatcttatactctggcacaatatgaattcctaacatttcttattttactatgcttgggttatctgatctttaaagaatttgataggattcccctggataaccaagtgtatctagggattttaggggtgggtagggctcttgaatgactttatttcttcagtaataattgtgctttcttactctcctttcccagttattttggttaggatagatagtgctttgtctattttgttggagttttcaaataataagctattagatttacatcttagttctaattttaatttttttaattttaccttaagttctgggatacatgtgcagaacgtgcaggtttgttccaaaggtatacatgtgccatggtgggttgctgcacccattaacctgtcatctaggttttaagccctgcatgcattaggtatttatcctaatgctctccctcctcttgccctcccaacaggccccagtgtgtgatattcccctccctgtgttctcattgttcagctcccacttatttttaaacatttttttccatctttttaagtgggtgttactttttattcttaatttttattttcaaattaacataggtatttagcgttatttctggcacttgatatgctatatttttctaaaattctgtagttttagtaattcttttatccaaggactgttgttattttttttctttctttttacttatttttttaatttttttttgagacggagtctcgctctgtggccaggctggagtgcagtgatgcgatctcagctcactgcaacctctgcctcccgggttcaagtgatgattctcctacctcagcctcccgaggagctgggactacaagtacctgctaccacgcccgtctaatcgtttgtatttttagtagagacagggtttcatcatgttggccaggatggtctcgaactcctgaccttgtgatctgcccacctcagtctcccaaagtgctgggattacaggcatgagccactgtactcagccaagttttttccttttatctctaggaagaccttttcattgtcattaatttattgtattattgaagttttctttgtgggataatatgccacaatttggtaaacattcatatgataaaagttgatatcatttttgagagttgagttctctggtaaatgtttaccatgggtccttacccaggtttccagtggttttcattgtctgaagcttgacttttagtatattccccagaaaggctaatgggaataatattccctgagttgttgcttttatcctcaaagttgtagcctttatccttgaaggtcacttttacttgttagctgttctcggtcaatttctccaggttaaaaatgtgttcccttagtatatattttcaaattagattttttttcaggaatgtgttctcaacttataatttatggtagctaatttatatcgtttaacatttctttgctaacttctacgtttatcactttttctcaaatcctttttatctttttttaaagtttatttttgatctttaaaatttacttcctttccatctcgtatttttcttaagtatgattttctgtgtttgtttgttcacatgtctcttctagcataggctttctttatgaaattattttctgtaattttcaaatatttcgagttctgtcgcatgtttacagatacctttttctccactcatgtcattgtagggactttcttattctaattgctatacttatttaatagttactaccatttccttaaaagttttagcacatgttgaaattatgtgttataattttgtttttttgtggccatgtatttccagtgtgcttttgtcatctgtatggatgtatttccagttcttgtttactttcattttctcttaaaacctatttggagacttgaatgtgatctattcctgttgtacatcttaaaaggaaattcacttttcaatgttttcagaagggataaagtaaggcagaatagattttctagctttaaatcattagaattctcacttttgttgttttcaaaagtgattttaaaatatgtccttttagaacttgagttctctttactgctctttcttcctcaattttatttgagccattttttctctttttcttttttctttttggacctaatttgctttctgttcaacttggaatttattctatgcaatttcttttcactgtgatgtttcgctttgcttggaaggaaattactggttgttaattgagagtttaaaaagtcaaaacctctctagaatgaagaactttcctcaaaatacagaccctttttatgtactcgcaaattggatcatgagagccctctgcaagttttggatgctgtttccatatggatctactacatccaaagggagtagctgtttgaactgtcctgttctcagagaggcccagttatttttattcctctttctcccacacagatacagctatgctatgtagaccttgcagcgggtaataatttctctccatgtgcttactcatctttgagggttcatggcatatttttgtcaggagctcagctaagctggagaaagtagccaagtaaaacaacaagccgaaatgaagataacagtcaaccctttaatcacttactgtgatagtgtgagctagaaacaaaacagaggaaaacaatgccacccccttccaatccattttccccatggattggtgtgatggttgaggttcaggtggatcaaaacagacttgagggtcatctttttgatgacatagctctaaacaaaatgagtttgccattttatggatccaggaggtgggagaggacaaggggctagggctagaagtggaaaaatgctgagtactgagtctgaacagagaaaactccttcaaaatgttttgcctctcccctgataaggaggtctttgcaaaagctctgaggaaggcctctgggaaagagctaaaataagtaaactactgaatggaaacacctgatctaggaatgcagatatgcatgagagtatggcaggccggggagcctgagtccttaactgcaactcccttcagagactgcagtgccctggctgtgtatccagtctagggtagggagggcagctttcccccaggaggcctgtccagtaaagcctttgtaattgcctatgtttgagcctaaaaaattcacacacagatttttttgatcagaagctaaactcctcaaccttgtcaccaatatttgttgtatatattggatttggattttttttatttcaccattgtaattgtggtgtctgtttttatgaggaacatttgtggagtactgccaccaccacctatccagaacactctctacatacactttagcaacaggagaccatattgtcattgtttggtggagccaatactcattaacatttacccagatagctaccctttctgctactcattgttcttttccttcatttccatgtttctttccaaagaactttttagtatttctttaatattaattgagagcaaacatttctctcaattttgtgttaatctgggtctctctctctctctctatccttctccctctctctcccctccactttctccttttcctttagcttcactttcaacattatcttcacaagctataaaaactagattggcagttattttctttcagaattttaaagatatcaaagaagttgctacaattaacagtaaagatattttctaagaattgaacagccttgctaatgtagtagttaaaatttaatcaacacatgagcaaacttattttccttatgttcctctcatgatattgaaaatatttataagttctagactgcaaatagtaccatatttttctttaactactaataatgaaaagtgaagctgaaaaattacccacatagacttagttaaaataatgtttctttaataaaatattatatatttgatttattatatacctttttattttattttataagagcaaaagtaggcttatattataacagaaatatgtttgtcctttagaaacttatgacagtctatttcagagtatagccattatgaacgcggttcctataaatactattattctgacaattttctgcaatgttgaaagtaaattaaggctcattattaaaaaataaagttttccaaatttcttagtgaatttttacctttgattactatctataaaataatcataaaatcaccatggaaacagaaattgttgtttcaatattaagaaaacaactatttcattgcgacaaaatctaggtctataaccattacccaaggtataaatataaacttacattaaatagagaaattaagaaaataaagcataaacaagattttttaagggtagtgacatttacacacaaactaaggaggcacagaaaagaatatggcaggtttttttctatttttccactgaataactctagtttttaaaaatagaatttttattggtattacatttattacattgtaattttctgttttatgttgaaatttaaatttctactagataaaggctagagaagaatataaacggtacctggaatcagtcttttaaagtaattgtaataattatgtcaagtttctttaacaacataacttttcactgtttccattaacatgcatttcttttaaaaaatgatttattgaccaacataattgtttctggtttgaagatgggaattgtgtgacatgaattctaactcagaatcatttgaattcaaatctggctacagtcctggagtgcacaaattattccatatagatgtgctagatgaagatggtataaataagagaggaagttgaaatggagttaattagatcaggcttttcctctttaaaagacgacttttgagttgaaatattaagtaattagagacttgatagagttgataggtaagcacattctagttaagaggaatagcttgatttaaaaaaaatgaggaaagagagtcagaagtggataataatagaaagaagtatttaatagcagtgagggattatgttggaaaacagcaaaagataattctagaaagatagtgggaatacactgggggcagagagccacgtataatttattcttggctgtatttctatctcctaggctggtgcatggtgctgaataaatattcattgaaataaagctatgccatttttaccctagcttggaccaagatggtaactgtataaatgaaaaggaatcatttaatctttcatttatcctagactttgctctgaatgcctattgcaaagggaataaaacattgcctcagtactatagatactcccatttttccaaaggctacagaataacaggaaaaaaaatacacatgcatgtgcacacatacacatacagagagagagagttcagtacattttgataagttcaaaagtagagtgatgaataaagtggatcgagtaactctgtcagaaacttttaggagaggaagttttttttttttttgactatcagattcagaaaatgaaaaagaacagtgagaggaaagttttaaaatatctccaaagttgtgcagaactgggagaactgtggtttcagaaaagtgctgagaaaatacaaataagatggttgtatttccaatattttcaattaaatttaaagcattttctgttgttttacctattgtgtaaactatagtaggatgtgtgtgtatatatatatatatatatatttttttttttttttttttttttttttttgagaaagcagagacagcaaaggtagctctgtcaaactggtgccattgttggtgattaactggatgactctgtctccaatatgaactcactcatatacacacttattgcttagaagacaaggcaagcaaacctgcccaattttacagaggagaacaatttcacttataagctaaagttaacactcctgatactcctggttcatggtgctccaatatttgttccacttttcatgatttgaccctacttagtcttagactccttgctgttgatctaacctggtactctgattttggctctttgttttgactttggtttcctaattagaccccttttttttttcacattccaaaagttgacttcttgttgcaacttcatataatgaagtgcatgttcatgtcaattaaattcaccagcctcaaatttaaaatatttccatcaaatttttatagtaagtagcattcaaaatgaggaaattattatattaagatccttaaaataagacaaagtgataaataaagaagtgactagtcaataacatgattaaagatcctgaggtaggggttgaatgggcgcaaggagggaaaaaattcacacacatacatacataaatgaactagatgagggataaaaggaaatcttatgcaattatatggaaaaatacttaaatattgtaagtttacaaattttaaactactttgaatttatataaagtaaaaacaaatcttaatcttaaataatttgtttagggaaagactccacttctttcacttctttttctttttttgggagggggacagcatcttgctctgttgcccagtccctggagtgcagtggcacaatcatagctcactgtaacctctaatacctgggctcgaaggatcttcctgcctcagcctcccaagtaattgggactacaggcacacactgccatgcccagataatttttaaattcttggtagagactgggatctcacgatgttgcccaggcaggtctcttggcctcaggtgatcctcccatctcagcctcccaaagtgatgggattacaggtgtgagccactgtccccagccaagactcctcttcttattgacaagagttgagtaaaggtcaatggcatgtactggtgctgaggaaattgtttcttgcaggttccatctgccagcctcacaacatccctcaaacgagacatgttttggggactgagatctgtacctcaaattgtttcaaggtaaaaatagcacagttaagaattggaagtatttctaaaagaatatctattaaattattttgtaacctctaaagtaacattttcttattgtgcctggaaaaaaaaaaggagtgaaaatttattaaatatccaaagtaaaatcaagctacaggtggcagtggtcctttaagaaaattaatgtattttgcctatactgtctattttatttcttacgtgtatatctatgttaatatttaaatattattagccaagtgactttaagtagtagaagcagaaaatttaagtgttacacaaacatttgctgttaagatgaatcatctttccatacacataactattttcaaatactttagaatacaaaatgctttttaaaatgccttgaaaacaaagaattaatctgacataatcacatccctaatagagttttattttcttatatttctttaattctcttactgaattgaaacttaataggtttcttttagaaacttgattgtcatgatacaatagtagttttgtaataacaaaattcctaaaaaaattaagtaatcatggctgaaagacatttactcgtgtgtaggcaacaatgttctatcattagctcaagtcatctccatatttttcactttaagttaattagactatcacacatttaaacactggagatgtaacaatttacggtagttcattgtgttttgttttccaaccagaacatgttctcttaaacatgagagtgcatcttttgaagagaaaagatatcaaaataatggtgttaattgttgtctagtgtttctgttatatgaaaatataaatattacaaatctaggagccacatgtctatgtaaggagtattttcaaatgaataatccaaagaaccaaaaatattaaaacattccaagttatatttgaatcactgtatgttcatcaccaaatgtcaaagagatggagacacatagtcccagtaatacttacagcccctcagagcactccgtttctccagcacctggtaatttctgggattcttgctctcctagctcagaagaatccttttagccacaacacatcctatttccatatcacaaaccaaataccaatcattcgaattcccatttcagcaggtcctcacattcaacagtgcctcgtctcttaggacgaataatactatataaatgcaagtaaataaaataaaatgtctaaaatattctttggacccagtatagaaattttgataaattatttcttcaaaacaaaagagtatgacaaagtgtcagttttcatgtgagtcgcccatttttttattaaagaattttcaaggataattttgagtcataactctttttttacctttatatgctgactttagatcctagctataaaatatgttggcctggcacagtggctcacgcctgtaatcccagcactttgggaggctaaggcgggcagatcacgaggtcaggcgttcaagaccagcctgaccaacatggtgaaaccccacctctactaaaaatacaaaaattagccgggcgtggtggcacacgcctgtaatcccagctactcaggaggctgaggcaggagaatcgcttgaacccgggaggcagaggttgcagtgagccgagatcatgccactgcactccaacgtggcaacagagtgagactccatctcaatatatacatacacacacacacacacacatatatatgttggctcccacatgattacttgtttaacacttctctcctcatctagacagtaatttccatgacaatatgggaaacctctgctttatacaccagggtggctctgatgactggcaggtagtggcatgctacataaatgttcattcttgggctcttcattcatcctgtggaacctctttaggctgtttcatgccacagactcactggaagaaattgccgtcttctctttcactaactggtacaacttcattcaaggaaacatttcctgaatcagtgaacatttggataaataaaagtaatgtgaatgttctgttttgacattttaatttaataatacgttctaaagtttcctttaggtttttggaattatatttagcttctaaaattttgccacttaacatatgctagaaacagccccattctcaccacagagataatctcccaagtatatgataatcattgtagcttatataacattttctaaatttagatatcccatcagtatataatgatcaagctatttgctaacaatttagaatggaataaaaataataatatggaaatttgcactataaagagcaggtgaagggtagtgtacataattttcactgttttagataatttgcttttgcaatagagtcataaacattagaaagaacaccagaacttaaaataacctgctcacttgggcttgcctctacagcatgtctgtatggtctgcactctctccccagattaattgctttcatatcatgtacatttgcaggaacagtgtgacaaatgataaaacaaaataaggtcacttaatgtgattaaggacaagagtgatttgtgcaaaatattattgaaaattactatttaagttgcattttgcgtgtacttttcagaattttaaaaagagtgatatgatgtgtggagatgatggatgagggtgagatggaaagcatattaatgtatgaagccactgaaacttctgaaaagatactcaagagttttacattaagcatctcaatacctaaaataaagctgtgagataagcattattaatttattttcagatcagaaatctaaggcacagagggtttgctcaaaaccaaacagctagtaagtgtcagagttggagtcttattaaggctatttgactccaaagactaagctcctatcgaccatgaagaacttgtaaaagacaaaaaaaaataaaataaaacaaaaacacatctttattatttattcacatccctaacacattactctggtaatttttataacattggtctccatttttgacatccttgtaatgactttttgtagacagagttatttctctttcctgatgtcagtattggccatgaaacttgctttggctaatagaacacaagtgaacatgatatacaccacctctgagtggtgctttaaatgtgctcacgtggtttgattttaccactctgtttctactcttttttttgacaacagcatgttttgggaagagctgctctttcagcctgagtctctaagacacctagcacagatctgaacaccgaccacaccgaccaaagcctgaaacagagactcagcagaactgtcacagggcatattatttgaatgggaaataaatattaaagccactgatattttggggttacttgacgcatagcataatttagagaaagctaaataatatgcttttcaagcatttaggagatacagccgcagatctgaaaagctaattggtaacatttttacaataggaaacctaacttgtcacagttttcttctactgcatgtgaaaagcagaaagttgttgtagagatatattttcaccccgtgtagccagaatagttttgttgccctggtgccaggaaaagacttctttgtaaatatatatccccactatggtacgagatcatagaaattaattcatcttgcttaagcattgtttcctcgaaggagagagtttttataaataatcctgggagaagttactcagtatgtaagcaatgccttactgtgcatatgtttgtcaaagtaattttccccgtgactggacaggcctgggatggacccacagcaatcagcagttactgggtggaaaggaaataagagtctcaaagcagagggaaacagtgacacaggctgaggaattaaatgactattgtgacttcttttatatcattgattactttatatcgcaatctgaaatcagcaaaaatatttctagagcttatgcattctctatgaacatttaaacatttattacaatatgttaattaaaatgatgcatgcataatctgactcatactttaatttaaacatagccaccttttaattgtgtctatcacacaaagtgtgtatttacaatagagttggcactatttactatatttactatttattctagagtatttagaagatctatttactatagaaaattgttgctatgatttcctggcctaatgagaaaaaaaaaacaaatgctgattaataggccagtgaaaaatttgagtgaaaagacttcaagtcacactgcccaaaagaagattttgcaataattttaccagaaaagccatacaatgcagtcattaggagcattactttgggaagtaagacaatgtagaagtctacagaacctgaagcatacaagtaagtatgttcatcttgtaagctgttacttagtttcgtgatccatcccattaatgtaatgttgctgatttgaatttatggatattatggctttatttctgtttaatttataaatgagttttatagttgcttaaattataagtgtaaagaagctatacttagtttcacatttatatgtattttagtagtgcaataaatataatttaagtcaacactggggttagcaagaattgtacttttccttaataaggcttattcctttacaagaattgtgcttttcctttatattcattggtgaaaacactattttgaaagcataaacttgcctggtattagttgtacaaatttaaaaataaactggatctgacaagtttccaaattaggtattcatttactatatttggcatgtttcttgtgttttgtagtatctgtaaatcatctgcaaaactgacagttaaaagatgagaagttactgtttgtgaatcagcctagttgtttcacttgaagacttttttagttataagagattagggcatttctttgtatttccatttaagaacaatttttaaaaaaattgttgtggaatgatagtttctatttctgttagctgaactcacttctgtgctatttctgttagtttaaatcacttctgtggatttaatttatttcccagttttgcaattatgagggtttttttctgggtttatgttgacctatatatactaaaatttgaatttaaaatttctggtcgctggagaggaaaagttctcctacagagataattaggcaatatggatgtagtttttcaacatgtgctgtaaatttcagtgaggattgtcctctgtaattgcttttagcactttctgattttgtccttggcaccatggtttgagttcagggcacctgaaacacatcattctctttcttctaaagaaggtcactagcctttgtcctctgcactgtaccgagtctgtgaaggaacacaatagtaatcaacaatactacaaataatatagtaaaatctcattaagccttcatcacattttcatgtcattaccatcatgttttttctgaaaaataattccatattctttaacagagacccaaaatagcactttctgtttgtgtggttcttcctctaacattttttttaaattactgagtgatattttttttaaattactgagtgatattttttatttatttgggagaaaaagatgataaaataatgtttttctgttcatattaatttaattattgaagtgtttttaatagtgggtttataagtatttaatgtaagaattattttgaaatcataaaaagatacagtaagtgtgaaaacattaaaataattatacttagggaagtcagagtgcaattgtcttagaagcaattaagaactatatttattctcttattcaaccacaagtatctcttaggataatctcaaaaagcagaaaacagatcctttgtcctttgtttatatattttttaattttgaagtcattaacatagctttttatgtaacccattcagtgtctggaaaatacttatttctcatgaaattaaattcacatttcatggtgattcatttttcatgtagatgattgtgaatttagtttggtaggttggactattttgattcataattagaaatcaggaatggcgtaatagaatggaaaactagtaatatgattactaattaaagagtaagcaaagatctggcttgtgaaaataaaattatgttaatgaaagtgataacttatttcaggatttaaggggctcaggtgggaaaaaattagacatctcaggatatgaccaagctgtggttgagcatttcatatagataaaatcaggtcagagtagcagctaacacaggtcagcaataaaagagtaagaaacaggggggaaaggaggctgctaggagacactgggctgggttatgagctccaagagtactgtagaggcatagtacaagagagctctgaactcctacaatcaagtgtaggcaatatattaggtttttttttttttttaattgcctcaaatggatgctaactctgcctaacctaaacaaaaatgaacgtattggaagactatgtgagagtttataatttccatgagaagactggagaatcagacctgggaaatgataaatctaaagtaactacaaggtctgaaaagtctaactgcgagctagactttcattcttatgccattatttagattataaggagagagtgtccaaatatctgtgccaggttaccaatctatctcttggctagggaagggtaatataccttaaataaaatgttcactaggctataaacaataggaaaagagacaatttctcaaaaaaggggaaattatcaaaagaaggtgaagtagaagttaaacaactaaatatactgataataataatgtcagcaacaaaaggtagaaactatccagagccatgggtatttctatagataccaaaagcttgtgaagggacaatacaataacaatagagacaatgtagcctgggatataattatgtttttattccattcattgctatttcagtgtcttaattgtgattactatttctagcaatgctcccccaccaccaaaatttagttgttctctttgccagagaattctcttcttctgagagactcacctcttattttgcatccaaaaatattttggtttaggataatacagattagggtaaattattgtatcagtggcaaatgatactggagaccaaatttcaagtgaagaagagaggataaggtagacacggatgcttgggttgaccaccgcagagaggcagcccatcaccctgcttatctgtttggggaaaacattataagaggaggtttcaagtcagagaacttgtcaattaaatgcccttggctaactctcttcatagagagttacctattctctatttctggttctctgtaattatcaaatggatgttttctcctcactgctagattttgtgattgtgcagcaaaggaatcatcttttgtgttgaatttagggaaccactgaaatcctagaagtttgaatgtatttttcagaagctccttcctgtcttcactcattaagttttattgaatacaatatgccaggcattatgccaattaacaataattaataccaatctctgaaaatctaatttttcttaacctagggacctgacaatagtgttatttaggattgcatatgctgcctactacattttcttctataaatggcaattttatgagtgaaataagtcagacacagaaagaaaaatactgcatgatttcacatataaatggaatcttaaaaaagtataatatataggaacagagagtagcaatggtagttaccaggagtgagactggattgtagaggggaagagcaagatttagctaaaggccacaaagttactattatgtaggatgagtatgtttaaaaatgaggtccggtagtcccccctatctgtggccaatatattctaagattcctagtgaatgcctgaaatcacagacagtcctgagccgtatgcatactatgttttttcctatacatacataacaataataatcttcaatttataaattaggcacagtaagagattaacaacaattataataaaatagaacaattataacaatatgccagcatcactactcttgcactttggggccattattcagcaaaataagggttacttgaatacagccactgcaatagtgagacagtcaatcttatcagatctgagatggccactaagagactaacgggcatgtagtgaagacagcatggatacactagacatagggacgatttgggttctggaatggagtgggaccctgtgagatctcatcaggctactaagaatgacacacaattaaaaacttacgaattatttatttctggaattttccaattaaaatttttgaacaacagttgacctccaggtactttgaagtattactaaagccgatatatctaagaactcttttcaacctggccttttagatttccaccaaacagttgttctttgatttcagtatataagacttttttcctactgtcatttcacagctgagcaagccatgtgaacctttgaaagctatagtacaatttaacttccaaatgcttatgttagggattaaaaatgcaaactcagtagtctcttggattcaaatcctgaccaaaatacttgctgtaaaatcccttatgtgaatcccattgtgtgccagctatcatgtaacctcatccctgactgatatttattttaattgcatgtgatcttactcattatagttcatttgcataaagagagtgaactgtagccggccagcaagtttaaaacctgcagtatttttttattccctgtgataaactttggtcataccactgatgtcctctacgtttaatggtatcaaaaactcataagcaaatattaactcgttaacatcttcacatattgttttgaccaacacatattctcctaaatttgccaatttaatgtttctaccaatatattaataaaatttgttttttccttatagttataattaggagttccatcaagtaggtgaaagatggtcatataaaatgtatgggaaaagattcctaaaaaatggaacagatgggcatccagctttagcagtgaccactattcactaatatagctacttgccacttttgcctttaaaaatcactactaactaacaaccttcttgctatacaaaatgtggtctgcagaccagaaacatctgtctcacttgacagacactggggcccaactagaggcctactgaatcagattctgcattttaataaggtctctaggcaatgactgtgctaattaaagttagggaggcattacgctaatctaccaaggtgatcagagactgggaataccatgcagagagaccttgggcacgagactcaatcaccatatgtgcattatagaagcctgtggctttatggcatgcagtcctctggatgagggtctgaacacctagacaaagctttccttgcagagaaatgtagattctggaaaggaatggcagtcactcttacatgggcagtcctaggagtacctgatgacccctttgtaacagatgaactgcacaggagacctggatctcttctggctccgagaatatgacagtagtggctttggcagcaaagaaactcaggagtagagcaatttcctaagtccttcagtgaaggactggtggctttccaactggtgtatcacagaaccacagggacagatacagataatttctacataagattccatagcatcttgggttgattctcatgaaacataagctcatgaggaaacacaaaaacaaacaaacaagaaaacaatgccattaagagcattgagaaattatacaaaggaaaaagaagaaaactaaacagcacaagcatcttctaggaaagaagaactggaggaggcagactattacattggcactcacactcaatttcctgagaacctttatatgagttaagtacagtctcttcttagagtcttatcttagaagaaccagtagtttggggcagatttagagcctttagtgtaagcaaagctgactgattaaattggtaagtttttttttttttaaattaccagcggtcgatatagcacagcgaacctagatcttttctttgttgtttttatgtgcaggaaattgctccactagaaataaaccttcttttccttacactgtggttaaagataatgttttaaaaagatgtctccctgttattcacttttacgttttatgatattatgattctgtttcttattttggttacatgattctatatgtatttggggtttatgctttattatagattttgaaaaatgtaatgcttatttgctttgtttttaatttttacatttaaggaacattattttaacaatataaaaatatttcaatgtgatttcaggagtttctagaatgttgcatttatgtaaaatttttacaggtatgtaaaaatgtatttgagaatttccctgggggaattgaagacatatatacacaaaagaatacaaaaagaaacaatttcttcatataaactactttctaatgactaagtattatcttataatggttttacctctcttagatttaattcttatagtcatgtttcttctgtcaattctaacttcaatatcattatacttaattttaaaagtggtacaaaatataagttagctctgcctttctttatcatctcttgacataagtttcctcctgtaggtgctcttatgtacactatgaaatagaagtcttagaaagcaaaaagttattatgtatccttagcccaatctcatactctgtagaaacacccatattaatatatgtcacacataataatctggcttctcttgaacactttcaagaatgattattattattgggaaatatttcctggactaagcttcaccctgcattttcataatgttaacttcttcccaagcttataacctgcatctttagagaagcttaaggctcaatccatatgatagccattcagaatttttaaattgtcaacattttattgctaaagtcttttatgttttgctgtctgccacaatcccttcaatgtgtttcccattcgtagtttctagatcttttattatcttcctgctaatcgttgcatggcttctccctgaattgtcggttacttttgtaaagagtagtgattttacagacataaaggcttctaaaattattgtctgaacaccagaaataaaagctttcctaggtcctgaatgtcccaaactacatttcatcgtatttatattagtgtgacccaagtttaattaccttacttagcaataattttattttgtattgtaatgattgttcaatcaacaaatatatgaaaatattcatataaagattcatataaaataagttcataaaaagctcatataaaatactatttaggcaagtatctgctcatgccgcattcatgcaatttacttatctgaatgtaaatcaaggctttatatttatcaaagctgatattcattttgttaatgtgctttcataattttcctttacaaaaattattttaaatgtcttattctgttttctaatatattagcagcttccctgagatttgttttatccaccttctggtgaccaatgaatggaacagtattaaattatatcccaaagaatctctcttctggactatataaattacatatgtagttaatgacaaaatagattaattagctaatactatttgagtgcagaagctcaaccacttataaatttaccaaactatgtgttttcatagccattttctcttatgttgcccatttggctggcacaagatatttttattaaatatcttggcaaatcaagataatcaatttctgtaacatttaacttatgtagcatctagcatctcaacaggaaatatttatctaagtatcactgggtcttatgaaattaaagctagtttctgaagagaattcctataattaaataagattatgctgtatatgaaaaaggttttataaattttgacagtattatgcattgtaagggattactgagggttgaaaaaacgatctgcttaataatagtctatcctagaatttttttgaaaaattaaacaataggattattagttcaatggatcttcaacaactctcaggaaaagaactagtaataataaatgtcaataaatagttatggaattaatgtctgaatgcctgttgattgtgatgaagtgccaactaaagaaggatttaaggttacattaatttaggtgcaaattttaactttgctatttacttatactgtgaatcctgaataatttacgtaacttttctgagcatcctcaacttcctcatttgtaaaatgtgttaataccacctaccttgggggattaagtaaaataatgtatatgaaataaataaaatagtgcaaaattgtttatttccttctttcaccccatctcttcctccaactaaagatgaaatgaattaattgctttgtgccttagtacattggacacaaaaccaattcatttgaattaggtcaggcaaaagttcagtcatttggctactagtatcctttgataatggaagtattatggtgtgtattttttcacaggggccattagactgtaggtcatttggatgtcattaggagaaagaatgatgatcttgaattgcatagaacatttcgtgctttctcatgctgtgctctttactctttccctttttaagagaaaatctacaaaaaaattttaaactacattataataatattattctatactggaacaaaaaaatgacaaatatacaaacaaattcaaactatggaaaaagttggtggggcaggggtggagactatgaaaaataaacaatcaaaacagcagatatgttcctaaattaaaagaaaattaaatattagaatgactaaagacttcagcaagctacaacaaagccaaggattttttcttctctgtgcatactagagccacttattttctctttaattcacattatactttattatatagtagtagacacttttgctttctttgaacattttattcatttactacaaatgtatattgactctggatgtctgttcagaaatcatgcaactaaacaagaactcataaccgtgattttttttagatggttgaagacctttatggtgcaattatccaagttaatgaaggaatagaatcagacactaaccttgagagtacataatccaaaatttactggataatatactatttttaagaaactgaaataagagccaaacaatggacctctagtttttctaaaaccagtaattacttgtgggtaagttatctaaattattgaaacttggccccaattttcccagctttttaaattacagaattatgctgtctatgattatattagatttttcaaagtgactgtgttaatacatttgaatataattctctcatttacagtttcttttaaaatttttctaccagcttatcccatctccttgaacaatttcctcccattcctcatttgtattgaatatggaaagaatcacttcttaaagtaattaaagttatcagcctaagaattgaccttttttgaatagggttgtttattttgttgttgagttatatgagttatctataaattctgatcattaatcacttatcagatataatatgtgcaaatgatttctcccattctgtgggttttctagaattcagttcatattaacttttaaaattttgttttaattttagacagcatgtctaaatgcatgttcattacatgggtatattgcataatgatggggatttggcttccagtgtacccaaaacacaaatagtgttgtacccagtaggtaatttttcaaactcaccctctaccaccctccctttttggagtccccagtgcctattatttttatctgtatgtccatgtgtggccattgtttagctcccatttataagtgaaaacatgcagtatttgattttttgttctgagatattttacttaggtctccatcaccatctatattgccacaaaggaaacaatttcattttttatggctacatagtattccttggtgtgtatatataccacatgttctttatctaatcaaccattgatgagcacttaggttggttccatgactttgctattgtgaatagtgctgtgataaatatacgagtgaacgttgtttttttttttttataatgatttattttcccttaagtaggtaccaagtagtgggattgctggattggatggtaattctatttttagttctttgaggtgtcttcatactgttttccatagaggtttaactaactgagattcccaccaacaggtcataagcattcccttttctccacatccatgccaacatctgttatttgttgactttttaatggtagccattttgactgtggcaagatgatacttcagtatggttttaatttgtctctctctggttaaatgatgttgagcattcttttcatgtgtttgttggctgcttgtgtgttttcttttgagaaatgtctgttcatgtccttttcccagtttttttttaaattttattattattatactttaggttatagggtacatgtgcacaatgtgcaggtttgttacatatgtatacatgcgccatgttggggtgctgcacccattaactcgtcatttacattaggtatatctccctaatgctatccctcccccctccccccaccccacaacagtccccagagtgtgatgttccccttcctgtgtccatgtgttctcattgttcaattcccacctatgagtgagaacatgcggtgtttggttttttgtccttgcgatactttgctgagaatgatggtttccagtttcatccgtgtccctacaaaggacatgaactcatcattatttatggctgcatagtattccatggtgtgtatgtgccacattttcttaatccagtctatcattgttggacatttgggttggttccaagtctttgctattgtgaataatgccgcaataaacatacatgtgcatgtgtctttatagcagcatgatttataatcctttgggtatatacccagtaatgagagtggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatgatgagcattttttcatgtgttttttggctgcataaatgtcttcttttgagaagtgtctgttcatatcctttgcccacttgttgatggggttgtttttttcttgtaaatttgtttgagttcattgtagattctggatattagccctttgtcagatgagtaggttgcgaaaattttctcccattttgtaggttgcctgttcactctgatggtagtttcttttgctgtgcagaagctctttagtttaattagatcccatttgtcagttttgtcttttgttgccattgcttttggtgttttagacatgaagtccttgcccatgcctatgtcctgaatggtaatgcctaggttttcttctagggtttttatggttttaggtctaacatgtaagtctttaatctatcttgaattaatttttgtataaggtgtaaggaagggatccagtttcagctttctacatatggctagccagttttcccagcaccatttattaaatagggaatcctttccccatttcttgtttttctcaggtttgtcaaagatcaggtggttgtagatatgcgacattatttctgaggaccctgttctgtcccattgatctatattttcccagtttttaatggggttctttatttttttcttgttgatgtgttgagttttttgtagattctagatattattagtcctttgttggaggcataatttgcaaatattttctctcattctgtaggttgtgtgcttactctggtgattatccctttttctgtgcagacactttccagtttaattaactgtcatttgtctatttttgcttttgttgcatttacttttagggtcttcattataaattctttgcctaggtcaatgtccagaagagtgttttctagattttctttgaagatttttatagttttaggtcatacatttaagtctttaatcaatcttaagttgatttttatatatgatgagggacaggagtccagtttcatttatttgcatatggctagccaacttccccaacactatttatcaagtaagttgtcattttgccattctttatttttgaccctattgtcaaaaatcaatcagttgtaggtatgtgacttaatttctgggttctatttccttttccattgatctacatgtacatttttgtgctagtaccatgcttttatacctactgtagccttgtagtatgaattgaattcaagtaatgtgatgcctccatatttcttctttttgatgaggattgctttggttattctggctcttttttgcttccatgggaattttaggattggttttctaattctgtgaaaaatgacattagtaattggataggaactgtgctgaatctgtaggtggccttgggcagtataatcattttaacaatattgatactttcaatccatgagcatgggatttttttatttgtttgtgtcatctatgatttctttcatcagtatttttagttctccttgtatgaatctttcacctagttggttaaatgtattctaaattgttttttttttctaactattgtaaatgggattgagttcttgattttgctctcagcttgaacattattgatgtgtagaaacgttactgagttgtgtacattgatttcagtatcctgaaattttactgatatcatttattgatttttggagtctttcagaggaatcttagggttgtctaggtatacaatgatgtcatcaggaccagagataatttgacttcctcttttccaatttggatgccttttatttccttctcttgcctgatctctctggctagaacttccaatactatgttgaataggagtgaggagtgtgccagttcttgtgccagtcttgtgccagttcttaggggaatgctttcaacttttctccattcaacatgatgctggctgtgtatttgccatggatggctcttattattttgaagtattttcctttgatgcctggttttttgtgggttttgtatcatgaagcgatgttagattttattggatgcttcttctgcatctattgagatgattatatatatatttaattctgtttatgccatgaatcaaatttattgatttgcatatgttgaactatccttgcatgcatggaataaaacccacttgaccatgataaattatcttttcatgtgcttttggattctgtttactagtattttgttgaggagttttgcatctaggttcatcagggatattggcctgtagttctgtttgctagtattttgttgaggagttttgcttctaggttcatcagggatattgcatgtagttctcttttttgtctgattttggtatcagggtgatattgatttcttagaataagctagggaggaatccttcccccttgatattttgaaataactcttccttgtatgtttggtaacattttagctatgaatccatctggtcctgggattccttttgttggaagattttttttattatcgattcaattttattactcattattggtctattaagggtatctatttcttcttgattcaatcttggctggttgtaagtttttagaaatttatccatttcctttaggttttctagtttttgcaaataggggtgttcatagtagtctctgatgatcttttgtatttctgtgatatgagttgttaatgtcacctttataatttctaattgtacttgtttgaatctccttttttcttgcttaagctaggtagtggtctatcaattttgtttatcctttcaaagaaccaactttttctttcattggtcatttgtataatttttttggtctcagtctcatttagttctcctcttatctttgctatttattttcttatgcttgctttgtgtttaatttgttcctgtttttccagtttcttaaggtgtgatattaggttgttaatttgagatctttctcttttttatgtaggcagttagtgaaaccaacttttctcttagtagcccttttgttttattccagaggtttttgtttatagtttgtctattttcatttgttttgaaaaattgttctgatatctgccttaatttctttatttacccaaaagccattcaggaggaaattgtttagttttcatgcatttttgtagttttgagagctcctcttggaattgatttataattttattcaactgtagtctgagaagacatttgatatgaatttgatgtttttgagacttgttttatggccaagcatatggtaaattctggagaatgttctatgcatatatgtatattctgcctttgttgggcagaatattctgtaaatgtccattgggtccacttggtttgtagtccagtttaagtccaaagttgagtctgtttgtgtctttagcaattaggtgggtctcttgtatgcagcagatgtttgggtcttgttttttttgtttttgttgtttgttttttgtttttgttttttatccttttccactctatcttctaaatactgcatttaggccttttatgttcaaggttaatattgatatgtgagaatttttcctgtcatagtgttgttagctagttgccttgaagtttcatttgtgtaattactttttgggatctgtgatatttgtgcttacctgtccttttatgatggtgagtattatccatccatttccacttttagaactcctttgagtatttcttgtagggttgatctcatagtgataaattcccttagtgtttgcttgtctgggaaagacttaacttatacagtggtattggcaaaattaggcaaatcatctttcctatcattttaactcatttcaattctcaccactctcctcttctatttacaataacaaatagaatcctctgttctgatttattcatgtatagattttgaagagaattctgattttgatgcacgttagaatacgtgaaagagcaaaagaagcaagtgaaaaattttgcagtgacatacaagaaaatgattcagtcttaagatatctgcattttgaataataatgtacttattatggttacatttaaatttactatcttaactgccttcatttgtccactcactgttctatttccttttttttcccaatcttctcaataattatttcctagaatataattttatctctactattggatttttttgcttaatttttttatggtcgggttacagtttaaaatttgcaactttatataatcccagtgtatcttcaaatccttttatttcacttcatatataatgtaagaatcttacaacagtgtacttccataaccttttattgttttttcctattttcacattatactttatgtatattattaacacaatatatatttttttactttatcccttgtcttttaaataaatttaaaaaattttttattcatatatttataatttctgttattttgtattcctttatgtaaatggaaatttccttctagggttcttttctttccatctgaaaaacaccttgcagatctagcagcaaattctctcagctattttgtcctcattttaagaacagttctgccagatagaactttagtattatagtttttattcctatcaggtcctccaaaatggaatttaattgatttctgacttaatttttgatgagaaaactgtggtaatctttgctcctatgtacaaaatatgtattttctcctctgactactttcaaaattttctttttttcactggtattcaacaatttcattagaaaatactttggtatcgttgtctttagatttatccagtaaggttttttacagatcttgaatcagtaagtttatttgtttcatagaatatggaatttttttaagcacttatttttctctctttttgaactccaatccacgtatgtttaacatcttgatatttttaagctgtttactgaagttcctgtcagttctcaccatttatctttctctcttcttcactttggatatttgctattgctgtattttctctgatctcttttgaatagtgttaaatcagctattaatcccatccacagaattcttcacttctgataattgtctttttcacccacacaagttcaattttttcttttatatacttttcatttctctcttcgttatttttatgcttttcttttaattttaggcttgcttatattatctccacctgctctttcatttctttctaagatctttttctactaacctttctatttattacaaattttagattcttccacatgtctgttaagctttaattggataccggaccttataaatttatgttgatgtcattgttgagtttagtagtctttaaagagtttaggctttaatctgacaagcaactaaagttacttgtggattagcttgtttctttttgaggcatattttaaaagttttccaaaatggcctacttttaccctactattaaaatatgactcttctaatgtctttccttaattccttggttgttcaaaaaagtcttatcagaaccgatatatttccagtcctttgtgaattctgagaattggtgaactcacctttatagctcccacagttgttctttggctggccttctgaagtttttccatatatattcatggcttaatattcagttacactctcagggagactcctatgcagatttttggatctctttttccacagtgctcccttttctccagcactttgcccaagatattccatgtgcctcaattttcccaaacacttttctctgtctcctcgacccagaaagcctattatcactaattatccctctctctacctttcacacctttttttcactatgatctgaaaaaatcctggcagaaagcttggatgatatcataggacatacctcacatgtttcttgtctctgttttctcagtcttgtgctgcctacttttcaatttcagaacacgtttgtttcctatatatgtagacaatgtatgtagttatttactgcagtaggctcgaggtgattttagtaactctgtcatggctgaaagtagaattaagtaatgttttatttggcatatttctaaccattattaaagttaaatatttggttatatctccattcttatgacatcagactaaaacttatgaagaatcatatatttttgtctataatttttaaaaatagttgtttacgtgacatataaggtaaaagtttctggaatccacaaaattctggctgttttcactcagtgtcagaataatctaagattttactttcatttcttcccccttgatgatgcagataacttcaacctcagatttttgaattataaaagcaaaaaagattatggtttataattacagcattacatttttattctgcaatagaaattaaaaatatgtcttttctatttatttcagtgctactgaatctcccattaaaacccccacatgtgcctgtcacttgtttataagccagacctaaacatgtgtgccaattatttgtttataaacataaacataaaacataaacataaacataaaatcttgtatttgagatatatgtgttttatatgaaatagtgaagattattcaaaaaattttaaacataacttaagataatttgaaagacttactttcttctatagaattataaaagcagtataaatcttttgctttagtttgaggataaaatttttaatgaaataatttactttacatttttatgcgttactgctggtcaataattgtctagtgcagcatggaaagtgttcttcctcacaagattgaggttgacagtttagtcaataaaagatcattcttttggggcttatcttgctgacacagcaaaggctcattcttaatgcacaggggcataaatgggaactctgtgccttgatagattcagacatggacatcctctgcttttttattaagcatgtcgaactaatgggaggggattttatctcattggcatatccaagagtctctacttgaaaattaaggtaagtgattttggcaacctaaatctgatgactgctgtggagacagaaagtgattgaaggcagttctagctttgattaccctatagttttagaaaagagaatattgactgggcatagtggcgtgcacctgtaatatcaggtaattaggaagctgtggtgggaggatcacttgagcccaggagttagagaccaggcctgggcaacatagcaagattttgtctcaaaaaaaaaaaaaaaaggaatgacaatattggatatgaaacaagttattattctatcatatccttcctaattataaagtaaaaagaatattttacaatggcatagccaatggtcaatattaaaaaggagagtgtcacatatttgaccacaaaataaagaataatcagtgattttttttcttcaagcgtttacttgcttgtttaaaatcaaaacattaaaactgtattttggactgtgaaagtaaacaatattcatttcatatactgtgaaatttttatgttagtttctttatcctatgaatataaacaaaaaaagcactgaacataagcattactgtaaagaaattgtaagtaaaatgtgttttgattactacaaaaaattgagttttacagttaaatatttatatttaatttcaggctgcatgagaacacatggctggaatttagaaaaaacaattgtgccaactttgattttgtagacaaatcactagctgaattgggatggcagatgcatttgttttatgtggccaaaattgaatgccttaaggtaatacatttgctcttcaggttgacacaggtgccaccactccctctagcacacagtctccagaagtagacagtttaaatttgaatgccacacttcttgcttacatggcctacacctcactatacttatccataaggtaatgaaaatcacagtgcctaactcatagcattttttaaagattaagtaaatatccagatctagatctagacctatctgtctattgctggagacaaaatctgacatatagtaagttctcaataattgtaatagttgtagtaagagtaagagtaatatctggtctctccacaaatacgtcttacctccctggcttctgaagacatttgaatttgtgactgcaactctaaaccttaattagtcctttgcactggtccacagcaaaatgactgttggttattgacagaactcctgaccaaccttcatgttagtttacagtgcctatctctctcattgtaattccaccaccttgactgtcttcttgttcactgaacttttgactgtacatagaaggtgacaggtgttttcccagaagtgataccaaccacttcacacagcttttatctgacagtttttaggtctttctgaggagaatttatgacagaaacgccatcagacaagcaggccaacagttgcgtttggcgtaattacgcacttccttgagggaaggaaacagtcaatctcacagtttttagtcaggctgacactatccacatattttgcaaggtacattcacaaagttcaagtagttgattgactgaagctgagcaggaaaggctaaatgtcaggcttttaaggtgaaactagtggcagctctgtagcagcgtggcaggtagagtgaagtctggaattaagagtgacagacgaatggtgggtggtaaagaaaagactgtgtttgctggcagagaaggaagttgggctgtgctcagagcattcatggggtttgattagtgatagaaaggctaaaatatatacagatttaagtgttcaaaattatcttaacattccaaagaaaaactgtcagaattttactaaaataataacttttaatccctttacttttaaaatgttaatatgaattccccttttttttaaacagttttcaagatgttgagatttttgtctaaagattattgtacttattgcattttgtcactctagtctctgctttaagagctagggaaatgtgagaaaatataaattatatcttaaaggggcagagattagagtaaatacatttaaagataatgagaaaattaagaaaatttgtgaaaagttttgattcatcatatttttgtgtgaaaatgaaaaagatatcctaagccaatcaagattttgaatagtctaacaaaacatagtaaatagagcacccttaacttaataaaataaagtatctaatgtgacactggcatgggaaacttagggtattgcttttacagctggaaacctctgtggctggtggtgcctttgcctgagtttttgcttcggcccactgggcttgttccacccactcagcctggcaagtgcactcatctcatgccaccagtccagatcccatgcctgccaagggtgagccaggcacagagtggcaaggggtgcataagtgagtgagcaaaaggtctggccactgcacacagccatgcacactggctgctgcagtgggatgggcagctctgggtgctagcacaggcactgagtgcaagcctgcagctggattagatgcaccataagcggcttctgctgtgggtgtctacatctggacaaggggaatgcagtggtgcccagaagcttagagctgcaaccacagagctccaaagagggtgtcacagccctggctcagggatcacctaggtctgggctcccaaagggctgcagctcttctttccttctagttgcctgcaatgtggcaagtcaggggtgatgtttcagccctgtttgtgttacagctttttcagttgtcccacttccaggaagaatgaagtacatggacaactggtaggtgagaaaggtggagaggagctttattgcatgacagaacagctctcaggagacctgaagtgggtagctcattttcactagcaagtcatccagagtgtccagatctcagcagaaaggagacccaaagtgggtagctcctatccacaggcacgttgtcctgacaagtctccagctctcagtggagagatgaaccacagtgggtagctcctttcacaggcaagctgtcccaacaagtcaaggagacctgaagtggttagctcctttgggcagctgttagtcttaacgtctgtgtgagtctggctgggtctgggggttttatgagctcaaaagggaggaagtgcatgctgattggtccataggcggccatgggcaggcccagaaaaagcaccatacattctcactctgggccacagactccacgtagaactgatagctcggcccacaggcttcaggctgtccccagcttgaaggtggggcttcaccagggaccacccctttctgcccaggaggctgtctgcttcctcccaccatcaacatgtcatccatagtgcccaggctgttcatgtggaagggtgcctgcaggcccatgccaagcagccctcagcccccctaggcctccctcccatgattattggtgcccaaagtttggagggggccaaggcagcaggaggcagtcttgttggcaccaccccaagcatgcacacacgtggccaggttgcaacagcacccaggcttggccacaactttgctccgcccactcccgggcaccaggagtgggcagaggacaggcaatgggagcaggccctttcaagactgtgtgggcaaggggcttcctggattcccaagagtgcagggatccctggtccagagtcatggctggtcagctgcagctgtgcccaggagcgtggggctccagccctaatgacttggtagggggcagagctcctgcctgttcatggcacttgctgactctgtggagtgtgcaaccctggctgtgcctcctctgtgcaccctgcatcttagtaatggtggttccagacagggctggcatcagcagtaccatcagctttactgtgcatgtgtttttgacaccaagtcttttttgctttcttattttggaatgacaagcatctcaaagtcattattttagttacttgggttatataaatcattggataaactaatatctatcttctcactttttggaattggagaaaattgtggcaaaataaaaattattaatcagattctatactattttctttcactagttttagtattttccaagataaaataatggtcagtctagtgctgtcacatagataaacaatatgaatcacagatatgagctaccattacatttaacttttcttaggaaccaaaattaataaaaatttaagaaagaaactgatgaaattaatcttcatagtgtattttatcatgtaatcaatataaaaattcagatatccaaaatatcacttcaatggttaattaatgtaaaattattgagataattttacataatttttggaactgtcttcaaacacttgtattttatacttatggcacatctctatttgattgatagccacatgtggcttgtgttatcatataagacagcacaaattgggatagtttttatcttcattccattcatttattcattatgtgcatggaagtcaacaaatgaaatattaattaatggcaaatatatttttattgtctatgtcttaatccattttgagttgctataaaggaatacctgaggcagagtaacttataaacaaaacttatacatgaaggaggtttatttggcttacagttcagcaggctgtataagaaggagggtgctgacatatgctcagtttctgatgagcacctcaggcagctttcactcaaagtggaagataaagtggaccagcatgtgcagagaaaggaatggggtgtgggagtgccaggctattttaaacaaccagctcttatggttactaatacagcaagaagtcattcacctggtgaaggatccatcaccatgacccaaacattgtccattaggtcccgcctgcaacattaagaatcaaatttcaatgtgaaatttgaaggagacaaatattcaaactatagatattttcaaattattttcagtaatattctcctttcgggctaaacaatgtccagtaatagtaatgtatcttattatgaatattgtttaaattactaaaaacattgctgcaattactattgctgcataataagtcaccccaaattgtattagtgtaaaatcaccattttattatgctcataaattctgtggtcaggatatgaaaaggcagagcagaggtgacatgtttctgctccacaggttctacagccttgaaggtaagtcttgttggctgggaatggctcaatatctgggatctagaatcttctggaatcttgttcactcacatatctgttgcctaatctgggttaacttaaagacaaggatggccaactttaactacatgtggcctctccatgtagtttgacctcctcactgcttggcatctgagattgaactttccatgttggggctcaggactccaagtgcaagtgttgcagcaaatatgaccaaagttgcattgccttatcagactgtgcctttgaagtcacacagcatcatttcgatttccttccactggtttcagctaagtcattaagttcagttgttattcaaaggaaggtgacatagatcttccctctttacttaggggtcagaattttagaacatgttttacaatgatcacacaacttttctttctgaacactttgcttcacaccttctcatatccacggttatgaattctcctgactatatctattgtaacccaaaatattgactgtactcagagattcatcagagatttcatgtctatatgcccagagcctgatataatgccaccttattacacacataatatagaatctgaggactacgttaactgatacatgttaagtatcctgcagagagctggcacattggatgtgctcaataattgttagctttaagtatcttaaacagctattattataatgataagtctttgttcatgtttcatctccatgacttgtcatgtgttttgctctgattacattacttgaattcttgaagcctctgtttctcttttgtaatgtaggtaataatagtatattttataggatattaatagtatatcctataaaatgagataatccaaataaagcacttactgtagtgtctggtacatagtaagccaagtatcttatgaaaatttgtctagaaattttaactgagacaaatttctcaatgaattattctttttaatcaaccaagaggaggaagtagtaatttattccaaacaatagataaagaaaaattctggccagtttaattctgatgtattttattacataaggtcatttgtgttctggaaatagtctgagactaattaaaatcaagtaagtgtccagattgacaataataatcattgggtgtctattggaaacatttataattaattaaacaaaattaggattgttagctattttcttacatgtctgattcttaccttagtacagaacattaagaacaaagttgacacaaagttatattgtcattctcctatctatatatttcaatatattcaagtccttcctaagtggttaagaaattgctattcaaatgtgtttataattttatactccagtaatgactatcacagtttaaaattggttaattttacctataaccatgtggagagtatttgaatggtaatgagaactactgttataacaaacgtaactcatttttgtttaaattatacctttattttcacaacagttcaaatgcatgatctgtaatgaatcataccatattggaaacgctctatcaggctggtgtgttagctgcagtctttccccactctacaatgtaactgaaaaaaaaaggccagatattccacttaactaaatctaacccttgttgaaggatctctcattcatgatttttttcataccacccacttgatttgtatttcaaatatgcagtattttctgggacattgttattatcttcttacatatggttcacagatgatattaaaactcttcgaaagtctagatgaagcaaagctgttagaaagcatcactgagctaagttaggagagctgggatctagtatctctccattgctaacaaaataactgattttaggcatgctacagaccccttcaggatgatttgctctataattgttggtgtggtatagaatctataaggtcaattacctacaaatgtatttaatttcataaaatatgctatagatttatgtctcatcataatgaccaatgttaattttacaatgcttttataaactaaaagttagatatagtttgggatgctgtgagatactgatttaaattcctttattcttaagtaatcaataacattcttgacttatttcctgactccatctatctatacactaagatagagctgccttagtaacagagatcgatgatagtgatttggatctttgatttctttgtctcttcattttcctggttcaaaactgacacaacattttctttaacttctgataaataacagtgccttttaaataaaatacagtaatgttagtcctcttgtccttcagtgaacatatgaacttactgagatcagtatcatggatgattaggttaagaatgatttgagattggtgagttggaaggtttccaaaactaattgttgaattcctgaatatgactaataaaattaatgagtgagatctgtgcctatgtataatattatttcactttgataaaaaatggatcagataataaaatctaacatgttcaggcacaatgcagtgccatacttagtctatttgtaaacttttcagtacagccaagtgtattcaataattttcagatatcatgttcctaatacattaaacttaatttaataaataatcaaatgttagaatgtatttcagtaatttttggaatgactaagatttctagaagtccagtaaaatttaggttattttgtattaatgaaaaattaaacagcaaaattgctcagtaaactctttgtatttactgtcagaccttacagggaacttaaattattttatatttctggaagagtgaaggagacatccctgcacaattataaaatatattcttaaaaaacacatttttattatatagtatatgctaggcactgctaggaggctaaggtatcttgcattattaaatccttgcaacaacgttgagatgtaagttattataggactgtcataaaaacagaggcttaggaatagtgaaattattaacccagtttagaacctgaatatagccaatgattttatgatttagtatgaccacatatttgatgatagtggaatatttttaaatttttttattttaatttctgtgggtacatagtaggtgtatatatttatggggtacatgaaatgttttgatacaggcatgcagtgcataataatcacattatagagaatggagtatccatcccctcaagtatttattttttgtgttacaatccaattatacccttttagttatttttgaatgtacaattaagttattgaagtccatagtcaccctgttgtgctatcaaatactagtggacatattttaattggaaaaaatctggatgatataagaatagatcatatggcagaacatatacagaggaacttacggaaacaaagtaccacattcccacaccttttaccatttttaaattattgatatttaaggccaggcgtggtggctcacacctgtaatcccagcactttggcaggctgaggcaagtggatcacgtggtcaagagatagagaccaccctggccaacatggtgaaaccccatctctactaaaaatacaaaaattagccaggcatggtggcgtgcatctgtagtctcagctactcaggaggctgaggaaggagaatcacttgaacccaggaggcagaggttgcagtgagccaagattgtgccactgcactccagcctggcaacagagcaagactctgtctcaaaaaaaaaaaaaaattgatgatttaatagctataacattttatttgttcttagtcctttaaaaagttgtgaatatttaggtgtgtcttttttacgtttctttttccattaactaatattattttataataagaagacatgcagaaacaacagaaactttgctaacgcttgtgttaaagatgtgggatccctaagttgagaaaaaaagaaaatgaaaataatcacaaagagataatagaactgctaaaacataacttctttccatctcttcatatcttcttaggatcataaagaaactgctagtcagatgatttttctcttccactaaaagctttttatgagtggtttgccctagagcagccctgttctatgccatattattcaatatctagggtaatgcaacccttgtttctgcctcactagctgttcagtgattaatatattcagggtcctcacttgacgtgagacttttaggtcaaccttctcccagcatatgtgcttgagtccttgtggttgttatgggtattttttttaataatggtgataaattgcattaagtaatttagatctctcactttccttttaagtgtcaggtattgatctatatgccatgatgtcagtcattctttccctgaatgcattaaccttctttctctatgtttgtgtctgatctgcctgtctagtttggaataaaagccctctgggaaaagtctaattcagtgctgtgtatattcttaagtgattgtgtgagcccattaaatgtttattaataaatataaattgtcaacattattaatatttattactgattcatagtaatgacaatagtatacatgaattatgggaatcagataactagatctaagttttatttttgttaataaaggaagtacagttaacgtgtatatacaaatatataaccatataatatgtatacatattcaataattattgtttttcatgttcatattatagtagaaaatgcttcctcagtgactgttttacatttcatttaaatatactttactcttaaacaacataggcaaaatacaactaaatgttgtttgcattgacattgtagttaatcccaaaatgccctttttttatacattaacaaatattccaaatgtgctgagcactctgctacatgttggagacaaaaggagaaacaaaaaatggcccctctcctcaagttgcccaacatgaaacatacacacaagtaaatgggtgcttgcagtccagggtgccgaatgctgagactgggatcaggcgtggaaagttcatccaagaattccttaaaaaacgtgatgtttggccaggtgcggtggctcatgcttgtaatcccagtactttgggaggccgaggcaggcagatcatgaggtcaggagtgcaagaccaacctgaccaacatggtgaaaccccgtctctactaaaaatgcaaaaattagctgggcgtggtggcacacacctgtaatcccagctactcaggaagctgaggcaggagaatcacttgaactcaggaggcagaggttgcagtgagccaagatcatgccactgcactccagcctgggcaacagagtgagatgcgtctcaaaaaaaaaaaaaagaaagaaagaaaaatgtgattttcaagatactctcctgatttcagaaaggcactgtccttgttaaacactatcatgtactaactaaatgcaagcttcaaaagaaccttagcagatatttggtttcaattttcatgtaagaaaatgagaacttagagaaatttgtgattaatttatccaaagacatagagcagaaatttcattccaagtctgccaggcacatcaaggcttaaactctggctgtttactaatgactctctatttaaagtcttaagaatccaataaatcagaaagtgtacttggatctatgtaatagaaagtcttctgtaatttcatctattaaggatgtataataaacctacaatttgagtgactgatacttaggatccacagaagaataacaactaatattcaaatgcttagtctcacagctactacagttgagctagtacagttgagtttgaaaatcatactaagcaatgttttcccttctcaaaaaactgcatgttgctgatttctatatattcctagggttaaaggtcaatcccatatacttattaaattaaaaaaaaagtctcatgaccctaataatagtctaaacttattggagaagcatgttcttttcttctacttggaccaaccattgctaaagcaccatatgattttttgtgtgtgtgctctctacatcactgttagaaaatgactcatttggttcattttttctgggtcaaagagcaacatgggtgtctcaactgtccaagcctaaaatattgactgctactgaacgtatcattaaacacaacattcagtaacttcagccctggatttcagtggcagtactcacacttaagaagcagaaaggaacagacatagcccagttaaatacagctagaacacagggttatcaaacgaacctacattaaaagtggaccttttcttgacacattctggtggcaaaactgagatacaaacttttcagctaaatgttgctgtagtagagtttatattaatttctagaatttcttgaggttgaaagcttttttgaggcgtaatggcaagagagtaagtcctagagaattattcagttcttgaggaattgataattgactttaacttacagttcattatccctttacaatgatcatattgagtttcacattgctttatcttatgtattaaatgttatttcaaaatatgttttccaaattgtgttccagtgatatttgttctataagatagcagtttatgtagaaaaatggaacaatgtcaaagaattctggggaaatctaagttaaacaaaaagtatgttgttttaataatattttatagagcttttcattccccagataagagttattctacagcagcatttctaaactaatttgatcagaaaacctcttttgattgaaagccaaaattaaggattttttggacaaagtactacaatatgcatagcatactgtagttactaaaattttaaattaaatatttatatgaattaaaaacatgtaaaatacaaagagctgttgaatgagactttccatgtgtctcagtttattgctgaaactccaaaactgagagcatcagattatgagtagcccacattctactaaggatggctggacacattcacaataactgagtacatgatgacatgaaaatgggtatgctcagcaatttttagccttcctcgagcacctataatagaaggccaaaaattccaaaggatggtagcagagtgctgtggaagtagagttgtcagcctcctaaagagtatgatggcatttcatattttctacccacacaccccacacataggaggtaacctctgctccctcccctaacccaagagaaacattgacagaactttggggtttgcttgaaggtccagggtggcatcactctcctcagctggtgaagtgctgggctgtagaaatgtgtaggaccagtatgtgcatttcaggggagttaagcaagataatttttgagacagccttacctaggttgttaaattaaggaatgtacatggacatctgattcccctgtcacctttttgccaagctgtgagctgttatggtaaaacacctttctttatgccatgataaggaaagaaatctgtgtttctgcattttcagattatgtgttggctcactcagagggcctacctaataaggcagaaagaagccataaggtatgccactggaaatagttgccagggtgggaggtgtgttcgggtatatataatgcacttaggaaactgcagtactatttatgtgaggtgtgtaacagagcaatgttctctgaagacatcacaaatgtgactcacaaaaaagccagcgtttccagatatgccatggtggagggtgtaatgctcagccagtattaatgccaagtgagaattatagcagaattagtacataagacttttgatgtctacctgaaattcctcttccactgcattgaccctggaaaaaccaaaagaaataaagaggtggaaggagagctaaagactgagccaaattccctcccactgggagtaccagaaccacagccagacctcaaatggagggaaaggaacagcagttaactgaatgtaaatgcgaatattaaatgtccccaagactggagttattcataaagaagagaggtgttttttgttttgttttttattctttcccctgtctcccaacataggacttgttttttttttgacatggagtttcgctcttgttgcccaggtggagtgcaatggcatgatctggcctcactgcaacctccgcctcctgggttctagcgattctcctgcctcagcctcccgagtagttgggattacaggcatgcgccaccacgcccagctaatttttgtatttttagtagagatggggtttcaccatgctggtcaggctggtctcaaactcccaaccttagatgatccgcccgcctcggcctcccaaagcgccgggattacaggtgtgagccaccacgcccggacttgttttaaacatcaatagtgattatgaaactacagaatctcaatgcgatgtcttccaaggatctgaaagggattcctgaaagaaaatcttaaacatatggataggagaaaaatgtagcttttttcttactgtatcctgttagattcagcctgtccagtaagccagttacagagatcatgtttaatttccaggtaattaactttatgttgaattaccagattactgtattaatagattaaaacaatacaaatttactaacttactgtgagattaattacatgaaaaccattgcagtagcatatatttcatatgtataatttatatgaaatagcttatgaaatattaatgaacataattcactgtgaaaaatatattttagaacttcaggttatgtatcaggaaaatacttttaaatagctaatattatactttattatcttaattcatagctaaagtccaattattatattaattattttcagctgatcatatctggtaacatcagaaccagagggcaaatgccaacctaaattaactctctgtgtcacattttaagagaagagcaataagaacgctaaaaggggaaaagaaacatatgaatgtgaaataaactcagccactctgttgtttaaaattattaaaaagtcatatataatatttctatatcatgtagcttgtggcaaagacatcagtcatcacattatctgtacattgaacatgataaattgattgtgttctaatgagaggatctaattactcagagaaatgaagagggcatatgaaagctttttagctccaatagccatatattatcattgataacactgaatctggtgtggtttaattcctttgttctgtacattttggaagatataatcttcctaattcatttctttaaagagacatcagatcatcaatttatcatactcctaaaaatagcaaaaggaaatatcacaggaatatgaaatctgtgcaatggtcatcagaggttttgtacttgggttccaccccgcccatgccaggctttgctaaacttccacaggtagcaaactaaagcttccacataattattgtttcaaaatataattgtaaaacttattcagtaatttctacaggatatctcatgatcataaaattatgttggaacccttctatagtcacaaagtagaatcaagattcagaattatctcaacagtgtgtcactcaaggtcaaaataaacaagatgaaatataatagcagaactgaaaacttgtgtatttgagtttcaatgatcatttgttcaaacgtagcataaggagatataaggtgtgaaatgagtgactgaatgagctcattctcagttgagaaggaaaatattgcacatttgaaggacgctcatgtggaaggaggattagatctacaggcaggtgaacctatggaatttaccactacacagtttttaattcaagaaatagcatgttaacaaccagagctatcaaataatggaattgactgctttgtaatggggtgagttttcttcctggtgtccttggatactgccaagcaataactgtataactatgtcgggaaagttgattatataaaaagcatttctgcagtcaaacctggaagtaatgattatatgacttctaagctgtctcctctgactttaagacttccagcttgtattttttttcacttatgtaacctttcaactctctcactggtatttatatttcgtcttattaattataggcataattgcacatgtctttagttcctttatagatgtttttctatataacaaattttataagataagtaactgcattgtttttatattcttctcttctgtgggaagtctagaagccttggacttagaacatgccgaaagcatttgagtgtatggtgaaattaatacaggatagtattttttaaaatagcatataagagaaatatttattatagtattaaaataacattttcctgagttatctttcaaaaactgtgaagagtctgagtttttacccaactggcatgttaacaaggtaacgtaagtcagttttatggatgctgattgaatacctgagacatcagggtcagaaggtaccacagtttcgtggatgttaacagaagactcaagactcctgagataaagaaaaatgactttattatttataatacagcaaaaagcatagacatcagcatgtttgggtcgcttcgccttgccaccagatctcaggggtaagatgcagatgggcccagatagtgcttacacactcagtaggttgcattacagaagataaacctaagtttgcataaggaacccaatttttaaataacagatagtaagcacactttccctcttctccaagggagaaaatatctattatcctgggctgtttgttataccaatatccttggaaagatggtccaaaacaaaattaggtcattgcctttctcacaagacatgcagaaacatgagagagccatggctaatcgtctcccaatatcactcataaaatacttctacatcgtgaactgaagagggcaggacttgagccagacctggtgtaggactgtgtgatgatgatggggaaaaagaaagaacacggaaaagcaaatgaaattcacagatccagtgtgtcgaagtgactttgaaactataatttacctttagttaaataatctgtatctagaattggcagtggctatatattgatatctatgatatttgtggcttttatttcttgataggacgcctgattccatcttcaccatagctcttttctttttgttgttcaatgtgaattttgtactatagctcttttatattttattgtttctatgtgccccacacatgagcagctaaccagtgcattttggtttattttttggccaggcgattctaaccaggatgggtgacttaacagaaaaagaaaagcaaggacaatctacataacccataaaacccaatttccaaaaggccaggtcctctatttaacattctcataacttgctctgtttccataccgcagggaatagcaattctgtttaaaaaccataaggaaatggtagcagatattatcagaaatatataccaggacaggacccttttttactttaaaagttttaaagataataagtttcctttcaaaaataaccgtgctcactctcttcaggaataaccaaagctttcattttctttgctttctttcttttttatttttgctgtcttttgaaaggcaagacttgtagattgatacagatctgtctatataagatatccaaaatatatagtttaaatttccttaaactctgtggaagtttctgccataattactaattttaatctcaccaaatctgttgttatcattaacaccaaacactatttataaagcacttaattgaatgtgggcctgtgaatactattgagcaaagctaattaatgcataccaaaattaagtaggctattataatgggacatatcccacaatagtacatggaacagaggaaatatccaccaatttatggttaaaccaagaagactgggtttataagcacaaagcataaaaatgaaaagtttcagaaaatgtttcagtaactatgaaaataaatgaatatcatattttctttattaaatttattagttctgccttcattactctcaaatttgcacacaaggataaggatattgcccactaatagataaagttatctcatctaatatacacatatttagcttgaaggttgtttgagaatcaaatcactaagacaggcttctttgggtgaatatactgactgcactggtgaactccaaaagtatattagagcaccagcattagactctgtattacattacaacatatgactgcttttttcacattacctacttatagtgcatttctaagtacattagtttggatcttatctttttaatctttgtatatggtgtaaggtaggggtccaaattcattctttctgcttgtatagtcccttcttcaccaacaatctactttaagctctcccctgtatgtctggtcttccctatattgtgagttctattcactcataatttgtgatttcttatagtttctgcagttcaggctttcaggtcttccatattgtctgtgttcttcttaagccttcttagcttctgttctgtcaactgataaactttcctcatgcgtcgccaatcttcaatttagagtcctgaataaaaaatctggctgacactaaacactgtgatctctatttgggaagaattttcaaaaagatctctagtggcttatcaattggcttttgtccagtaggacacaggctttttgcatttaacctctaacagggtatcatatgaaatagaatgggatacttataacatgtagccatgtgccttctcacagagtagaagactttatgaaggtaagccttagctgtgtcaggcatttgtggttttaagagtccagtgtaaatctctgtacataggccatttataatttcacagattgtgtcttttatctccaagttgattcatttaaagcagaggtctgaatagtttattcattcttcaccttagacctaaaggaactctgcatatattcctttggtacgagataaaacttctcctttgcaaagtgaacaattacctccataactgcctaaactcaggtctagtctctcttttgtccagatttaacacaccattatatgcactgcccttcctcagaacctttccacccacttgtttatgatcatcttccttgtagctttgcctcatggacaactatttcttcactgcctcactcatagtagcatttgtgtccactttaatgcttcttgtagctttttccacatcagcttccaccatgttttctgtcctactgatctcaacattttctatttagcctcctttacctgcatttctctacctaaatcctcattcagttcatatttctggcttctgatttcccatcccactttaagtattatctgtccatcaaccccaatgcctaaaaagcattaacatctctgaaatatgtattttcacttaatagtgtagttcacttttaggaaataaaagtcacagtgcagtctacaataaattagacaaaataggatattataagcaatataatcatgttgcctagcatataaggatgtattaaaaacaacataatttattaaattattgttcataagacagaaatgttctttcttttttgatccaaagtgagaactttttaagggcttattttataaacaagattgtactgaaattcatatatagataaaaatgaacatgatttattatgaacaatttcagtattcagcatatttatattgttattaataagattgggagcagagagctaaagcattttactttgccttaaaaaatgcaccaattatcagcctgaccattttaatataaaaaatgtttatattatagtataaattattaatcaatctgccacaatcattactttagttaaaactgaacgtacttgtggctagcataggaaaggagacattttcatgttaacgtgaatttttttaacctaaattattgcagcctattgatcctagatctgaatcttcaaagaaaactgatttatttcattaattggaatattttaaccagagaagtctatcaagttggggtttcaacctgaatgaaccttttccatttagaaaattgatcttccagtcacacttttatgaaccttgagcttttagagcatggttgcttttaaagacagatcatctccagtaacatcttatatcattgacaggttggagtatggatgttagagcaaactaagtttgtgatatataaccacccacatacagacaaaatgaacaaggcatatatttaaatatgcaagctagacaacatgcagagcagtgagtaaggagtaaatactgagtcacccttagaacataatatatgctggtaactaaaaaggtgggcacggggcaggaactccataaaaataataattctgccatgatgtcttttatttaccaaattacatctccaaatacattgctgtaccatctatataaagaattgaaagtgtctttgaacacaattacttgtgttgcctattgactcattaagagaagagcattgttggaatgtgatttacttagattaacagtggtccctacagttaattgggcacagagtgaatatctcaaagtgaacagctcacaaagtactggaatatttatcagagaactaaatgactgatgtacaatgagtctacttgttagagtatctacagtgtaggtttggagtcccaaaaaacaagatttgaattctggcagcagcacttaaagccatgtgcccttgggtaactttaaaccacctttagtttttaaaagtgtgaataacgggcacttttaagaatcttaatgttaaacaaaatgtttgaaactgttctttcaaaaaaggaggccctctacaaataggtcacaataaaatatgaaacataactgacaagggtcatagaaaatccattttctagcaacattattttttcctctctagaaaatcacagagagtgaagttaaaaccataagttttttttttttttttttttggcatccaagaaatcagagcaaatgggatttgtagtatgagcctgatcattaaggcatgcatctccataatggaagaaaaccacacgctcatgggaacagcaggcaggatcctgagcaagagtaagcccttccagagggcaaggtgagagaaacttgcattccttctcaaaccactcattctttcctttctgagcaccaaatttcaggtgacacacacacattctttaggcatgatatgagatttgctcagctaagaatttcttagatattctatgagtttactatcaaatggacaagaaatcaactacataaattgtgacacctaagtcacaattctgtttacttgagctcagtgtaaattttgagaagatgtcagggtttttggttctacataaatatattgacactcaatcaagtcattattggtgtgtccccttgcccatttatccaaattgctgctgttggcagttttgctttgtattcccatcactatctatacttcagttggtccatattttagctcttcaattgtgtgagttttttctcagcaactgccatatttgaaaaccatatccctcttctgtgtcgcaaagacttattatgcatgcttctctgacacctggttttaaattctcaggaaatactggacaggaaccatcagtttttcagggttaagagaaaccatcttgtccagcaaataatcccttctttttcttttgttaagctaagcctcttgccaagaaattctaatttaagaagtctaatttgctggtcttagctgtttgattgcttctggttcccctgtgatgagtctgtggaaacaagggccacagtgaagtcaacccaacccaaactgcagaagtgagttacttttctcagtgtctgtggtttgtcttcaagcgcctgttagacacctatggaaaatttttcctgatctcaactctcctggataattctgaatcagctaattaggtgactagagaggtagcaaattcctgggtttacaagcatttttttcttccattgattttctttgatttgctcttgctctaacttctttccttctatcctgggacttgatttgtatatagcaaatatgacaaatcttactgatatcaatagagcagaaagggggaggctggtagagtctctctgttacttaaagaagcaggatgagggtttaggtgacaaaaaaaatgatagttgatagaaaacaagaggctacagattcaacagaatatatgctttaataggaaaacgaaccttttaaaagctagcttttctgaggaaggaaaatctaaaataatgcaagtcatctgactaagacagtgaagtttcttcacttctcacaaaagcaagaagaacaggcagaagtttttctaaagtaatgaaacatagtccagtggaataagtcctttatcaccgtggcgcttagtttcctcaaaattctctgaatctatcattttatgatttaaggtcctaaaccagactttcttccccaattctctatgatattttatggcaccaccatctacctagtcattcgctccagaaaacttacatagattttgtgattcctcccttgtgctcacctcttaattatcaaattctgttttattgtccaaacattcttgatttttctccctcctttcaagctttactcccaatatccttgttcagcctcacatgagtcctatactgactgactgaaatagcactgtaataggtttctgtgactccagtcttgtctccttcaaatccatgctccatggatttcaccctaatgatgtatctaaagtagggatcagcaaactatagcttacaggacatatctgggcttctgttcacttttgtatggtccataaacccccaaaaatgttttcttcatttttaatgatttcaaaaatcaaagaggaataatattttgtgacacatcaaaatgacaagaaatttaaatttcagtgtccataaataaaggtttattggaacacagccacactcgtttctttatgtcctgtccatgggtgttttgtgctataacagcagaattcaatagttgcaacagagatcatagaatccatgaagtttaaaatatttaatatctggctctttacagagaaagtttgttgatccctgctcttaagcacaaagactattgcatcatttctcgaatcaaaatattttactgatattctgtcacctgcaggagaaacctagcctcctgagcatgacatacaaacctctgctatctgagccctattctctccagcctcacccttgtttatactgttgccttgcactagattgttctgctctgccttggttcctatgcttgtcttcatggaatgccttactcctccctctttatcatgtaactttcgcattacttatttatttttaggggcagggtcttgctctctcacccaacctgggttacagtggtgcagtcataactctcactgcagccttgaactcctgagctgaagcaatcctcctgccttagcctcccgctacagatgtgcacaatcatgcccagcttgtactacaggtgtgcaccaccatgcccagctctgtttctcatttctgtagaaggagtattgagatcatctcctccagggaaactctgtagacctccatgcagaatagtaagtcctccctgacttctcttgtcctacataccacattattttatgaatatcgatttgtgcttgtgtctaaactgcaagctctggattttgagcccatcaatacttggaaaaggatctcattttttttaatcctcagcaaatatcattgtctcacacttaatagtggctcaatcagtgtttgttgaataaattaaaatgtcttatatatatctcaactaacaatagtcttttaggtttaaggaggactttacataatactataaacagtatcatctgataacaaaaatgtagcattaaaattatttgtaaacatttctaatcttttctactatgaataatgctacaataaatataggagtgcaggtatctctttaacattttgattttcttttctttggaaaaatatccagctggatcatatggtatttctgtttctagtttttggagaaacctccatgctgttttcaatagtggttctctctccacgttctagctagcatttgttactttttgtctttttgatcatagccattctaattgtgatgagatgacatttcattgtggttttgatttgtgttttgctgatgattagtgatgcggaacattcaattttggtatgtcattacaaaatatctgattttcagtttagggacactgtaaaacatataaccttaagattatttagatgtaaaaataaattgctctcatagggctgaataacacatttcataaatatttaaacaactctgcttgccattctctttattatcatgtatcactgaccactaaaaatttcatatatgtgctatgattatagaataaattaaaacctcatacatgtgaaatattttatatatttaatattagctagaagaaaatatttagcatagttaaatttagcattaatatgtcatagcatcactttgtacttcttaagtatatatatacaattgtaatttgtcaatatgcaataaaataaaaattcaagataatactttgtatttattttgtaagtcaaaaaacaatataagaaaataggcttcttcctcccatagaagttagtagaataactgtagcaaacatatcactaattaaacattagtgaaatgtcatttttaaagaatctaaggcaatatatatctattgagcttcctaccatggttaaaacctactgttaattattgagatattcaaaggatttactccctttgatcttgctaatgagaaaaaaatatttaattctttaagtgttttatcattcattcttttcaccctctccctcaacaacaacaacaacaatttggattgattcaattgcatttgtaaatgtatgtgtatgtgtttcttaaacaaaggaaattttattttagctatacactttttagatctctttttcttcaaactagttgttccaaaaagaatattttgcttttgttatttgcggagggatgtgagaaacttgttcaggggttagcaggaggtgttttttttttttttttcttctgccattatctgtaaaagtatgaactctcatgacctagcctaatctgatgatgggtcactttctgttttgaatctaatttttatgttgccaatctttgccagactgatcggtaatatcctaagcacatacacttatagattttcacagtgctgtctgtcaatctttgacttatttcatcccaaaacttttaacttgggaatttgctgttattatttttgctttaatattggttttactattttgctttttcccttctaatacagaatagtgtaatgtttaattacattccatcccctaatactcatcctcagttcatcaaatatcgtccttttctttttttaatcatgtgaaattagaacacctctccaagggctaaggtgaagcatttggttctttatatataaatacagacaaatcactgattgtgagctattttctgacatttttggtttatgctagactgtctcttggctggacttatttagtttatcttgtgaccatccactttctgttatttgcctgctgagcacacatttttgcttttgcagcctgtgtagaaaggtctgcactttaaaaagttaataggtaaaaggaggttggtatttgaggcaaaatgttttcctaggaggatccccatagctgacatttgctttccttctagatctcacagactgaatttgcaggcctttgggactctgtgcacagcccatctgttagagcaaagctatgccaagctgatctggatatgactgagaggaatgaggaggggatttttaaaaattacttttatagtcattttctttttctttaaatacaaagccacattgttaggatgaacttgattctgccatccaaggcaaactgacagtgtggtattagaaataaacatcaaacagaacctgttgaaatgtcgggttatattggaaaggtgtcaggtttcatgtcatatgtgtttctgttcaatgatttccatcatgatgctattggttatcaacaataactgaattaagttaaacaatatgttcaggaaacatttagtaagtgcctataatgtataaactatgtggaaaatcttagatatgcaaagatatctgagatgtggttccttctttcaagaagtttgcaaacaggggatagcagagcacagatgtatccagagaataaaataaatgtcatttaatatgcacaaatagcatagttttaatattgatgccacttatatcttagtactatggataagcaattcactaaagtgtgttatgtatgacctacatttaatcttataacaagttatgtccattttagaagggaggagatgagatgcagacaagttatggccccagatatgagaggtcatcaggaggataatgctttgtctcaaaacctgtgtttcccaaaaagctacaatgcctagggaaagcaaagacagagaaagagaaaatcaaaaatgtacttaacagtggggcagatgctggcctctatgagaaattacctagaaactaaacatccactttctcggccttcctgggacagtggccttggaagagtttctgccgggaagcctactaatgggatttaaattaggtcagatgaagctggttttgctctgcttcacctaattccatcttcctgcctttgaacacagatgcagtggccatagctgctgccaccatcttgcaacatgagaaaaaaaaaaaagagaattccatgcatagaccttggctcagttgagttgtgaacatagcatagccagcagctgtcttcctcccatgtttattgttaggagaaaaaaaaactaaagccctgatggtttaagccattggaaaatcagattttttgttatttgaagcttaatggaaacttaagtaacaaaatctatctttaacctaaactattgaggctatgatgctattgtattcttcctctttttcaatattttagcttccttgatttgtataactccacttacttttgattttggaataactgtctggttagtcacactttattttctctgtagactgttctttcacttcctacatcttaacgctatttcccaaagttcccttcttgtctcgtaattttctcactgccttcagcatttgtactgcatactctctcttcgtgacctcatccttctccttgttgttaaagaggcatgtagtgttgccataaaaatgccttaaccatgacatcatatgcagtgacttcccaagctgtatttctagatctttccctcgagctccagactgaaacatatccaataattgcatcaaattcaaaatatccaataactgtttttcatctttccctacaaatcttgttttctaatctattcacttgcccaggtcagaaatctataagtcattttggacttctctagattgtctttttatttctagtcagacaccacattctgttcaattgtaataacccttgactctatttattccatctttatagccactaacttagcctaagcttttgcagtatttctcatctgaattactgcagtcagacccttaatggatctccctccctcagttctctcattccagtcaattcccctacattcttatgagagtgattttccttaatagaaacgtattggaggcatttgtccactgagatccttcaggatttttccagagttttaaagatttagtgcaaacgtttagcatggcatttcctgaccttggtttagttatctaatctcttctgtatctatcctatcacttgcattcatttccatttatccagttaataaatagctattgagtaaatgatatgtatggaaaccaggctaactaactgctggggctacagactttgtcctggccctcgttgaacttactgtcaagtaggagagacagataataaagtcagcaaaataagttcagcctgtgattagtaaaataaagaaaatagatttctgtctttgagaataatggtaggggagagtgatttatattacatcatctgtgaaggtctctctgaaaaggtaatatttaagctgaggcttgagagatgaggatttagcaatgtgaagtgttgaggattgaaatgtcctagacataaagaacagaaaaataaagaatataaatttagatatattaccactgaactgtacacctaaaaatgataaagatggtaaattttatatgtatattgtacctccaaaaaaagaacagcaattataaatgtcatgaagaggtaaagaatctggaagtttctagaagtgatcaggccagtggggtaggagaataaggaatgagaaaggtggtgttaaaatgaactatttgaaattcttaattcccccaaaacatgacacactgactattgcttcttgcttatatgagcttgctattattattgttgttattattgttactttattataattaatattacctaaaaagcttcctccttttgtctttgtcaggttaaatgttactcttcttttaaattcctttgggatttaaatggatgaatgaatgaacaattggcattgtattattattattactataaataattgagaaaatattaaaagagtcagaaaaggagagtgggaaaaaggcctctgaggtaggtgtgagatttcacttggcttcacagtcacaccgtgaggcttacctcctgcccactgtagacaagaggcaggagaagtgaagtaacacattcacattggcacatgagtaagtgaaagagctaggtaatgactccctgcctggctggctgcaaagcaagtgcaaactttaatttaaaaaacagacctaaataataagtaacatttaatctgacatacatggacatttgcactatgggctgcagatatgttggtgttgttatggtttgattaattgtctgggtggcttactgtcacttcatgaaggtgtctgctaaaatgtcacttcctgaaaaatgtttttcctgaacctgtcttaaggaaacttcaccaccactgctctggacccttttatcaggttttttttgtttgtttgtttgtttgtttttaatatctgacaatttctattcactttcctactatttataagagcagagcctggagctcaaaaactttatggaaccaatgacttgaatacttgaataagaaagctaatcatagcttcttccaccctcacagttttatcttaccaattaaaaatgaatggatatttttctccttttataaaattgagtgcgcttctgacagcacagctttagattaatctatttgaatctcttacaataaataatcagcttccatgccctatctgcccaaatattgtattttaggttgcttgtaagccgtgaaattcaggaaagtatactaagtaacatgtggcttattgttagtctatacaagaaagacctcgattttggctgccttttgtttatctcaaccacttttatcttaagcctttgctatctacacaaagggcacatgtcaacacatgcaataaggtagatccagaagttccctccgtgcaactgtgaggctgatgtgaaatgtactgacaactgtccctaaccctggtgccaaaaacatagtcccatctcgctgctgctgccggcagggtgggctgtactttgctgcaagtattcctacatacttctaatttgaatttttgcaaagcatttaaagtatttctgtaaacatatcagaaatacaggaaagcttgccacaccctgtttaagaggttattgtctctgatactgtagtacattttaatagggttgttttccatctattcttattccctcccttaacctcatatcaatttgagatccatcgatgtgtcacattcgggatttgttaccaagagaaacttaactgtcaggtttcctgttcttttttagaagacgaagaatgctctgtagcttttacttattatatgtgatagatgaaggaaaacagttgagtgcaacaaatgtataaaagcagaatggtaaatctttgaaaagctctttggtgccaccatgtggataagatttggtagttttgaaactatgctgggacattctgttcttcaaacaattctacttgcatacacaatttttgttccactaccttcctaaaatctagttctcccattacccttgaaaagatgaatttttattataaagtaaatcaagggaagtctcagaaattgatctgaataacatttaacttttcagccagagctcacttgctctttttttctccctttgaatgtgaaatagggggtaagacctcatttataagcttcatttgaggattttcaataaaagaacattatatctgaactaaatcaataacttttacttgggttttcatcctcatacacagcctcaggcctgagtacctctgcattctaatcaaagaacatcgtctttttatttacaaacattaatatggcttactagaaactattctaagcaatccacaaaaaccaacatttgctctttttgacaaccctttgtggtaggtactgtcatcatcataagcattaccaccaccaccagcagcagattctgtgctcttaacctctgtgctccattcacctggtgctcatttcaatcagccgatgatttgaggagcctctcacttaacactcatgttctcaatctataggctcaaccctgttcagttttctaggtgatcctgactcaggcagataggttctatgcccacagccatggcatcattgtgtacattgggtctattattagtccatttgctccaaacctagattctgtagtgccatgggcatgccctgtaaatccccaaatgtactggcaatctttttctccctccctattgtgttggcccaaccggtatgaactcctgcctcagtaacctagcacaccatttacatactgggggagaacacaaccccggattctgacctcctctgaaaggctgaactatgatgctcgtggctaagtagcataaatatttccattgaaatgcccctgcttccaggttaaacctaggagagccaggtttaagtatagccagagttatttgtgagattcattaatctgcacacattccctgtacaaacagccacacacttgggtccattctgcgagcccctgggccccatcctaactcctcctcagtgcatgttattaagatcacaggaggttttcaacccaaatcagtccagctcttttccattgctctgctatataataactgtacttcttttggtattcccctattcctatggtgctcttgcactctcatacacacatcaagtatctcccctcagtttctttaaaaaggtgccaatctgttccacatttgacaaagctttctctgataattggtctgcagcagagagtttactaatttcttcaatcataggaaattgaatgaatcgttttcagcaaaaatcccccagttatttgagcaggaacatgctttggtcactactgaccttgagcttgtaaataatccttaatgttagtctttggtttcatgtgtgtctgcagaattgggagacactgtcggtacttttttacattgttttaatttaaaaaacacaaggacattgctttagagcctggaaccattctgtgaaaacagaagacaacttaatatggagtctttaataatttagttgaatatatttaatttaattttctcctgaagacatcaatatattttaagtttttctctaaagaagtggagggtctttccattgcatgcacgtaattcaaatatggctggtgtgtgcttctaagtgtctatccaacctgatgttgaatggctgggaattcatacatggacctttgttttttacaattagtaggtgtagtcttgtgataaatgaatgttttttgaaaactgagtattaaaaaggcattaaagggcaatataccatacatatatttgtttaaggtctttatataagggaaaagctcagtgtagtgtagaggaaagatttggagtcatagaattgagttccaattctgctctcaactgtattaacaacttaataatatttttatttcagtgaaaactttttatgtaaatggagaaaataatgctgtccttctagaagtggggtgtgtgtgtgtgtgtttgtttaaagatgataaatctaaagtgccacattcgggactcatacattttaattgttttataatgattatttgtgttatttttaactcaataaaacccaaacaatatctatcttttcttttcctgtgtcttttccagattttcttcttccttctcttttccccccccttttcttcctgcttctttctcccaaaaagcagtaaagtatggagaagaagcaatacatatcacattcttacagaccaactgcttcatttcattttgaccctctctggccaaagtgcatttataatttacagtaatgcaataataaatttaggataatttacaaaggcaattttggttagagtaattaaatatgaactcagagtaattataaattcaaaatgatttttaaactgtgagttagagaaaaatcagcaaaatatttagcaaaatcgtaattcaaaatgaaggaacctttgcatattttcatttaaaatttaaaatcagtttagatatctgacagttttctccaatgtgtcccaacattgcccataggtagaccacagaatccccaatcagtgtcttgctccactcttaaccattaggaaactgcagaaagcagagtaattcggtccacttgggcatctggatcgcctgccctggacactgagcattagagagctctgctctgctctcttcccagcaatattttcctctatctgtatgtccactaccaatgaggaacctattgtgtatatacttagatcctccgcccttcttgtcaacctgtgtttctcaaaccctctggggtcaaggttcatttttctctttactgttttgaggatcaatatgttgataaaaatacaataaaaataaatttctaaaaagacaaaatgtaatttaaaagaaatataagcatctaggtttttttttttttattagcttcaacagacatgtaagtactcaatcgagttgctgtgaagtttctgagtactcagtcaattgctgtgaagtttctaagctcttattctcaattttgtatatatcttgttgcggtctagaaacagtttccagacaagctgtttatggacatgctttgagtagcagtgttctaaatcacactcccaatattcaggccccccgaatttcctgcacaaaggtcccaagccagccacaattgcctagagcatctcctccaggatcattctcccaagagtggtgaaggaatcccttggccctcgggataacctagggtaaactgttggtggatgttgtgggcttgtggacagaacttggacgtatgggccaatctgtccctgcagggagacatgggcacctcatgcaggactgggatgggaatgggaagaaaggggcccaggatcctagcaattcctcctcttaccctcttgctccattcccaggaaacatttgagtggagatgcgattgctgttttgtcagctttttctatatttctgaaggccctgttgttccttgagcctggactccctggatctgctagactaatcctgagctttgctcctgcctcccactttgcccttccccagggctgcgggttttcatgttcagtgcatttgctccatattactcctgtttccttttctgaaaatgaatcttttaaactattaggataaagtgtgcctatcctaaattcatggatttctaagatttttataggaatgacacagagtttctgaattctagccactgtaacatctcattgccatgccacctctgaaatgtctgtgttgatgaccctgatttaggacccagatctgccacgaatccttggttcagtttagctcagcagaaatgtgttgcatatctgcagttgagcaggcaccacgttgcgttctgggattacgatgctgcataagaccaaacccatccactcaaagagtgtaacatctaataggctttttttttcttttttgtaaatgtggaatctgaaatccagagagttgaagcaatttgcccccaatcccacagctagtgcaaagaagaagttgcttcaaaccagattttttggctcagtgtccagggacctttccagtatatcattcttcctcatatgtctcagaacaaagctagtagacatttctgaaaaacgttcacctttgctgcattgctgctccatacatcaaagagatttacacaatcttgaggttctataagatctattgaatccctcccaatgtgtaggaggcacagagaattggaaacagttaaggggtctgagtttaattctgaggaacttaaatttatagtttttctttgatcaacttaacctgttgccttcagtttccttgtctgtgaagtaggaatcatctatgtcatagagttggtatgaaaattaattatatacgtgaaagtattggtaccattggtgctacctcatattaggaactcagtgcatgagaattccttcccctttcttgtctgttttgtgaaactcaaatcctttagtcactagatgtaaatgtacacattaaaagtattcattagaaggtgcaaattcactatagccactgcctagttaaaattcactataaccagtgcctagttcaaaacttgattttttaaaacgattttttgaaacaatttcagtttaacagaaaaattgagcagacactgcagagttcctatataatcctgaatgctctgcatacagtttcttctattattagcatcttatattagcacaatgtatttccggtaattattgaaccaatgttgatgtgttagtctgttctcatgttgctaataaaaacatacctgagagttggtaatctataaaggaaagaggtttaatggactcacagttccacgtggctggggaagcctcacaatcattgtggaagacaaaggaaaagcaaagggatgcctcacgtagtggcaggcaagagagagcgtatgcaggggaactcctctttataaaaccatcagatctcatgagacttattcactatcatgagaacaacatacgaaagacccgcccccataattcagttacctcccactggatccctctcatgtcagtcacatgggaattatgggagctacaattcaagatgagatttgggtagggacacagccaaaccatattagttgataaaccattaactaaaatccaaagtttattaagatttttttcttttagtttttaccgaatgtcttttttatgttccgggatcccatttagactaccatgttatacttagctgtcatgtcttcttaggttctgcttgactgcttgactcccagactttctttgtttttgatgatagttttgaggaatactggtcaggtgttttgtaagattcttttctgttgtattttgtctgatatttttctcatgattagactgcagatagagttttttggaaggaacatcacggaggtaaggcaatttttagcacatcacaacaaaggatacatatatcctttatgtataactgttgatttataactgttggtgctgatctggatcaaccagctgaagtagtgtttgtcagatttttccactgtaatgttattcttcgctgctcttctttgtgtattgtgctctttgaaaggaaatcattatatacagcccacattcaaaaagagtgagtagttatgttctctcctttagagaggagtatctacataatttatctggaatcctcctcccgcatttataagtttattaaaccacttgtttatatcagtatggaatgatgggtatttgttttatttgggggttattagccatgatatattttacttattttgttactcaaatacttccagctttggccactcagagctccttcagtgggttcctgtgcacttcgacgtctctccgtcaatgtacatgtgtgtatgtgtgtatattttgtttgtttagcattttcttactttgtggcagtacaagatgctccaggttcagtttggatatttcctactccagtatacaatcagctatttctgcaagcatccctagttgtttctaaaggagaatggcatttgaaactaagatctggacactaggcatgcttgtttctactgcagtaccatttcctttaggcatttggattttaatgtccacattcatggtgttattattatcacagtttatcctactttacagaaaactaaaagtggtataataagatgccactgagtgcattttggaaattttttattcacataactttttccagttttttgtgatttgattgatgaaagtgtcattaacttcctaaaaattatgatgtacatcaaagaggtgaagtgattatctttacagcaaataaatgtttatatacacatttttcccatttacctaaccattttcttcctagcattataaccatcccattttctctaggactgaggcagttcacagttttaaaaccaagaaagtcctgggcaagaattaatcagccactctattcacagctctgataaccattataattaggtattaaatagagacacttagagatatgcgggtgtgtgttcatacatgtatatgaatgaacacatacacacacacaaaagttgacattatgtctgaatattttcatcatagtatccctaacttattgactggttcactctattaatatttgtaagttaaatgagtgacaaggttaattgaatgaattcatagcctgtttgattaacgcaataaatatatggtcgtacatcatataagtatttacacattacatgtctgtttttagaatacttttcacctactttctcattatcattgtatctccactttccctaaactgtagtaatgttgtaatatttgggatagtttaaaagctttgtttttatagccatgtctatagtgggttcactcccccaattacacaaagcactctcatactagtaaacaaagtgttggaatttgcatttgtggatgtgaacatttttttctgtttttggttatttgtctccatttttttaaataaatttactgttccggtttttttgttaatttttgtatttgtatttgtcttactagtcacagctcttttcatagtaatggtattagcctattttctaacatatactaacctttttctcttagattgtggtttgaattgtttgctatgtagaagatttatattttgggattttgggggtttgtgtgtttccagtagtgagatttatttattatttcttcataacttctggctctggtgtcatttgtaaaacttaaaaaatgctatttgttaaaaaaaacagcatgaaaagtggtccatgtggttgtctgtatattacccaagtcatgaatacctagcaatatcagttatcagaaatgacaaatatcataaagtcacatcaggagagcatagtaaaggcaggagagcatacttaagttgtaacactttccctgtgacaaactcccccttttgtaggctttgttgctggcatataccgtatttatctatgagccaggacaagaccactaatgaatcttataaagcttgagaaagtgactatgcaaaagaaaatagatccagcctgttactctactccagaagagagatgtgcaaggactttaaaaataaacagtcttcaatattcctttccggagataatacgattcttttatgtgagatatgtaactttcttttcctttaattactacaaaaataatttgaattttagacaactctgtgctatttgggagtattactttgtgtgagttggtgcaaaatggaaaattacaaacatcatttaaatgtcctctgaataaactaggtataaaaagagtaagaaaaccaagttcaatatccttggaacaacattgctaatgttatttttaaatgcatgtttatgaatccatagtgacactgcacaaagaaaaaaatcaccactgcatgtaaattgcttgcattttccagtaaataccactttagttttcgtagtaaaatttactgtgcaaaatggattatactcactcttccctttgaaggtggttgcaaagtgtgttttgtgatccaagttcatggattgcagaagctcttgaaaagattacgggtttatgagttgctttaggtaaagaagttaatcaaatactagaaaaaataaaatatctaggtaaacacacaatttcaatataaaaaatttaaggtaggcagagttatgcttgtcttatagaattacagtctgagacctgaaagcctcaattttcataagaactaaaaatgaatcatttcagaatcaagtttaacacagtaaacttagttgcaaataaaggaaaaacataaaatatatacttaaagaaataaacacccttgaactttttactgtgttctttcacaaaataattgatgctaaacataatcacaaaatttgggcagaaagctcatgtgacattatcctgactcttaatgataataataatgataaccatagaatccaccggatgttgaaaatgtgcaagacactgacacaggtacctcgcatgtggtaactaactgcatcctcttagcaaccttaggaaggaactgctattactatccccattttagatgagaaaatttagacacacaatggtgaaataagttatccaaagtcacacactaactgaagtaggcagaaattcaatgtagatataataggtaatatccatttttatcacttatagaatcctgttgatcccatacaataatgtacagggaaaaaaagccttttgaaaaattgtaatgcccaacaacatagctaaagcattaacatcattataggttttttagtctctcaaatattttcctaattcatgcaaaattattacttaaggtcagaaatccgcagtttttactttaaacaattttcttcagatttatatatatatatatatatataatacacaaatcttgccatttatatttcaatggctacagaacttgtagcctaccagccaccttctctcgttggtctaaaaagtatagaatcttgagtcaaggggtcttctcttccaaattcatctccacaatttataagcttttacagaataactaaattgttaggccttagcgtcctcatctgtaaaatgggatccactaatagtacctatgacactgaattactataaagattagtgtttgttagcatcaattttcaaagataattagttgaagcatattgtgcctggcacacagtaagaactcagtaagccttagctgttgctgttgttattaatataagtacgagtatcagtattactctcagaataggtattattgttggtgttggaagtagtcttataagaacaaactaaaagttctccctacactcaaattctgagctaatattataggaatgaaatcacaaaggccatctgacaacataaatcttcctgacttgagattgcttttcagaatctagaaggacacataagagatggatctcctgcatggaagagtggtcactaaactttagattacatcttccctatttctccagaatgactgtgcctccagcccttcaatctccctcagtaataggctgtttaacttacttgtggaatattgtatagattctcaggtatttaaggctggaaagaaccttagaagtgaattattaggttggtacaaatgtacttgtagtttttgccctatttttaatggcaaaaaccacaattacctttgcaccaacctactagttcaactggtgggctctacagagggctgtaaagtcaggatttgctgctatggaaagagctaagactacagtcagattgttcctcccttctttccttttttttttttttttcattttctttgtttggaaacatttgcatattttctaaaatcttataaaatatgctggtagatttgaacccacagaacagtttccccagaattatccaggaggatatggtacaggcactgtacatggcattttacgacctcaataaaatatcttcctgaaacctgcccttgaggaatgatggcataaattactgtaaaatgaggctttagaggcagaaaccacttatttccttatgtgctactatatgttcagtccttgtcacagtgcctgacagctaataggtatttcaaaaccatataatcaatatgtgtgcttttttaagcagcactttttcatgaagttgcactttaagatatttgtagttttttacggaaatatttctaaaatgaattgttacttttttgctctactcttttattaaactgagtttacctaatttagctagtcccagaggactgttagagattctttctctcctgttagctcttatttcccagttgtatcagctttaaagagccccctttcctgctatcatgttaaatacattgaaaaaaaaaaaaacagaacgtccttatgcgtagcatgggcatctgcatacaatagactatcaatgtcagtatgtatttatataccatcttattccagaaaagaatgacacctgcttaaatgctcaataaaggtattgcagagttaaattaaatgtgattaatcagtttaaacagtgtactacaaatataagtcaatacgttctaagagagcctgactatagaactttcgtcttttttttttttttttttttttttttttttacttattattatactttaagttttagggtacatgtgcacattgtgcagcttagttacatatgtatacatgtgccatgctggtgcgctgcacccactaactcgtcatctagcattaggtatatctcccaatgctgtccctcccccctccccccaccccacaacagtccccagagtgtgatgttcctcttcctgtgtccatgtgatctcattgttcaattcccacctatgagtgagaatatgcggtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcctttgggtatataccccgtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatgatgaacattttttcatgtgttttttggctgcataaatgtcttcttttgagaagtgtctgttcatgtcctttgcccactttttgatggggttgtttttttcttgtaaatttgtttgagttcattgtagattctggatattagccctttgtcagatgagtaggttgcaaaaattttctcccattttgtaggttgcctgttcactctgatggtagtttcttttgctgtgcagaagctctttagtttaattagatcccatttgtcaattttggcttttgttgccattgcttttggtgttttagacatgaagtccttgccatgcctatgtcctgaatggtaatgcctaggttttcttctagggtttttatggttttaggtctaacgtttaagtctttaatccatcttgaattgatttttgtataaggtgtaaggaagggatccagtttcagctttctacatatgcctagtcagttttcccagcaccatttattaagtagggaatcctttccccattgcttgtttttctcaggtttgtcaaagatcagatagttgtagatatgtggcattatttctgagggctctgttctgttccattgatctatatctctgttttggtaccagtaccatgctgttttggttactgtagccttgtagtatagtttgaagtcaggtagtgtgatgcctccagctttgttcttttggcttaggattgactcggtgatgcaggctcttttttggttccatatgaactttaaagtagttttttccaattctgtgaagaaagtcattggtagcttgatggggatggcattgaatctataaattaccttgggcagtatggccattttcacgatattgattgttcctacccatgagcatggaatgttcttccatttgtttgtatcctcttttatttccttgagcagtggattgtagttctcctgcaagaggtccttcacatcccttgtaagttggattcctaggtattttattttctttgaagcaattgtgaatgggagttcactcatgatttggctctctgtttgtctgttgttggtgtataagaatgcttgtgatttttgtacactgattttgtatcctgagactttgctgaagttgcttatcagcttaaggagattttgggctgagacaatggggttttctaggtatacaatcatgtcatctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtggatttgtcatagatagctcttattattttgaaatacgtcccatcaatacctaatttattgagagtttttagcatgaagcgttgttgaattttgtcaaaggccttttctgcatctattgagataatcatgtggtttttgtctttggctctgtctttatgctggattacatttattgatttgcgtatattgaaccagccttgcatcccagggatgaagcccacttgatcatggtggataagccttttgatgtgctgctggattcgttttgccagcattttattgaggatttttgcattaatgttcatcaaggatattggtctaaaattctcttttttggttgtgtctctgcccggctttggtatcagagtgatgctggcctcataaaatgagttagggaggattccctctttttctattgattggaatagtttcagaaggaatggtaccagttcttccttgtacctctggtagaattcggctgtgaatccatttggtcctggactctttttggttggtaagctattgattattgccacaatttcagagtctgttattggtctattcagagattcaacttcttcctggtttagtcttgggagggtgtatgtgtcgaggaatttatccatttcttctagattttgtagtttatttgcatagaggtgtttgtagtattctctgatggtagtttgtatttctgtgggattggtggtgatatcccctttatcattttttattgcgtctatttgattcttctctctttttttctttattagtcttgctagcggtctatcaattttgttgatcctttcaaaaaaccagctcctggattcattaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgcgtcccagagattctggtatgttgtgtctttgttctcattggtttcaaagaacatctttatttctgccttcatttcgttatgtacccagtagtcattcaggagcaggttgttcagtttccatgtagttgagcggttttgagtgagattcttaatcctgagttctagtttgattgcactgtggtctgagagatagtttgttataatttgtgttcttttacatttgctgaggagagctttacttccaagtatgtggtcaattttggaataggtgtggtgtggtgctgaaaaaaatgtatattctgttgatttggggtggacagttctgtagatgtctattaggtccacttggtgcagagctgagttcaattcctgggtatccttgttgactttctgtctcattgatctgtctaatgttgacagtggggtgttaaagtctcccattattaatgtgtggcagtccaagtctctttgtaggtcactcaggacttgctttatgaatctgggtgctccgtgttgggtgcatatatatttaggatagttagctcttcttgttgaattgatccctttaccattatgtaatggccttctttgtctcttttgatttttgttggtttaaagtctgttttatcagagactaggattgcaacccctgcctttttttgttttccatttgcttggtagatcttcctccatccttttattttgagcctatgtgtgtctctgcacgtgagatgggtttcctgaatacagcacactgatgggtcttgactctttatccaatttgccagtctgtgtcttttaattggagcatttagtccatttacatttaaagttaatattgttatgtgtgaatttgatcctgtcattatgatgttagctggttattttgctcgttagttgatgcagttacttcctagtctcgatggtctttacattttggcatgattttgcagcagctggtgccggttgttcctttccatgtttagcgcttccttcaggagctcttttagggcaggcctgatggtgacaaaatctctcagcatttgcttgtctgtaaagtattctatttctccttcacttatgaagcttagtttggctggatatgaaattctgggttgaaaattcttttctttaagaatgttgaatattggcccccactctcttctggcttgtagggtttctgctgagagatccgctgttagtctgatgggcttccctttgagggtaacccgacctttctctctggctgcccttaacaatttttccttcatttcaactttggtgaatctgacaattatgtgtcttggagttgctcttctcgaggagtatctttgtggcattctctgtatttcctgaatctgaatgttggcctgccttgctagattggggaagttctcctggataatatcttgcagagtgttttccaacttggttccattctccccatcactttcaggtacaccaatcagacgtagatttggtcttttcacatagtcccatatttcttggaggctttgctcatttctttttattactttttctctaaacttcccttctcgcttcatttcattcatttcatcttccattgctgataccctttcttccagttgatcgcatcggctcctgaggcttctgcattcttcacgtagttctcgagccttggtttgcagctccatcagctcctttaggcacttctctgtattggttattctagttatacattcttctaaattgttttcaaagttttcaacttctttgcctttggtttgaatgtcctcccgtagctcagagtaatttgatcatctgaagccttcttctctcagctcgtcaaagtcattctccatccagttttgttccattgctggtgaggaactgcattcctttggaggaggagaggcactctgctttttagagtttccagtttttctgttctgttttttccccatctttgtggttttatctacttttggtctttgatgatggtgatgtacagatgggtttttggtgtggatgtcctttctgtttgttagttttccttctaacagacaggaccctcagctgcaggtctgctggagtaccctgccgtgtgaggtgtcagtgtgcccctgctggggggtgcctcccagttaggctgctcgggggtcaggggacagggacccacttgaggaggcagtctgcccgttctcagatctccagctgcgtgctgggagaaccactgctctcttcaaagctgtcagacagggacatttaagtctgcagaggttactgctgtctttttgtttgtgccctgcccccagaggtggagcctacagaggcaggcaggcctccttgagctgtggtgggctccacccagttcgagcttcctggctgctctgtttacctaagcacgcctgggcaatggtgggtgcccctcccccagccttgctgcccccttgcagtctgatctcagactgccgtgctagcaatcagggagactccgtgggcgtgggcgtaggactctctgagccaggtgcaggatataatctcgtggtctgccattttttaagcccgtcggaaaagcgcagtattcgggtgggagccacccaattttccaggtgccggctgtcccccctttctttgactaggaaagggaactccctgaccccttgcacttccggagtgaggcaatgcctcaccctgcttcggctggcgcacagtgcacgcacccactgacctgcgcccactgtctggcactccctagtgagatgaacccggtacctcagatggaaatgcagaaatcacctgtcttcggcgtcgctcacgctgggagctgtagaccggagctgttcctattcagccatcttggctcctcccccgactatagaactttcatacagtacatgaacttcataaaaacaatttctctgcttaaaaggctttttctaatttacttcaaggtttcctatcctaatgtagacttaggttagctgtagccttgtaggatttaaagagagaatagattgtaagagatgagttctaaattcagacagattctcaagggcatgattcttatgaatatgtataatgtcaactctagcctatgtggatttctagtcctttgcagtgctaatttagccattattttcaagctctttttctatgaaaccaatttactatgactttttggtaaggcttttataacatttgctaattacaaggtgacatctgcataattattaattatgaagttacatctgcataatgaatattaccaataatttaacttaaatgtttcagttaaaactttaaatgcatggaattaaccagaagtcacaatgagttgctactgtatcagttatagaattgagaaggaaacaattcaagacaaacatagtagtgaatgaaaatttgagctttaacactgcatgaatgagaggaaagatgagtttgatgccacaaagaaaaaggggtcatacgtggtaataacctggtagagagttaagagaaagtctcatcccaaagtatatttcagcatgaagggcttgttaaaatttattctaggaagaatataaaagtgtttgctttattggtaatgttaaagaaatctacactgtgattttctttgagctcagaattcagcctcagatatgagcatcgtttactaggccaggctatgttctaagtatttaaaaattttggaatcttatctgagccactaaattttgagcagattttacagagagtggcatcatttcctagaaaaacagcagcaacaaatgtggggaaaagagggatgtcctcagggttagtgtgtccagggatcaggacaacgctccacagagtcgaggggcattagtacatataattattccagggaagtctctctcagaggccataagaccaatttctatttagtttccttgctgtcatatggaagagattgaagtctgctggcatcaatgaggtaaggactctgccatcataaagtcctgtggattatggaaagcccatgtagaaaataatgggaaataaaggaaacaacaatactgtttaatttgaaaaatagacatatctgtgtctcaagatgtaagaattgacgagtacacaccaagtcgttgttatctacgtggaaaaaaatagtaaatgtatttattattagaggatgtgaagtttggttgtgacaaattaaagactgcacctttttgagatagtcatgtaacattttcagtgactatctcttaaggcattgtgcacaccatactgcttaaaattcaagatccttgtgactgaaagccagttctgattataatagacacaattctcaatgctaagttctaacaaattaaatgtgtccctgaatgtgacagtaaaacttctaagttttattccattttcaaagattagctcagttccacttgtcagctgggacatgctgttagatttgttgttttattgtattgtttaaatgttcagtgggcacaagtttttcataggtaaagaattaatgtgtcatgttatcgtgacacattaattttagatacatcagtctaaaagcatgaaagtttattttgatccagttcaccgcataaaataatcactacccattttcacttcaaagggcatatcttgatatgtatagaaggatagtgttgaaaataattgtgtttatgaaattaataaatctccaaagtagtggtccaaaaaatattttaccccttaggtcatcctactgtcctgtaagttaccaacagtaagtagaattaaatttacatactcttaatattgagatgattgctgaccttgagaataattattttagagaggtagggagaggaagttgtcaattggggtgcattaaggggagagtatgagatgagaacatgaaatgaaagaatacaaacagcaattcgaagaagtttttctctaaataggagcaggaaaatcatgtgggagttgatggtgaggagggatgttggtacaaatagttaccctttcacatgatgaggactatcacaaatatgctgtgggaaaaaaagagtgagaggaaaaaaaatttaaaatatccttgagcaaatcaaagagcatggaatccaagcctaagcagaaggatttgtttcaacaggaagggaccaatggccccatcatgaacgtggaaagtctgaccatcctaggtacatgaggttggtaggtctgatagtgggagatgagatacttctctttcgactggtactattgtctgtgtgaaataatcacttgaataaacaagtcttgacagaaaagagttgaagttttcactttgggttattgttagtctttagagatcatcatattcaacatccctctctgtccaggaatcagatgaatagtgctcagatattttgaacatggccatccagcaatgagcagcttagtttttcaaggacagccctttctgtgtttagacatcactaatttttagaaaaccttttcttactgtactagttctctactgcagctctaacaaattaccacaactgagctgctagaaacaacccaagtgcattatcatacaattctgtaagtcagaagcctaacgtgggttttactgggctaaagtcaaagtttcagtaagttttgtgttcctttttggaggctataggaaagaatccttttccttgtcttttctgatttttaaaggccatgcacattccttggcgcatggccccctttttcatcttcaatgccagcaccattgcatctctctgtgtgtttctgctatggtcatatcttcctctgactgactgcacttagaaaaggttctctgcttttaaggatgcatgtgattagattgagcacttctggataatcaggacatctccccatctcaaggtccacaaccttaatgccatctgcaaaggcctctttttgtcttgtaagattacatattcacagtctacaaggattaggacatggacgtctttggggaacattagtctgcctaccacacttgttttaggtttaaatcttttgcacactgcctcttgacttaccctatcgaattgtgaaacaaaatagagtcattctttccttttccatagaataatcctgtcagatgtttcaatgtaaccttcaggggctcttgtcttttacctcccaaaatttctcctaaacttctgtgcccataagtaaacataagtcatactgacatcattgacatcatatagtctttttatacatatagagaaatgcattcatagataatttgaaagtcacagagtacacagaaactggagtttatttgaatagtgttacagtatatcttagaattatgtcatagtgtccttttcaaaatatgaaaaacaagtttacatgtaaaattatgttgaaaagaaagtgatgaaactgtctttcaagcaagttgattttaatttggttcaatttcacagtccttaattgaacattactggtaccttatgaaacaatctctaccctaatgacctggggctaattgggatgatgggcacaaatggttttattgtattatagtaaatgaaatgatatagtaattataggatgcaataggaaaatagcttcgggcagaagtaaagaactcttcctggaattgtctcctgtgctaaattttagtagatgagaagttaggaaagtgtactgtatggcaagcactttccagacaacagaaatagaagaagtaaaaacactgtgaagcaccaaacattatagagagagtgtatttggtaagtatcaagaagctcatgaatagtactagtagtagctttaaattctgattagcatttactatttatcagctaacttttctaagtgctttattattttaaccttcatagagatcccataaagtagataccataattacctaaattcattagttcagggaactgaggcacaaagaggttaagcaacttgccaacaatgtatagcaaatccaaggtttaaaactctggaagtctgaaatcaaagattctgttacaccatacaagctctcaggatgaccagaatataaagaataaagcaaagagtggtgaatgataaggaatgtcagcaggagtttttgttagagctggaaccttaaccagtggtggaggggctcccttgatggggttaaacagaagagtgtcatggtcaagtcacatgtcactgtggttgtcattgtggttgtggttatgtggagggagtgggaagtgataaaaagagaaacacgctaaaaggtaattcagagacaggggcacttatccaagtaaaatatgacaaaaatatagcagagttagcaaagaaaaaaaaggctgaaaatgataaatatttaggaagtaaaataacaggatgtgatatttgtatacaggagtatgtgatataataaaaatgagataagagataacactcagtactatagtttgacttttgaacttttgtaatttactaagttagagaacacttaataagagcggaaaatacgtttaagttgaacatactgagataaagctgcatgtgagaattccaggctgtgccactaggcggcggcatttgtgcgcctgcattgtgcgaattccgcccaagctttactctctgcatgatttgtcagtgaaattctgaatgtctaaagacctctcattctccacttctgttgtattattagtttctgaccacacgatggagtcatttcttcacatttcctcacactgattttgtttattaagaaaatcaatccagtcaaacactagctggaataaaagacatttaaattttcagaatattcctctaaaaatttaggttctctttgacaaggaacataaaaattaattcagtgagtattcagaaccagcttcagattatttaaaatgaaaattgagattcctgaaaaacattaattaatccaggaatattgattttaaaaattgtttagagacactgaaaaagcataaatatataactacttgagaaactttgttaagtctgaatcaaatttggaattcatttaaagcaggtgattgactgtacacaagtatattgtcaagctgcattctattttgtgtatgatcctgccaagttttaataaatattagtcttcaacctttaatcaataatgttttagaagagagtaacaataaatggtattggtagagcaccttacagtttgctgcgctttcacagccttatttcgtgtgacactgacagaccagtcaattaaacccctattccaaggaaaatgtaaagaactgattctagacaaagaaaaaattagtactattatctcccttcaccttacacatttatactgcctctggtacactcttgctctttaacaatgtatcttcaatttaatatccaaaatctgttacaacgcttttaaattactgcaacaatagaagcatatggttcttaacctttcagggttggattgaatgacctaaaaagggcttctgaagtcttcaacttagcattcgtctttccaggtcaaataatccctcctattttttctcgcagggtgatcagtctttttggaatgatctctctcttagaccatgataattttccagttctttgttcagaatctgggtacctgaaatccctatcccagatgatgtttttatactaaggcatagctgggaggaagcctcaatggaaatactgtcattcttaattttacagtcatctagtgtgcctttcactgctctccagagagaggtcttatcgagtggctaggattccaaattcatggacaattttcagtttttatctcctagggtctctttaatacatacagcatttctttcttcctgcagaagaaagaaacactttcttcctgtgttctcctagatttcttcgtgcatttctggccactctttctcagcttcttttcccctgtctctttcacttctttctctgtattctgttaaataccagatttatttctctagctcagacctattctatgagctgaggtcttatagataaaattgaattattgatgtttttcactttcccaccataatgaatgatatgaccatccattctttcactgttcaaatgagaaatctcacacccgtctgtttcctctctcttctttaatgcccatatttaaattcaatccttcaatgtaccctatcaaatctatttcaaattgtaccccactaaattcatgtctatttccattgtcaaaagttgatccactctaaaattctccatttggaccgttatattagactcctgattgctgtttcgtctttctcttttgccgtctttcaatctattctctggaatctcaaagtaatcttttaaaaatataaatacaactaatgccactcattgtgtaatacctttcaatgacttactgttagatgcagagtacaatcctaactactaaacttgatacagtttggctggtatttttcgctcctcttttcttaagtaactctttcctcttttcattattccatagtcaccaacatttatgcaacttctcagcccatgaatattttcttcctgcattcacacatcttaattttaattagttcttagtttccctggctcttcctcatctttcaagtttcagatttagtaacacctcctcaaaaaggccttcctcactccctatcccattatgatccccaataggcatgattgtgtattttcttcacggtgcttcctaatttgtgaacatttatttgcttgtctatttcccttgttagaatataaattcctttgagggtagacaaacttacttttacctactacattatttaagtcctacagagtaggtgattattaatattcaccaaaagagtaaatgaatatatttttacatcaactcatgttgcagttaaattctgaagaaatcatcacagaaaatggtaagtaaaatcataacattttgttgagaaatatcgggggatagagtgctgatggggaggaccatcacggtagggtgctgctgaaggaaacaccaagtaagaagggtggatagaggggcctagcaggaataacagtagcagtctccatgagcatctacaatctcagattgaaatactgatggaagttattttggaaaataatttttgtttattaaaaccaaaaattgttaatggtaaaaaacaaaaatattaatggtgaaagatcttatttcagatggtctgtccagtaaaaaaaaatgtggaggataatcttttgaaacagataatctaataggcatagatacaaaaaataactgccattatagacatctcaactatctggatgcctgattgactcagcaaaaagcacagcatttaattacacctagaaccttgactcaggattataatacactggaagtggctacagaaaatctaggctgttattgaaattgaatcctctaggtgacttccctagtttttctctgttgtgcatatcaccttctaatatactaggtattttatttatctgactattgactgtcctgccttattgaatgtatgctccaagaaggcagaaacctttgtctattttgttaactttagtatctccttcacctagatagcaggggctcaataaacttttctttaatggacagaaataaaagtgactacaatattgtgctggaaataatgtgaaagtgtgggaaaaatacttccaaaatgcatatattctgagacttagatactacttctgggcattcaccctaggaaaataagtgagcaatacaaatatataaggatattcattgtgacacttctataataatagtgaataagacttaatcctcaataatggcagattcattaaacaaattctggaaattccatggaatgcaaacctaagcaaacaatgaaaatggtacagtggagatgtaaagatatgttacatatattgctcagggtaaattcagctcatatgacagaacagtctgtgtaatatgtataataatatacaatagagcatatatttgtgtgtgtgtatatacacacagtatttcatagactaaagcttgaaaggttatgcactacaatactgaaagtggttttcaagtggaattatgtgtgattattttccccttttgtgtgttttctaattttcctacaatgagtatgcatttttggatgaaaaaccaaaaggatatatggttttctaagagaaactttactccagaaattttataaatgactatgctgacatccaaaaatgttaaatgacatgctaaaggtcatgcagcattttaattttcctttcaaagagcatcaactctgagtaactgagaaaagaaataagggcttgaaactccaagcttaattctgattaccaagagaaaacatcatttaagcaaagggaagtttaggacaatcaggctatatgatttagaattttttccagctaagattagcacaacaaatgacaaaaataatattaaaaacaaagatagactcttaattggaaatggaattcagaatgagtagaaggctctgaaaatggaatatttgacattacaaatgtttcactaattagtaacaggaaagccaccctaaatacagcttggctacctagtgtgctctccaaagaactcttagtgtaactgggacctactagtgtggagggttgagtcataattcaggacaggtacatgaagatagccagggaggccaccaaactttaaaaaacttcaaacaacaacaagaagaaaccctatattcaaccaagaaaaagggaagtatgatgagtcagtttgattgcttagaatatgcatagtttcaaaaggaattttgggtgggtaagtgggaaggatgatgcagtttctccgctgcttccatgtttctcctcaataatgctcatctttaaattaggacgttgaggaaactgaaggcccaaatgttttttggcctcactaaactagaaactgttaaatgaagttgatttgagaaaactaaacaccaaaatatttttgctgacattaccaaactaaaaactgttaaatgacagtggtaatggctgtattccctgtgcccagctcaatggctgttggagagtaggtactccataaacatctgtgaaggagagtagaaatgtgaagattatcagaaaaagcaaaataatttaaccaattcatctgcattttccaaagaatttaaacttggaatgcaagaagaaaaacttgcaaattagattagattttataaaattaaggagatttggagagcatcagaagattgaaacataaacgtttttattatcaggatgcattgcatgaacaacagacaggtgaacctgacactaaaaccaggtaaaaattctagaaggcatatagttattttagaaacatcgtggaagaaaagtgtgatcataaggagattaccaacaagtcccaaaccctatttcatgttttgatagtgtcactaggttgataaattttataaatgcctttataatgtttctgcatttcagcaaggtctttgcctatcttagcaaagtctgtctttcagaaatccctcttattgtccaagaaaagaaatatggactgtatgaaaatggtattagcttagttcatgttgttctcttaaggtgactcccgcccaaaaatcattcagtttattttttgtgggttcatatttgagttctgacttgatcttttaaaagccttttagtgtttggaaattgaagaagtattaatctctgagtgtcactttctcgtttgaaaaacaaaaataccaacaaaactgcttaaggctgtcatgggatgaaagataaattatatgaaaatcttttgaaacctgtgtaacactgctcaaatacatgagtataattatcataattttcaagatagcactgttttcaagatggtagcttcagaaggtaaacagggtcaaaaagacagttttttttttgatatgaagatctgtacataagtgtagactgaggtatagaattcaggatagaggaagactgaaagtactggaaagaaagagggtcaggaacagagtcttgggagaaagtcagtagtagaaactattcattgatttctccaacatccttctttttgatataattgatggcattaggacttacattctgcggattcatatggtcctggaaaaattatacacaaaattatttgtatgatttgaacaactgttacttaaaggtgaagacattttattaatctaaattggcattacttatttatattattaaacaaattccatattattaagcaaattccaaactgctatgttctaaaagcttgtttccaccccacccccctgccaaattcatacgttgaaattgtaactcctaaaatgatattaggaagggcatcctttgggaagtgattaggttatgaggctggaggcctattgaaaggggttagtgtccttataaaatagctcattatcccctcccaccatgcgagaggacagctggaagatgccgtctatgaacaagaaggcaggacctcataagacacagaatctgccagtggcttgacttggacctcccaggctccagaactgtaagaaatagaaataaaataaaatgtttattgtttataagctacccagttgagagtattttgctgtagcagcccaaatgaactaagacacatatcttagacttccatttccatctttaaaatgggaagaaatttttttccaactaaatatttgctatgtttaaagcagatgataatattagaagtccattctagaaactctgagtatttggatataaaagcagtgttgcaccatgtcccattttatttgtatctttgattgtggcaattaacaacctgctttgtcatatcctacaaaaaaataacagttgtcaattgagatatttggttgtgactttatatagacctgtgtgtgtgtgtgtgtgtgtgtgtgtgtgtagttttctttatttttctgtctgaactttacatttagtatattccagtacagtggtgaccttgacttattccggatgagatcagggctaaattctactattttgtaaagtaccccaccaagttttgtagaaagccttataaatatctccaaacaacattattttgaataggaaatgaaggagagcttttcccagaggaatatacagtgttttcatttcagcaacattgaattgccactgcacatagccccatggccttgagtaagtaactgactcaatatgatgctattttgagaacatgactttataatgacttcatgctatgtgtatcatgtttccattcagaatggaatagattcagtttaaatatctatcccacaaatgtttatgatagcaactaactgcaattggctgcatttttttctggccataaaatttgagggtttagccatagatacagatttaccataaactaatttctttactacaattgatagaattgaggttttttttttaatattgcatgcagtttattaaaatgttaagaggctgagtctttagtaaatctccatttaatgtacttttccagtggtatactatgtttgtattattcagaatgtcctggttcagcaatagagtttatagctagatgagattacaggctgataacacccagatagagtttggacagtaggagataactatttatcacatcaggcaaataaaatggaaactggctctccgctacttcctttcccccctgactttaaaaaaaaatttttagctgcacaatttaaaatagaaaaaggctgtcccaataaaaacacatttttgtatttatttgatagtgaattgaaatacagcaacttttaagaaaaaagaagtcctgagtagtttcacgcataaacattccttttggtaaaatgttatttatttttaatttgagagataatagtaacaaatcagacgtgtttaaagcaacaaaatagtaacagtaacaacaaaacattgtaaaagaggctatgagtcaatactaactaaagattaaattacatatgacatttgggaaatgaggaccaaacagcttactttttgtatatatgcaaactgtatgggtcatatcacttctaaattaggaaaaatgtgtatgcctatctctcatgtgtttttactattaagacagaggtattctgccaccatagaaagatccatcaaagtctatgcaatcaaccaaacttagacttgaatccagtcctacttataattgtttggcttgggaaaagatacttaatttttctcaagtcttgacttcacgaaattacaggtttgtaccttaggaaatgttgactgatgttaaaatgatataatgaatataaataacttagtacagttcctgtcaaacaaaatacctcattacttagtaaatgtcataactgtacttataaagatcacagattaaactaagcatcaacctgacagtgttaacttttatattgttagattagattagaatttgtattattaaatttcgtattcatgatctccacatctaaataagagtacacattataacatgctctagtcacacggatttatgtgttgaccctaaacatatctcttcacttatgcttttctttctttcctccctacttttgaccaatatcttttgtctgccaataatactcttcccctgtctttgtgtctgcctttcaaaggcctgtgctctgcatttatgaaaaccccgatgaaccactatattttccatgaagctttttagaaaacacttctaaaataaacctgtccctctctgccattcctacagtatttgtcattttatttaacttctgaagctatttatgaaatattcgtcctattggactgtgagttgctggcatcaaaatacatttactgtactctattttgcattatccatagcttataacacagtctcatgtattcagtacatttattaataagggcttagcagcccttattatatttatatattcaatacatttattaataagggctaagaagtcaggaaatattctaggattaaagtttaaacaatgggaaaaattgataaaagactgaggaagggctggtcagaaagatagaagagaagccatagtatagtgtgtcccagagagaaagagaacttcaaggagttggaggaggtcaacacgctaaattgacaaccactccgatttttcttgaactcattctattgatatccaaatggtggaaaaatgataaactgctatgttcctttaggttgattccacggcatttattgagttgaagcctttaatcctgtaaactacactcaggattctagttctgaccttgaaaagcccacacctagtcacgtagttagggagaacctgctgtttgccagataatggtggtaaaaaaaggtattcaagatagtaatcattctttattcctgccattataaagtgaacgtcctgattgctgagggtgatgaggataactgattgaacatttacagtgcgttaagtagcaggctaagtactttacatattttttttattttattctcacatttctatgagaaggtgttctacaaaaacaaaatggaggcatgaaaaagcgaaacaatattgaattgctacaatatgctggaaaaaggtaaaataagtccaattatcttctgctttacatcccttccaattgtttagaacacctgccatatcttttaagtactgtcttctatagaagaactatttccaggttcatcagccattttttttaatgaaaaagtttccaggctttttgctttctggataaatttatcggaatatggtaatgtggacaaaaacctcttttaaaacatttttggaggtagttttccaagcacaatagaataatcagctttcttactgtagcaacttcagttctactgacattacattcagctttttgataggtacagatactattgagagatttacaaaaaaaaatcataaaaacctctagatattttcatatgaagtgaaattatgtcatcttgcccttggatataaagtattttgaggtaattctttctttagatccaggagatataataaaatgatactgaaagtatagatttagaagggaacttatgtaacatacggctcttagcatggtgcgcagaatggaaatattcaatcaatgtcagcttctcttcctattagctttgtgctctagagatgaggaaactgagctcagctttctcattttcaaccattaacttcatgctttataacacaatatgtgaacttacagtatctttggttttcttaatctgaacataattaaaaccccttggctttttgaacttctggttaatcctaatgtgagactgtcagacaccagtattttggttcttccattctgtcccaatcttgtttatttgacctctttctataatgtaaagtgtcattttccaacaagatttcatatgaaaatcctctattaccacacactttctttagaggctctgctcctttcttacttatcagaattttctaattaccaggatttaattttgtgcatatctacaaaaagccaccttcctttttaacagcactgtctagagccattattcttatatttgctctgaaatgtcttatatctactctcctaaaatgtggaatttatcacccttatcagtgattcctttctggatgatataaattcagaaaagaaacatacttttcccctgttgtttggtaaatacaagcaagttgctttagtatcatagaatagagtaattcttcctgtgagagatggaatgtacgcaggacaagtcaggaaatgaacacattttttataacaataaaagtatccaaaagcaacccgaatagtagctctccccttattacatcttgatactgtcagctgagtgatctgtattaggacaatatcactgtgtcctccatctagctggacagcctataatatactaccacaagaataacaccacactttctcctttcatcatcatccaaatgttactctgcttttttccacctacagattcttggatattttacaagcatttatcttattgacaaacagggctattccacacttacttttagactggtttctttttgatgaagaaaatccttctattgtcataaaaatttattactgggactgatacatatttttcaaatgtgaggagggaaaccatataccagcattaaagcacatctttaaatctgtttatgggtaaaataacagtatcatgtttcttgcagaaaaactccctcatggcttatttctcaccccttcacctaaatggaatagctgtttatgttgatgttctaactattctgctgtggctggtcttcacctatggaagcttagactcagtgtcatatctgaaaactaataacagaaaattagtcaaactaccttcctatcagaaaatatacatacagttatgtagatgcttggtaaaatgttattatactatttaggttcttatccttaatgttccaaaattctgtgagtccgtgattctagcatgtgagagagacaacatatgtttcatttgatgttgcagacattttatctaaacaaaaactattgacttcatcaattcaagttttgtttattctaggacagttttgccctttcaaacctgtgttttcaggtatttaaggaaatgaggagttagatttgaaactattgcagttgttcatagtagaggaagtagtagtagtagtagtaatagtagtgaatgcatccaaggtcaggtgacgtttcctagaagatttttatgcattttctcctgtgctcccatcaggcctgcaagaataaccaaacacaagtccaaccactggctgcttgcagaatccaattaacaagagtgagttatggtagaaagaaagtgactttatttaccaaaactagtaatggggaagtggccagatttacatctaaagtaatcacttcaaagtttaggctggagagaggggctttaaagggggaatttggagtggaaggcatgagggaaaggtactcagtacaaggtctgcatatcttgttctggtggctatttctagctgtggtcctccgggagtgtggactgggattatctcaacaatagctgggttgctgactaactgccttgaggtaatctctggaattttgcagctgggtctccatgcatggtctgtttcaaggttatcccctggaacttctaagtaagctcataattagtacaggcatacggttaaataaatgtgcatggtttaagggagtgtatggtaagaaagagagggatgtggtgcttcaaagaaagtacatttaaaagctagaacaaatagacttaacagatatttacagaacattctacccaaaaactgcagaatatacattctatttatcagcacatgaaactttctccaagatagaccatatgacaggccacaaaacaattctcaataaatttaggaaaattgaaatcatatcaagtactctttcagaccacagtggaattaatttggaaatgaactaccaaaagaaccttcaaaactatgcaaatacatggaaattaaataacctgctcctgaatgttaattgggtcaacaatgaaatctagatggaaattaaaaaattctttgaactgaatgataatagtgacacaacctatcaaaacttctgggacacagcaagtgtggtgctaagagcaaatttcatagccttaaatacctgcatcaaagtctgaaagagcacaaatggacaatctaagctcacacctgaaagaactagagaaagaagaataaaccaaacccaaacccagtggaagaaaagaaataaccaagatcagagaagaaccaaatgaaattgaaacaataaaaaatgcaaaagataaatgaaacaaaaagcttgttctttgaaataaataaataaaattgatagaccattaacaagattaaccaagaaaaaagagaaagccaaataaactcaattagaaacaaagtaggagattaatagcagaaatttgctggagcattatggtgtagggaactaaaaggttctgagaaagtctgtcctcaaccctatgcagtgtacagtggcaataaaatccttagcaaccaagttaaacaatgagcagaataccagttatattgtatatgagagtcttatctgtattaagaagttaactaaactatgttgttatggagtcctgagaaaagacatctataacagaaatacgagtatctaatgcacgcataaatatatatatatatatatatatatatatatatatatatatatatatatattctctcacaatataacccatatatatgtacacacacacacacagacacacacacacacacacacacacacacacacacacagatgggatggagactcaatatttaatgtattatattaggcctcatgagtcaaaaggtctttttaggatataaaggcatgcaaatgtgcactttctgtaaactgggcagaactagtccatggttggtggtcttttctcgggagaaacttactggaattaatattttatttaattaaagctacagttgcttgtgcaataaggggctgtggggcagttaacttattgactgctagagaaaaagaaaaaacatatggcagttagaacatagagaaaaagaaaaaccatatggcagttagaacatagtttattctttaagtgtaggagcctgtgacttacccctgcctggcatggtcttaggtcctgtttataattttgtgttttgttacaacaagccttttctgtcaaccttatgatctccattttaatgttaatgctgatcagttgtgtctaaatcaaaaaaagtgaggaaaggtatagtgaaacttgtctgactcttttcttgctgtcatggcctgaactggttttttaggtttctttgggatttcctttagccaagataaggggtccattcagtctgctgggggacttagaattaatttattttttgtttatattctcccttttttgtcaaagtataccagaggcagtgctgatggccaaccttctattttgtcccatatcaatgctgaggtggtgtgatacctgcccctggtccatcatacaccttggtggaatccttatggccaaggaccttagagtcaaaagaattaaagccaattaaatgctctaagcaagacaggcatgaaggtgggaaggcactcattaatccttaaaacccttttaatcaatataataggcaaaatccagaagccaaaaaataaggtcataaagtggacttatctataaattctgtgcatttagctactgtgatgtgatcttggcttgtagaaattagctgtccaaaacacaaatagtttgttcagctgtttaggcatctgtgtgcccatccctgacttggagggtctgaataaatttgtatagctttgataagccccagctataaatgagagacttaatttaggatttgatcttcaagatgtttgtcaaagatgttaaaaggctcaaaatatattattgcaacagaaacataggtcattgtaaaacaatagttactcatttaacccaagtaataatcaaaagactttaaaggcaatacaggaggttacatagatgtaaaacattaattcttttaaatatcagttttttaaggaattaaaaacctaataaagagtataggaattattttgataaaacctaaaatgttgtctcttaagcgagttatcagaaaggcaaagaaaaacctgcaatgtgactgcttcttatgggaagcccatttacataacctgaaaattaaatctgatgaaaaagtacttgaatttaatcagacatcagaagattgtgttaagattatgagtatagcaggggaatatataattcttagtaactgcataagaagttttctgattacattcaaaaatttagacatatcaagaaaagccaagatgacaaaatcaggttatactggaggaaaacattgcttttctagaccctcgagataaaatgttttcacatcaggccacaacaatagttacaactggaggaaaaaacttacagaagctgatgaaaaagctgaaggaaagagtcacctcaagctttctcaaggagagaaaaagctaaaaacagtgtgacaccacagaagctgaacttctgaggtatgattctgagaagttttcaaaacaggatataaaattaaaaatcaaaatctgaattttattaagagccaattaatatcttaagaaaatctcattataacacaggggaccaatcttataaagaccattataactagttcccttctaattatagtcaactgaattatatacaaaacttcttttataatttttctttcatgaaccttgtcacagcttacatagaccatttatgacatgcttggactttctgacttgtattacattttcctcttttctacataaccagtaattttattttaagacaagaatttatcattcatataaactcttttttcatataaaattattatcttttctttataacctttttatttaaaatatattttatattgataactttctttatatctctctcccctgcttactggtttatttttaccttttttaaataagtaactttaaaataacctccaaattatataaaagtattcttttttaacataagaatacaacttacagaattatatattaactagaattattaattttagtaaccttcaattttagtaaaaatttagggggtaagaaatcctgaactatttgtcagatgttagcattttatagattaagccattccactattttagaaacaattttcctacatcataatattttcttaattgggaatgactgagacatccaaggagcacttattatttaattcaaaataattttaagatttaaaattatacaaaaagtacacttacaagtatttatgtcattaacatgtactcaatttttccatttttaccagttgatctagattacttttgaaaactgtcatattacacaaagctagtcattatttaaagttatttccctgttaaccatttttaaaatctgaacattaggtgaacacctaagtaagaaacttaagcacgtgtgtattttgctgataactcagaagattcagctgtttttattgaaccaacaatcataaattagtcttatttgtaaaaaaaaaaaaaaaaaaaactcatatacacaaagattactctgtttttggctgggtctcacaacctttatgccaaaacattgataccttaaacatttagcaaaggcaaatataaaacttatttatccagacacaaatgtatgcccatgcttccaaaggcattttttaaaattttattaataattatagttagaaactagttttatttatcaaagattcatgtgaatgaaaagcatttggacttaatttatgagtactcatttacttataagccaatttggtagcatactaaatatgaaacagaacataatacatgtatattacataaatacatctaatcgcatgtatacatgtgtgcacaaagatccaatagcttttaccttggaactctagccatgagatagcatcacaaactcattgacttataaaagatagctggctccaagttatttttctgacaaaattggaacctcttcacatagctaaactttgtttgccctgataggtaatccaaggaaagttttgaaccaaaattttaagtaaagcagcctctatggcaatttgtggggtttttttaaacttgagaaaaaaaactcttttaccttttttttccttttcagtttcaaacaagtttccaatgtttacattctagatagaccataagtaatgagtcttagcaccagcagcttagtaacagcagatttaaagcaggtagaaagaaaacaagatagagagctttagaagattccacttaactctctagttacagattcaccatttgagctctgaatttttcttgctttaatttgtctgtcagttcaaaatgggcataaaataggccatactatgtaaccagctggagtcttaaagaggatgacaaactcgggctaagatgttggaagctgtttttccccttcagggctggtgtccctggattgaataagaaaagcgaaaaagaaaggaatggagagaagaaaggaggtcaggttttacagaagagaggatgaaagagaaaggtaggagaagaagcttttgagccacctcaaggttcagggtcagtaccccccaccatcctactttatctcctgtcagagagagcctcagcaccccacacctacatggtatggggtgaatccctctcatctctgcaagtcaccagttaaggtgaactatttccaggtggagggagctaaggatgcttttggcccaaaggagtaaggctgtaggtggctcctgagataatctggagaatgaagttggaagaaggggaaagagagagagtagggcccacacacaaaggtcacacactcacacatacaaacaagtggcatacctccaaaaaatccccaggtaaagggctgggtagattcccaaatgtatcacctcagtttcaaacagtccccccacccccaaaagtcagctgagtctgaaccaaccaaaaccccaagggtaccacaaatacaaacaaatacaaatgcataaaacactcaaatggtatccctagcagccgagtctaaatagagaagagccccagtgacaacctaaaagaggcagaggatagttgagtgcattccaactaactcacttagttccaaagtttgttgacttctccagtggtcactttctttgcaccagagaagcattgaaggcagcaggcactgcagcaggaagagaaagaggatccacaagacaaaagcatcttggcagctgcagagaaattccctaacgttccagccatggggtcagccatgagcagccagcattcacaggcatccctatgccccatcatacagaaattagactggcaggctggagactccggagcacacagcaatccccatatgggccaccaaaattgtaactaaatgcagatctggccacttgctgcttgcagagcccagtaacaagagtgaggtataataaaaactaagtgaatttatttactaaaactaataatggagaagtagccacattcacatccaaagtaaccacttcatacgttagggataggggtttaaaaagaggaacttggaatgggaggcatgtgggaagggtactgagtacgaggtctgtatatcttgtcccagtggctgtttctagccatgatcctcctgaaatgcaggctggcatcatctcagcaatagccagattgatgataacagccttcatgtaatctctggaaacttgcagatgggtctctaggcatggtctgttttaaggctagcacctgggacttctaaataagctgataatgagtaaaagtatacagttagataaatgtgcatggtgtaagggagtgtatggtgagagaggcatgtggtgtttcaaagaaagtatatttcaaggctatagcttaagactaaagaggagaagaaaaggtttccacaatatgcttaagggttacattttgagactagggaaaaaagggaaaagggggaaaagttttaaaatgcacttttaggctagactctttagcctaaaacaatgacattattattcccatttcacaggtaacaaaacaggttaaatttattattcatacacttaacaaatattgaacatcttgtatgagctaggctttattctagaaatttggtattactaattttaaaatggataaaattcctatcctcgtggactgacattctaataagaaacttctcatttattacaagacataagaaattagtaattaaaattatatgttagaacttgatacattctttagaaaaaagaaaaggtagaacagtgtaaggaagatctgactgctggagtgacagcagggaaagtgtagcaatattactcatgtcatgtttctggcttaaattctactttatctgcaacaggattccatccctgccttcctgtgtattatcttgtctgttaaacctttgctcattcctttatgtttagctttttgaatcattgtgttccaagtttgtcttttttttttctttttttcttcttcttattatttttttgagacagagtcttgctctcttgcccgggctggagtgcagtggttcaattttggctcactgcaacctccacctcacaggttcaagcgattcttgtgccccagtctcctgagtagctgggattacgggtatgcaccaccacacccagctaatttttgtatttttaatagagacagtttccccatgatggccagactggtcttgagctcctggcctcaagtgatccacatccctcagcctcccaaaatgctaggattacaggcataagccactgcacctggccaagtttttcctttgtgtatagcatagaattcagttttgctttataagccaaattgaaattttattattattattaaatgaatacatcctaatcacatttaggatgtgactaatatgttgggtctcaattgtcatggtatcttatgttgtaattactgaatatattatttttactgtgttttccccccactatgttgtgtttttgttgttgtttacatcatttaacttgtttatactacattttaacttgtttatactatatatttatactatatttatgaagatttctattccagctctagtggttatttttggtttaatattttatatagtaatcttaatttttctgtttctgttttctccattttaaaatttttacaatctcttctgtcaattttaattggtatctttcaaatcctatctaagacatggacaatagttaatgaaatgattctactttcctttctccttttccatgttttcttttttaagttttatttttgtgagaatatattatgtttacatattattcttttacccaagattaagactttgtagtctcagttctttgtcttaggtctgctagtaaaaatatgaaatacccccagtcctttggtcagacttggttggatgaagctcatcctctagcagattcctttgaaaggacacataagtgtgtgttttgcacattcaaaacttttttctattcctttcacacttcaaggacttagctgatgtcagaatttctaaatttcttgaaacttctgcttcatgttggttttatttttgagaggtctgattgcctgtctattctcatgcttttgtaccttgtcatttcatttcctggagaccctgaggatactttatgtttttttaagtctaatagttttacttgagtatggtttggaattgctcacaccagttcaattttccttaatacatcctttcaagatgcagattcaggtcttcttttgttttctggaaagtttccttgacctatagttttaaatattagttctctttcatggttttggttttcttagtgaaaggctccagatatgcaaatctcggacatcctttacttagcttccatttcaagcatcttctctctgaccctttttcttttatttttttttaaataaaaatgtcatttacattaccctggttgtttttctctttattcaataccctttataaaattgtcatttgaattcatatttttggtcattttgtaacttacttttcaattctgatatttaatttttttatttctttcttgggttcaattgattctcattttatttcttcctgtttttgtcctttgctgctttcagtgtttatctttctaattcagcatactttgaaaaaatttccaaatgctcatttgaggatatttaatttagtttgggggattgtattataggtctcttaagttctttggttggttttatgggaaaaattttcatcagctgaaatgcgtcaattcaatttaagtgatttttcaaaatagttgtgtgtggatgtggtctgattttttttctatggctatactcttcataaattgagagtgcccacttctttcagttcagcccaaatctgtgtaatttcttttatgaatggtgttttgattgcagtgttgtgggcggagggattggagtgttttattcctttttgttttctttgtttctttcctttccaacttcatacatctgacttcccccttccatctactgtcaataactccctgctgttgccacttctggcaccacttactttcgctaaacccagtgttaggaaccaccaagttctgacctgtgttcagcattttggtatttgtattgaactttctcactttgatgatgattttgtttgtgttttatctaattcatctagaatcctactcttttttagttcttaagtttcctctccttctttctccacacccacaggcaatggaaatacttcctagtgctcctggatgtgtgaatcatctgtggttttgtttgttccccttgttggttttatagttttttgggagaaggatcaatggggagattcaagctcaggacgccaaccttgttctccaagcctataggtctttaagatctggaggtgaacagagaagatgttaatgagaaagttatattaaacaaagccttgaaaaggattagaaagttgtgcagtgggatattggatggggatgcatttcaggcagaggaaacagcatgatggtcttgaggtgtaagcatctctggcatgtttgcggaacagaaatgaggggagctggactatggatgtgcaggtgaatatggaaaagaagagtaagatgaaaggtcagagaagtaagagggtgatgtgtatttgtaaggactgaataaacatgcctgaagatagaaattggagaaggtggtattcaaatctatctacatgatttcacaccttgtgttcttttcacaacataatgttgcaattcataaagagattttattaagttaacctataatgaaatataacccagaatatgcagttttggagctcacaaaagaatcttctagtgtgagagaatgataggtctttgtggactcaatttattatctctagtatttacctttcccttgaagagaactgataaaactcctggtgtcatgaagcttacattccatggagggagatacacaagaaacaatatgtaagtaaaagacacagtatgttatggtgatcattattaaacaggaaagaaggataacgagtgctggagagatgttcagaattttaggcaagacagctatgaaagagcttactgaaaaagtgacatttgaatgaaaatcctggaagatgtgagttagtgcaaggtgcttaatcattttgtacctaattttctcatctgtaatttggggaaggattacattaaatggtccatgtcaaagtatttccctatacagtagtaggtaatgggtgctctttgcatagctgtcttttcaatgtccaggtttaaagttagtaccacagaatattgtgttagggactctccagcagagtgtaaatgcttgagcatgtgcgcacatgcgtgcacacacacacacacacgacattgccgcttcattctggcaaagatcattttggtctctgattaaacattccagtatatcacctgtggaggtagactcctgcagacacattaaagcaagttttcattagcaattagaaaacatcagattccacaggtgccacataaatttgccagtttatcttaattcatcaactgctgtcagcatccatggctcaagctccccatcataaacaaaaaatgaggaagaaaagtttatgttttattcattcagtactaatttgcatgtggtttgattagaaagtaaagcaatgcagtcagtagatggtgccagagggttgcttttcactgcaaggctagaattagtttgctgaagataatcttttgtccaatgattctgattccttttccctggccatgctaaacatttttcacacgggtgaactattaacataagaaaaatctaaaactttagagtatatccacattactatgcatggaataaatcattatacatcttattaaaatatttaaatgtataaatttcaaaagaggaaaatatttaattctcatgttttctaatcataaaaaggatgtcttaagcattttgatgaaattattaatatattatttgaatttatattcaatgcattaagttgaattatgaatatgtatgtgtattatttatatatgtatatataaaatttaaataatactataatatcttaacaaaagtgatacagggaacacatggtggttccatctacctatctgagaagattttctcaccaaatcttttggagttgtttcttctggagggaaaatgatagtcttatttatctatcatccctttaagcataacaccacatggtgctcattcatagagtaaatatttgttaaatgaatttctcacagtgatatcttattctcaagacctccctccctttgtgttatttttataaaaagcttattaatcatattcactcatttattaggttcacataaggattgcatatgttgtcaccaaaactcttctataaatcccttcaggttatagaccatgttaatctttaactttctaaaatttatttaaatcttctcccattttttaggttgcctgttcactctgatggtagtttcttttgctgtgcagaagctcttcagtttaattagatcccatttgtcaactttggcttttgttgccattgcttttggtgttttagacatgaagtccttgcccatgcctatgtcctgaatggtaatgcctaggttttcttctagggtttttatggttttaggtctaacgtttaagtctttaatccatcttgaattaatttttgtataaggtgtaaggaagggatccagtttcagctttctacatatggctagccagttttcccagcaccatttattaaatagggaatcctttccccattgcttgtttttctcgggtttgtcaaggatcagatagttgtagatatgcggcgttatttctgagggctctgttctgttccattgatctatatctctgttttggtaccagtaccatgctgttttggttcctgtagccttgtagtatagtttgaagtcaggtagtgtgatgcctccagctttgttcttttggcttaggattgacttggtgatgtgggctcttttttggttgcatatgaactttaaagtagttttttccaattctgtgacgaaagtcattggtagcttgatggggatggcattgaatctataaattaccttgggcagtatggccattttcatgatattgattcttcctacccatgagcatggaatgttcttccatttctttgtatcctcttttatttcattgagcagtgctttgtagttctccttgaagaggtccttcacatcccttgtaagttggattcctaggtattttattctctttgaagcaattgtgaatgggagttcactcatgatttggctctctgtttttctgttattggtgtataagagtgcttgtgatttttgtacattgattttgtatcctgagactttgctgaagttgcttatcagcttaaggagattttgggctgagacaatggggttttctagatatacaatcatgtcatctgcaaacagggacaatttgacttcctcttttcctaattgagtaccctttatttccttctcctgcctaattgccctggagaaaatttttgcaacctactcatctgacaaagggctaatatccagaatctacaatgaactcaaacaaatttacaagaaaaaaacaaacaaccccatcaaaaagtaggcgaaagacgtgaaaagacacttctcaaaagaagacatttatgcagccaaaaaacacatgaaaaaatgctcaccatcactggccatcagagaaatgcaaataaaaaccacaatgagataccatctcacaccagttagaatggcaaacattaaaaagtcaggaaacaacaggtgctggagaggatgtggagaaataggagcacttttacactgttggtgggactgtaaactagttcaacccttgtggaagtcagtgtggcgattcctcagggatctagaactagaaataccatttgacccagccatcccattactgggtatatacccaaaggactataaatcatgctgctataaagacacatgcacacgtatgtttattgcagcactattcacaatagcaaagacttggaaccaacccaaatgtccaacaatgatagactggattaagaaaatgtggcacatatacaccatggaatactatgcagccataaaaatgatgagttcgtgtcctttgtagggacgtggatgaaattggaaatcatcattctcagtaaactatcacaagaacaaaaaaccaaacaccgcatattctcactcataggtgggaattgaacaatgagaacacatggacacaggaaggggaacatcacactctggggactgttgtggggtgggggtagcggggaaggatagctttaggagatatacctaatgctaaatgatgagttaatgggtgcagcacaccagcatggcacatgtatgcatatgtaactaacctgcacattgtgcacatgtaccctaaaacttaaagtataataataataaaattaaaaaaattaaaataaaataaaatttatttagaccaatgcctggcaataaggatagcatgatatgaatgccataactatgaataatacagttaatatagttaataattatactataattaataacttgtatggaaccacaatattaaatttcttatttctaggcacaagcagtgaagataaaatacttatgactaaattcaatcctaattatgagacaaatagggaaatttgctgaaacacagaaatttacttcaacctccaggttttggcagcaattaaatttagagatagaggcaaatgttttccatagaataaacacagcatttgaatttatttgatcttgaaaagtttaaagtgtcaaaaataagtaacagaatacataaatatgtcatttgatatactttacagactttggaattgacaaaagttaaggtgctgatcaaaaattatgacaatttcataaaacgtgttatatgaaaaaaacttaagagaaatagacttttgagagaaagttgaggaaataaagataattattgaattagatttggagcaaagtaggtaatgtattgagccaattgttggaaaggaacaggatgtcagattctgtagataaagcctgtgaaagaaaagagcagatcaattggattaggataatttaaaagagtagaaaaaacgtccaaatatcttgaatctgagaaaatgagaatatttctacaagtctttgcatagtaaagatcttagaatcttttgccagaatcctcacatttttatttgacatgaaaattgaacatattattaaatccaaaggcctaaaatgtctcataaggattccagtcccctgtgattgcacataggaatctcaagtgtaagacactttgctgtcaaatgtgtttctacaagtaggcacagcactggactataattgtaagaggagggtaaaaatataaatctcttcttccaaagaaacttttgttatcaaacttagcattttaaatcaatcagtctgatacctaaaaacttagaaattatctctctattataaggtttgctgttctaatagtaagcgtaatagatactatatttgatgattccatcacttcgattggtatgattttagttaaatgattgcactattatttatgccacaggatgttcagaacccctgatagtctctttgatactcactgagtaatgatagttttatgctgctatggccttagagtaacttcacccaggaaagtattatagcaatcccctttcaataacttttacaacaagtgaacatatttattcctatgtccctatctgtgcttagatcccatttttaaaatggctctttattagacatgtgtgttttttcatctgaataaatccttgtaaacaacagtgagttaggttttataaccccacattatgaatctaaaacaggctgtataatatgtttaagtccataaagggagtaagaggtaaggctatgattcaattcttggtctgcttaccaccaaaacttttgtccaatctgtctctggggcccatgtattctggttgtctgggacagttctgattgttgcctatccggcttagcatttgtcctcttctgaaatgtctcatttggatgataaattttatggtcactctagaccacactaagaaaccaggattatttaatcaagattcagacattgcatcaatgtactggaaaactagaaatatggtttctactttaaatgcttaaagaaaaatagagaacttggacatctattcaagttaatgtctccaggatacttgcataaatctcactgtgtataccagttagtccaatgctaaaaacaacaaacaaacgaatgggttatgaaacttgagagtgcgtaccagagtataatattagaaatttatgcatgctgtacacatgctttctttagaaagaatttgtccctgggtaagattgattaataaaactactcttcttcagctgctttaaattatatgccactttttaaaaaaccaatattcaacaaaataggttatttctagtcaaaagagttctaagaaaatatcaacatatttatctctacataaatatagacaagctgaggatgagggcaaaaagcacctacatggcccatagagctacacatgcaatgcacgtacacacacacacattctggacctcacctcctacctttcttttgctcattctgtttcagccacagtcagtagcttccttgctttcctgaagcatattaagctcccttctctcatagggcctttgcaatttccagtccctctatttggtatacttttccctctcatttcccaatggcttccttccttccttcaggtctttgccaaaatgtcatcttctagtagagatctctgattaattaaatttaaacagcaaaagccccattaccacacatcttacttttccccattcctccataaaacatacctcctgacatacctccataaaacagaccttctaacatacctccataaaacagaccttctaacatacctccataaaacagaccttctaacatacctccataaaataaggtgtgttagaatgtgtaagttctatggagaatattaaagtaaaaatattttaacttttttatcttaatattctctaatataaagtatttttactttaatattctccatagaacttacaccttctaacataccttattttatacttatttatttcacttattctctgtctgccgctctgaaaggtaagcccattgagaacaaggtttgtattttgttttttggtggtggtggtggtttgttttgttttaatttttgtggatacgtagtatatgtatatataaacacacacacacaaatatatatatacacacatagtagatatccacaaaaatatatacatatatgttacatatatatagtgtatatatgtatccacaaaaattaacacaaaagaagccaccatcaccaacatgtacatgtataaaattaaaacaaaacaaaccaccaccaccaacgtatatgtatatctcatgttccatatatatatatatatatatatatatatatatatatatatatatcatgtaccacatataggtatgctacatgagatattttgatacagacatatgatgtgtaataatcacatcagggtaaatgggatatccgtccactcaagcatttatcattttattgtattacaaacaatccaattattctgttacttatttttaaatgtgcaattaattaatgttgactgtagtcatcctgttgtgttaccaaatactagctcttattcattctaactattttctgtacccattaatcatccccacttcctaccaccactgctctttccctgcctctggtaactatccttctactttacatctccaggagttcaattgttttaatatttagctccacaaataagtgaggacatacaacatttatctttctgtgcctggcttatgtcacttaatgtaatgacctcaagttccatctatgttgttgcaaaaacaggatctcatttttatttgtgactaaattgtacttcattgtgtgtatgtaccacattttctttattcattcatctgtttatgggctcttcagctgcttccaaatcttggctattgtgaatagtgctgcagtaaacaagagaatacagctatctcttcgatataccaatttcctttctttttgggtatatatacctagcggtgggattgctggatcatatggtgggggtgggtctattttcagttttttggggaacctccaaactgttcttcatagtggattgttctaatttatattctcaccaacagtgcacgaagttttcctttctgctacatgctcaccaggattcattattgcctagcttttgggtaaaagtcattttgactggagtgagacaatatctcattgtagttttgatttgcatttctctgaagatcagtgatgtggagcacattttcatatgctgtttcccatttgtatgtcttcttttgagaaatgtctattcagatcttttgcccctttttaaatcagattattagggttttttttttgtttttgtcttgttttgttttgttttttgttgttgtttttttgagtcagagtctccctctgttgcccaagctggagtgcagtggtgcaatctcggctcactgtaactgctgccttccaggttcaagtgattctcctgcctcagcctcccaagtaattgagactacaggtgcacatcaccatgcgcagctaattgttgtatttttagtagagacggggttttgccatgttggccaggctggtctcaaactcctgacctcaagtgatccaccagccttggcctcccaatgtgccagaattacagacatgcaccacggccaaggattattagatttttttttcctatggagtcgtttgagctccttatattctgatgataatcccttgtcaaatggattttttgtttcaatttagtggggaagtgtttggggtctttttactgaaatatataccacagtgtctgccatactgtatatcctcaatgaatataacttgacaaatagaatgaaaaaatagattgtgaataagctgaatttcagcttagagatgacaatttgtctcaatcgctggaagtatgtttcagaaattaagagtaggatcccctgaatcagcaaccttgtttagttacttttaagatcttatgcattacggagaaccagcgatggttaataccttatggcatatatctcaccacagctgaaaatgatgctacctactcgaaatgaatttcataatttgcatctttctcacagttacagaaggatatagaaggtaagttcataatcaaagtcagttattttttgtttgttttgttttgtttttatatgcaagaggacatatttgcagtataactgattataaaagtacaagactggtttttaccctgattgagggcacagctcaatttccttttagttataccatgtgtctttgtagagctgattctgcaggccccaagacaagtccctttctcatattattgaggttctcctttgattgacaagtattgatcagcaactcttttggcaaccttgaaaaatagttgtcttcttgaaatagggttttctacttataggaatatgaccagactcacttaaattaatccataaagatggaaatatagagagaaataatatacctgactgattactgactatgagttaggcatactcagtcctcattcacaccttatgagatgagatatttgtattctgattttataacaagaaaaccagagtttcagaatccaggttcatgatgtttggtaaatagtgagcattcacaaagtgttaagtgcctttatttgtttcaccacctcttccaggtccaacattttattatcatacttgaaaagttaatacaaacataccaagttacccaaaattgagtgtagatttcttgataattagagtaattgttaaagttaaagcattatctacctgagataaatatacttgaaatatatataaaatgagaaaaaatatattttaaaatgcattgggtttaagaagccatatgagataaaacaattggctattttcccattaaatatccaaagtagcctggaaattttctattttgtgagattatgattattataattttatagctggaatcatgctaaaacacatgggacaatggaaaaaatgttttatgaggcaaaatgagctcactttaagcagatgattcagattttatataatgataaaaatttatttcaaagcccacattacatgagtataagaaatttcagctgctgacactgtaaagattgttttcattttacttttaaaacagaccaaaattctgtaggcttccacagatctagtgaatagtaacaaatccagaaattgctgttctgttgcagtggcaatttccttttcaaattgcctaataataggtgttggatttttctccatctcctgtaccgtttaaaaaccatccggaactgtgtctggtatgtagtagttgcttgtttagtatttgtccatttatcaaattagttttcttttactaaaaaacaaaggaatgtgctttcaaggtaaaaatttccacaactcaatagaattgcagttaaaagaaagcttctcttccttcccagaatccaagtcttactctcaaccgaaactggttatggttttttagaatatttcttgttggggctgacagaaagcactcatgtgcatacctttctcctcaaacagtgcattagtaaaggggctttctagatatacgttaccaagttcaaagagaataggaaagcatccatctgcagatgaataccttcagtagatttctacaagataaaactttggtggaagaaagtcgagtgaaaaaacaaatcagagaaagaacactctaatagaagtgcaaagaggccacttgaggaagtcttctctaaaactggggggataaatcaagaaagaagatgggagatccaggaaactgtggacctagctctagatgagatgttgcaacagggctacagagctgtcagtcctgattggagtagattccaccaagtcaatcagtgggctggaggagggaggatttcaggagatagttcaccgtttgatatagattgctgtccttttactttgttaagtacacctatgagaaacaaaaatgaaatcctaagcctgccaactgactgaatggattctgtcttggtcaaggggatctcagggaaagcttggaagttgagttcccagcaataacaggatgggaggttggacaccatctcccatgtgcaatgaaagttttcatgtcccttgcttcaccttttgacaccacagggctgaaaactgtatcctcgaattatgctaacccatttttggaacatgggtcccatagagagacatgaaactcaactgcacatgcccacatttctctacttataaatattcatgactcttcctatagtttattgaatatgtgtatttggccagtctattcaacataaatccctgtcatattcttctgaccctcaaaaagtgtgtttctggcttctggatggaggttacacttcctggcctctcagaatggctacgctgcaggctgcaacctttatgaaaagtaaagctctcctttccaaatttatgaaatttatcattcttcagttgatacatctttttaaatttatgaattgtatctccctcttaaaattagaaaggtgtatgcataggaaattgtggataaactctgtagttttagaaacagcagtaagtgtgctgaggaacaactgagtcatcagtactagtgatcccatagaacacggttccaacagtttgtgtaagatgatggatagacagatagcctgagtggaaaactgacaatccagagctgatggtctctctgcttggagatgaagcctcttcgtatatgagcttacacttataaaaagatataaataaggaaaagtgaagtaaaagaaaaacccatgttgatactctgtggctagaatttgtcatatatggtgttgagagaagaggggacgtattgaaagaggaattggggtagggaaaaaggagggaactacatctcagtctcatattaagccaaattctccttttgccttttgtctcagtttgcggctggatatggctgccgtgaaaacacaagggctctctaatagaaaacaaaacaaaacaaaacaaaaaactgaaaggagcattgctaagttgactctgacttgtttccagggaagacagcttactacaagtgggatagatttttcttcagtgctagtggtttcaggctgtataggcataatgtttaatggcatatttccaggttactgaccaaggagctagttagactaaaacagcattgttgcagagtggattctccaggaaacagacactgagatggaaataagattgtagaatgtttattagaaactgtgtagagatcaacaccttttaaaaaggggtgtggggaagcagcatcaggcagagagagaagtggaactgtgatgtggcatcaacaccttaagctgttgatcaacagcttaagctgacccagaggaagttctggagttgatagggtctggctgcggtgttccccattaggccaaatgtgagagagccattgtacccctccctggatcagacatcagatgagggccacccctgaagagtgagcctttggtcaatggaaggcaatcagaaaaggctgtttgataaagaaaggtagcttgttgcagcactaaaagctgctgaggcccgctcttccttaaaggggacctaagcagtttaataataagcttaagatatcagaagaacttgacaaagatgcagcaaatacaagaaaataaaagaaaggctataaaatatgtgatagtggactaggagtaggtggaggctcagggcaaactgctagaaaggaaatatgatcatgtggctttacctagtcacaataatataaatatcatgtattgcttttgccatttatattcaacctgttgaaatttggaagatttgtgactacaaggctataaatgaatgcatatgatccccatattaatcaaaatttaaaattatagataaccgatattttgaagttgaagatgaaaaggagtgaaaaagagtaggattactaatatcattaaaagataaagttagaaatcagtaaatactgtctatatgaataggacaagaaatagaggtttaagtatattattctgatttacaatgattaccaatagggagagaataatagaataacactttgaagaatagtagaagtatctattccacgaatatttggtaggtggttacatttgaagtgatataggcatggcactttacaattttctcaatttattctactacagttggcctgtttggatataataaccctattgaagaaaagatatttgttctaaattttcaaatttatgtacataaagttgagaattgagagttatttgaattttctcaataatgatatatctcatttatattacttttttatttctctttttgtgtcctaattagtttattaagtagtttatgttatcagttctttcacataaccatatgcttgaattgtattagctttactctatttgtaccttctaaatgttgttaatttctgctttaatcttggttaacttttccccctctgtctcattagaggtatttattttgctttttaaatttaataattcatttaatttatattttcctatttcagtgtgtagcatttaagacaataaactttcttacagtgaatcatttcatagagtttatattttatttccatatttcatagattgtggtttttcatgttttttaactattatatttagatattcttcaattttttttgcttttccccagttttaaggttttcaacttaaagataccttttgaggaggattctatttttaaaatttaacttccactttgatattgttatcaaaaagcaagttatatattatgtgtaaatgtagaattcactgaagttatattgagactattgagacttcatatagaacaaattttgaatatattcccaagagaatttgaaaagaaagtttggattctattttcaggatgtagaatttagtatcttaatatacatataaaatgtcttacattattatttttatttgtttattttatttatttatttattttttgagacagagtcttcctctgtcacccaggttgaagtgcagtagtgcaatctcggctcactgcaagctctgcctcccgggttcacgccattctcctgcctcagtctcccgactagctgggactacaggcgccccccaccatgcccggctaattttttgtatttttagtagagacggggtttcaccgtgttagccaggatggtctcgatctcctgacctcatgatcctcccacctcggcctcccaaagtgctgggattacagacaagagccaccgtgcccagcccacattattattaatatatagagggaccataaattattattatttttgccctgtgatataccatagaatacagtaagatatatgagtcaaagtcacccactcctctgataaatcaatttcattctgctatttcattctcttccaattttgctgtataaattttcaataacaaatctttattgttgattatacagtatgtatactactatcttaatgactaggctttcaaatcaaatgtgctttttattattgtaacaatatctccattctttttgattgaatttaatcaatgtttactttctagattctctgaattattttgatataggcatggctttaatttatggcaatagttttttgacatagtttttttttttcgtgctacattttattttatttattttatttattttttttattatactttaagttttagggtacatgtgcacattgtgcaggttagttacatgtgtatacatgtgccatgctggtgcgctgcacctactaactcgtcatctagcagttttctttcattacatatattttttgataaggaagctccacctaagtgtatggttatttatttcttcttcttgcctcttttcttcccagataaagtggcctggcagtgtagaaggaattatgcaaaaccccttttcacatttctttgagctggagccagctctgcttagtcatagtcacatttttgttactgtttttttttttttccttgtggtcccatacttcttatagttgtccagatttaaggtagcttttctcataatctttaaagacctccaaatttagttctcacagaaaaataaagtcaatacataaaaaagtttgaaagctattcaacgtgtgacctcttttctagctcccttaatattcattcaatttctttgcctcttaaatatgctcatgtctcaatctttaaagtatttcagtggactcttacggctctcaggataatgctgaaactctttcacctggcttatcatgggcttcatggaaggaatgtgctttcatttcctaccttgcttctgaaaacttcccttcttgcactctaccacacattcacactaatatatgctttaggtccttgatcagtttatagatcttatttggatctgtatttgaacaacatataaagaaaaatattttgagaataatcaaggtaatttaataatgattttatgaaattaagacatcattttaatgtttttagatgtgatataatattttgattttgtttaaacaaagaaatcttattctttacatacacatgatgagaggcttatgataatgtctgagatttggttcaaaataatccgaggttggaaagtaggtgaaacaaggctgtctgagcttataattgtttaaactggatgttgaacacgtggtaatcattataccaatctcttgacttttgtatatatttgaaacttttcaaaattaaaaaataacctttttggatcaaattatggaaatgtattttaatatagttttagatcatatataggcatccacaattaatctattactacatatttatataaaatagtataaaaatgcatatataatttttatttatttactttttggattttgaacttttaagttcagggatacatgtgcaggatatgcaggtttgttacatagttaaacgtgtgccatggtgattagctgcacagatcatcccatcacctacagattaagcacagcatccactagctattcttattaatgctctccctcctcccacccctcaacaggctcaagtgtgggttactctcctccctgagtccatgtgttttcattgtacagctcccactaataagtgagaatatgtggtgtttggttttctgttcctgtgttagtttgccaaggataatggattccagctccatccatgtccctgcaaaggacatgagcttgttcttttttatggctgcatactattccatggtatatatgtactatattttctttatccagtctataatcggtgggcattttggttgattccatgactttactattgtgaaaagtgctgcagtgaacatacgtgtgcatgtatctttataatagaatgatgtatattcctttatgtatatacccagtaatgagattgctggagggaatgctgcctctaggtctttgaggaattgccacactgtcttccacaatggttgaactaatttacactcccaccaacaaaagtgttcctttttctccacaacctcaccagcatctgttgctttttggctttttaataatagccattctgactggtgtgtgatggtatttcactgtggctttatttgcatttctgtaatcatcagtgacattgagctttttttcatgtttgttggctgcatgcatgtcttcttttgagaagtgtctgttcatgtcctttgcccactttttaatggggttgtttttttaattgtaaaattgtttatgttccttgtagacactggatattagacctttgtctgatgggtagattgcaaaaatggtctcccattctctaggctgtccattcactctgatgatagtttcctttgctgtgcagagctctttagtttaattagctcccatttttcaatttttgcttttgttgcaattgcttttggcatcttcatcatgaaatctttgctgtgcctatgtcctgaatgctactgcataggttttcttctggggattttatagtttggggttttacatttaggtctttcatccatcctgaattgattttcgtgtatggtgtaaggaaggggtccagtttcaatcttctgcatatgcctagtcagttatcttagcaccatttattaaatagagaatcctttccccattgcttgttttggtcaggtttgtcaaagatcagatggttgtaggtgtgtggacttatttctgggttctctattatgttccattggtctttgtgtctttgtaccagcaccatgctgctttggttactctagccccatagcatagtttgaagtcaggtagcgtgagtgtgatgcctctagattttttttttttttttttttttttcgctttggattgccttgactattcaggttcttttttggttccgtatgaattttaaaataggttttttctagttctgtgaagaatatcagtggtagtttagtgagaatagcattgaatttataaattcccttggacagtatgactattttcatgatattgattcttcctatccatgagcatggaatgtgtttccatttgtttgtgtgatctctgatgtcttttaggtttgtggttctccttgtagagatatttcacttccctgcttagctgtattcctaggtattttattatttttgtggcaattgtgaatgtgagtttattcctgattaggctcttggcttgacagttgttggtgtatctggatgctagtgatttttgaatattgattttgtatatgagactttgctgaagttgcttatcagcttaagaagcttttagggtgagatgatggggttttctagatataggatcgtgtcatctacaaacagggatggtttgacttcctctctttctacttgaatgcctttatttctttctctcgcctgattcccctggccagaacttccaatactatgttgaataaaagtggtgaaagaagacatccttgtcttttgccagttttcaaggggaatgcttccagcttttgcctgttgagcatgatattggttgtgggtttgtcatatatgactcttattattttgaggtatgttccttcaatacctagtttactaagagtttttaacatgaagggatgttgaattttattgaaggctttttctgcatctattgagataatcatgttgtttttgtctttagtcctgtttatgtgatgagtcacttttatttatttgtgtatgttgaaccaaccttgcatgaagtctctttgattgcggtggttaagctttttgatgtgtggctggatttggtttgccagtattttgttgaggatttttgcattgatcttcatcaacaatattggcctgaagttttctttttttgttgtatctctaccaggctttttttaatcaggatgattctggcctcatagaatgagttagggaagagtccctccttttcaattttttggaataatttcagtaggaattgtaccagctcttctttgtaactctagtagtatttgtctggtcctgtgctgtttttttatttatagctgcttattactgcacaatttcagaactcattattggtctagtcagggattcaatttcttcctgcttcagtcttgggagggtgtatgtgtccaggaatttatccatttcttctagattttctagtttatgtgcatagaggtgtttatagtattctctaatggttgtttgtatttctgtggcattagtcgtgatatccccttatcatttctgattgtgtttatttgaatcttctcttttttcttctttattagctagctagaagtctattttattaatttttttcaaaatccaactcctggagaaatacggaacacttcacaaatttgcatgtaatccttgtgcaggggccatgctactcttctctgtatcacttcagttttagtatatgtgctgctaaagcaagcacaaacacaagtcttgactaagccatctaaactatttttcatctctcttatatcataatataaaagatcatagtaaaaaaaatctgtcaacaaagaataaaagacaatactagaccacgtgtttattttatcttgtattttctggatatagattggtcttatcacatagagaactaacagttcccctaatggttcgggtattgatatgcttttagatctgtatatgttttgtcagtaaaacaaagataacagctctttgattctgccaaccaaggttggctctattcttgcatgaagagtcagctttaagtatatttctaaccaccataacatatttttcattgctctgaaatactagcctattttgctcgttattggcttcatgacctgagtcttttacttctgagaccatagtgaagatgctctattgaaaaagggccttcatatttattcatgtgaacaaaatatacatacgaaaatgagtacgcatgtgcacacacatgtatacaggcacacacacaaagataaatatttaacagtgaaccaggctctgcactagaatctgcaggtataacaaagaactctgtacttatgggaggttaaagtttgagagacatgtggaatggaaaggcattgaaaatgatacagagcaatttatcctggccccgcatttgtgccaactgaggagttacaaaaaatactgtttctgggttccactcaaaatcaaataaatcaaaatgtctggttatgggaccaaccgtatgtattttaaaaattttcccaggaggcactaatgtgtaacaaatactgaaaatactcataaagagcacctttatctgagatcaaatgaaatcgtttctgtgccacctttcttccactgcagtcctcttgcttcatactcccagatttagcaagaagaaaatgaattataacattgggataaagggccagttgatggtgcttggagtttattcatgtatttattctgcaaacattcagtgagcacctattatgagctgtgtgctgggcactctggtggtagttgctaatacaaaattaacaagacattgtttctgctatatcaattaggaaagacaagtaagtaatctgtgattacattcctgaatgagaagtgcaacattgtgagggtaaatttaagttaagtaaaagtgtgaaacctggacatgggtttttaaaacaaaaggaagaagttcctttttctcttttctgttttgccatttaattcatttgcagaagaaaacaggtaatttgaccatggattttttgcttattttgaccttctgtttatttttactttttttttctccttgcctcttgtatttcctgtaaactgttagctaaatctagagacttgttcatattcaggttcgagtatgggctggaatacttcatcagtaatgttgagtacttccatcaagagacccatgctacctgttttaagtgtctttttggattttatggaccattattttcattccctaaatccagtattttgtcaagaactttaagtggttattttcttttactccttcttagtatatttgccataattttctatgaagagaaactttctctgattgactagttatgctgcagtacagtgggtataggaaaatcaagataaaggcttgcttctttatcagttttcaaaatgatgagttggtacttgaatatcagttaaagtagactgctgaaggatttttcctgttatcattatgaactaatgtttttaaaaattaatctcctcagtccattacattttttttccctgaataatcccaactttggtcaatgacagccacttcagattggctccagagaactttagacttgaccccggtcatcattgataacttccttgtttctggtatgataaaatgtaaccaacatatcttataccattcctgatctacactgagaaccagtcagcccaacaagtaacttagtgggtgttggtgtttagggactcaatctgaaaacttacctggagttatataacctagggaggatggcagtgcttttctgagaatgagcaagaaaatgggcattccacataggctgaggagtgcatggtggtgtgcaggaaaatcatgccatagagacaacagccttttaaaattctttttccttactatttttaatcctctaaggcatatgtttgcaggctctttctccatggcttacctcctttgatgatgaaaaggtgtgtgataatagcaggcaatcgttttataaattaccacttcatttcatggggttctgtgtctgtcaaggtatatgacaatcaggaaatgcttactgaatagtcactatgctagctttaagggattcaaacaggattaaaaccttatttcacgttgtccttcaggttatttcaatagagtgatgaatgctattgttggagcccagaacaagaaagtaataaattctgcctgagtgaaaaagagaagcagtcatgcagtgagttttcataaaggtcttaaaggaataaaactttggtgtgtgtgtacgtatgtaacaggggatagggagttggggcattatttaaaacagaacagctgtaataaagacaaagacacagtgatttaaaagtggaaaggtagtagatccaggtggttagagtatagagtgcctgggtggaagttccaacattatgctgagaagacactttcagtcagtttgttggtgtagcaaggtcacttataaagttattatctaaacttgaataatcacagttggcattaaatagagaggcatatattatgagacactgtacaaatagaacagtcattctggtgagtggatgtgaggaaagatttaaatatgacaacataattttgttatgatgactgttattagagcttggatgataatggagtgagaccaaagtagggtagttagagctcagaaatagccagacaagacagagaaggatattaaaggatttttttaaaaatcacaaaacataaagaaatcaaaaagtagacaatcaagtatccaagaaatttactggtaaatgtcagataattggcaggaaagctattgaggttaaatgttcaacaacacatccatccatccatccatccatccatccatccatccatccatccatttattcattcattcgtaatcatttactcaatgattatcaaggcctattatgttcatgtgtcttgcaagaaacacatagaaaaataaaacttggtcccaccctttgaaatggtgtaatacagtaatagataactgagattcacagccacaactttcagtctagtgttggttttgtcagatcacccctggacagtccatctcactgggtacactttgactctgtatgttaaaccaaagtaattcggcagtcatcccttttcactaaatgttgacactaggtgatcatgaatagtctctgggcttgggcagggccatttgggaattaccattttggaacacccatgtgcttctgagcatttttttttaatttcaacttttattttagatagagggggtacccgtgcaggtttgttacatgggtatattgcatccaggtagtgagcatagtccccagtagttagttattcagcccacatcttctccctcccccctccccccccccccactctattagttcacagtgtctgttgttcccatctttatgtccatgtgtgctcagtgtttaattcccacttataagtgagagcatgtgatatttggtattctgttcctgcattaatttgcttaagattctggagctgagcatgctgttgatcaagtctgtccacatcaaatgtcaaggattcaaaacaccctatcatataagatggccattcactttttacagtccagacctcaagtcagtggtgtacttccattactaatggagaaggtgtgtcccaactcctgccctagattcataccatagctaagtaaatgaaaaattctcaaaaaattatctacttattaaaataagcataacttattttctgtcaaacaccaagtattttgcatctgtttgtaaatagagcagtttgcaaactacaagtgcgcatttcaaccgattcctagtcttttcactctctctttatgttcatctttcttaatatagtctcaaaacacccccaaggggattggtgctgattcttgcttattttatatcaaaattcttgagagcttgttcctctgaaacagggctctttttttccttcattttaaggcatcttctctgactatttcctgctgaaaaaaaaaaactaataataacctcccacctcttgcactaatttcccactgataatgggatcctggtcatggactttctgcctaagatcacttttaatattttttccctaaaaatacagatgaaggacttcaaagctcttttgttgttttttatacttttcccacttgaggagttacacaactcttgctgctggacattcaactcatattgaacacaatacttgtacacaaattagcaatttctgttgactatcccttgagaaagagaaatgtcagacatctgatctcccccaaacaaagtgatgattataaaaattatgtaaaaaatttcacaatgccttacaccaatgtattatgtacttcttcacatggctatgaagaaatacccaaggctgtgtaatttataaagaaaaagaggtttaatggactcatatttccacatagctgggaaggcctcacaatcatggtggaaggtgaaggaggagcaaagctatgttttacatggcagcaggcaagagtgtgtgtgcaggggaactgccctttataaaaccaccagatcttgtgagcgttaatcactatcatgagaacagcatgggaaagcccacccccatgattcaattgcctcccaccaggtccttctgaagacacattagggattatgggagctataattcaagatgagatttgggtgaggacagagccaaatcatatcattctgcctctggcccctatcaaatgtcatatcctcacatttcaaaacgaatcatgccttcccaacagtcacccgaagtcttaactcatttcatcattaactcaaagtcccacagttcaaagtctcatctgagacaaggccagtcccttctgtttagagcctgtaaaatcaaaagcaagttagttacttcctatatacaatgggggtacaggcattgggtaaatacacctgttccaaatgggagaaactggccaaaacgaagggtctataggccctatgcaagtccaaaatccagcagggcagtcaaatcttaaagctccaaaatgatatcctttgacaccatgtctcacatccaggtcatgctgatgcaagaggtgggctcccacagtcttggccagctctgtctctgtggctttgcgggatacagccctccctgctggctgctgtaataggctggcattgagtgtctgtgtcttttccaggtacacagtgtaaactgttggtggatctaccattctggggtctggaggatgggggccctcttcttgcagctccactaggcagtgccccagtggggactgtgggcgtagggagctctaaccccacatttgccttccacactgccctgtcagaggttctcaatgagggccccatccctgcagcaaacttctgcctgaacatccacgtgtttccatacatcctctgaaatctaggcagaggctcccaaacttcaattcctgacttctgtgcactcacagactcaacaccacatggaagctgccacagcttggggcttccaccctctgaagccctgacctgagctgtaccttggcacagtttagtcaaggctggagcagctgggacacagggcaccaagtaccaaggctacacacagcagtgggggcctgggcccagcccacgaaaccattttttccttctaggcctctgggcctgtgatgggaggggctgctggaaggtctttgacatgccctggaaacattttccccattgtcttggcagttaacatttactcctcattactatgcaaatttatgcagccagcttgattttctcctcagaaaatcagaagatgggtttttcttttctattgcattgtcaggctgcaaattttccaaactgttatgctctgcttcccttttaaacattccaaacattttaaatgttccaaaccatatctttgtgaatgaataaaactaaatgctttaaagagcacccaagtcacatctctaatacttttctgcgtagaaatttcttccaccaaataccctaaatcatctctctcaagttcaaagtttcacagatctctagggcagggtcaaatgctgccagtctcattgctaaagcataacaggagtcacttttactccatttcccaacaagttcctcatctccatcagagaccacctcagcctggactttattgtccatatcattatcagcattttggtcaaagccattcaacaattctctaggaagttccaaactttcccacatcttgtcttatgagccttccaagtttttaggaagttccaaactttcccacattttcctgtcttcttctgagtcctccaactgttccaacctctgcctgttacccagttccaaagtaacttcaacatttttgggtatctttacagcagcaccccattacttcgtactaatttactgtattagtccattttcatattgctatgaagaactacccaagactgggtaatttataaagaaaaagagatttaatggactcacagttccacatgactggggaggtcttataatcatggcagaaggcaaaggaggagcaagggcacatcttacatggtggcaggcaagagaacatgtacaggggaagtgccctttataaaaccttcagatctcatgagacttattcactatcatgagaacagcacaggaaaacctgcccccatgatgcagttacctcccaccaggtccctcccatgacatgtggggattgtgggagctacagttcaagaggagatttgggtgagggcacaaccaaaccatatcaaccaaaaagctccagtttctgtaaatgtgttcatgttattgcactagtcaaatctgcagagaatctacactgtcttccacaaaggctgaactaatttaccctcttaccaacagtgtataagtgttcctttttctccacaaccttgccagcatttgttattttttgactttttaatagtagttattctgactggtgttagatggtatctcattgtgattttgatttgcatttaatgatcagtgatgttaagctttttttcatatgcttggtggccacatgtatgtcttcttttgaaaaatgtctgttcatgttatttgcctactttttaatggggttgtttgttttattgtaaatgtgtttaagttacttgtagatgctgaatattagacctttgtcagatgggtaaactgcaaaaattttctcccattctttaggttgtctgtttactctgttggtagtttcttttgctgtgctgaagctcttcagtttaattaaatctcattttttcaatttttgcttttgttgcaattgctttgggtgtctttgtcatgcaatttttgctcgtacctatatcttgaatgctattgcctaggttgtcttccaggatttttataggtttgggttttacatttacattttacatttaaaatccatcttgagttgatttttgtatatgatgtaaggaaggggtccagttttaatcttctgcatatggctagcctgttatcccagaacaatttattgaatagggaatcctctccccattgctggcttttgtcaggtttgtcaaagatcagataattgtaggtgcacagtcttatttctgggttctctattctgttccattggccctctatgtgtctgttcttccagtaccatgctgctttggttagtctagccctgtagtatactttgaagttgggtagtgcaacgcctccagttttgtttcttttgtttaggattgacttgacaatttaggttcccttttagtttcatatggattttaaaatagttttttctaattctgtgaagaatggcaatggtagtttaatgtgaacagcattgaatctacaaattgctttgggcagtatggctattttcatgatattgatacttcctgtccatgaatatgggattttttttaatttgtgtgatctctgatttctttgagcagtggtttgtagttcactttgtagagatctttcactttcctaattagctgtattcctaagtattttatcctttttgtgacaattgtgaatgggagttcattccttatttggctcttggcttgactgttgttggtgtataagaatgctagtaattttttcacattgattttgtatcctgagactttgctgaagttgcttattagcttaagaagcttttgagctgagatggtggggttttctagatataggaccatgtcttctgcaaacagggatagtttaacttcctctctttgtatttgaatgcctttatttctttctcttgcctgattgccctggccagaacttccaatattatattgaatagaaatggtgagagagggcatccttgtctggtgctagttttcaaggggaatgcttccagcttttgcccatttagtatgatattggctgtgactgccctatctttcaacattactctaaacacagcattcttttgtagttatctctggctcttcctactccttccaaaggccaagatgtacactctggatgattacacagtactttaaaagtacttcaaaggtaattctttttatcattatctcatcaaggctgtataatccaggtggacaggaccatttgtcttttattcttagcatatttttagcatatggagaatactcaataaaatttgataaaatttcctttttagctcttagtgcagtcattacttgcttactaggttattacgcatgaaatccaagattacagaacacttagaagaaggtacatttcttatatttttgaaaccaaattgtatacaaagtaagcacagtttgagttaaagttgtttcttggatttattcttacttatgtttatttaaaatttgattataagaagatatatgccaatagtgcagatgtaaaaaaaaaaaaggaagacttaaaatttactgctatctactgttaagtagctctgagttcttaaaaatgtaattatgtttgtaacttgttaaattgaaggtttttaaaccataaaacccataacaaataagatttatcgtatttccaattccatgctgtttgagaaatacatttttttctgaaggcttagcaaataaatatttaagttgaatataaacttgaatttttcactaaacttttaaaatatgcttattaaatgttcttattccttaaattacaatgtaactttggatgacttgggtggttttgagattatttgaagaatctcttttttcaaaagtatgtattaaggtataaccagtccaccaattctgttacttttctactgatgtttttaagaaatttgacttaatagaggcttacaaatggctccttaaataggagataggcgaactgaatggaatagacctaattccccaaatattagtttaaaatttacttcaaaaagataaaaattagtttatacttgaggaatattttcaaaactgaattataaaatgaaattttaggagttgatttttgacttaggtaaccagtatttgatgattttcatgctcatacaaatattatcaaattgaaacatctctttttctctgaaaggccaactttgtttctctgtggaattcctcactgttttatgtgtttggtcacatccaaaaagtttgtctttttgagttcccccttttctgtagatattctccttggcgtttcaccatagtccatagacgttagatcgtcttctccaccatgtatattattcaggtgatgggtgctctaaaagccctgactttacccctatacaatatatgcatgtaacaaaattgcacgtgtactgcgtagatttgtacaaataaaaagggggaaatatattattggtcaccaacaaaaagagcacatgaattggtgaatcttaactaaaaagagaactgcaaggcaattgatgtgttaattagtgtaatgtggcaatcatttcacaattcatgtgtatgtcaaatcattacactgtatatctcgaatatatccaactgttatttgtcaagtatacctcaacaaggctggaaaaaatgggaaaataaataaataaatgaaatgatgagcaataatattttataaatgtccttacatgaaagaatattttctctttggattttttctgatccaagtaattgcaattgcaaaaaccaggaatcactaatgtagagatatggatggccaatttgggttgcttatactatgactatatcagaaatgcagcttattcctttctccaaatagtccctgagattttgcagatgtccatacagcagaaataggtcttagtttgtggcttgcatgcaaatatacaaagcttgattgtaggcataaccccttttttcctatagatagtttatgagaatgttgcaatcaaaaccatgtcctaacattcccagtgtgctcccaaatcccttgtcccagttagcatttagttatgtgagcaaactgatttcacaatgagtccatgagataactgaatctgtctccagaattttagtgtgatcgtgcttaatagcaaatgaccatttaaggtccccacccaatcctaaaacagccttctggatttcaagaagctatataatagctggttatgccatcattaagcctcaattaaatgattattaaggcctttctgtgcttggagttatggggaaacatagaaatgaatgcaaaagttataatcctttcaaaatattttttattgcttgcgcttgattacatattaaaagattttttttttctttttttgagacagagtctcgctttgtcacccaggctggaatgcagtggcctgatctcagctcactgcaacctctgcctcccgggttcaagcaattcttctgctcagcctcccaagtagctaggactacaggcacatgccaccacacctggctaatttttgtatttttagtatggacggggtttcaccatattggccaggctggtctcgaactcccaacctcatgatccactctcttgggcctcccaaagtgctgggattacaggcatgagccaccctgcccgtaatgcactcttgtactttaaaggaagaaatgaagaattaaaggaatgaagaagccaaaagattttatcaaggcagagctatatctattaagccttcaaagctaaacttgtttttcccgagttgtcaatgtcccagataaaataaaatttgatcttgattagccttttattaaatagaccaataaaaagttaaaattattatgtttgtaaaatgtattttgaataacatggttcagatattttcatatagcagtaagtatagattggaaataatataaacagttaaacctggtcattgtactacttataaccttaaaaggaaataaaagtataaatgggaataggaatagattacctactaagaaatgatatgttataatagcaagaataaataatttgcctatttcttaatgatctgaacaaaatgtgtttttcagagattttttgaatcagaaaagtgtacctataacatattctatctaagaatttaaactggtgataaaactggaaatagaaaagaataaagattgcttctaaatagaaaatgcttaaaaccagcagtatttattgatattttgtgcaataaaagaaaatgaaagatgcagttatttcagctgctttctcaggtaaagctgtttttaaagaaaacttcttaaagctatggctaacccagctcccacgtgaaatgactttttttatgacattttcaatgtaccttcaatgcatgtacttctagtctaaattattagcctaggctactttccctttactcacctcagatagcatttttcaagaaataaacttatgtacatcacaagtggaaaataaaaccacgttctatttcttcatttataggaggttgaacttctctggagtgctagagctatagatttttctggatgtgtgcttcagagtgaagtcaagtgatattacttttctcttaaattaccaaccaattgaaaaaaaatccttagttctaaatttcaaattccaccgatatcataagtcatacaaaagcactttgcttttcaccctttattttttaacattgtctatatgggaatggacaactcttgattactacagctaaattgtcagttttatgaattacttcctataaaaatgacctcctttgccctgcaagtatagtttttttgttgtttttttgtttttgtttttgtttttgagatggagtctcactttgtcacccaagctggagtgcagtggcgatatctcagctcactgcaacctccacaccccaggttcaagcgattctcctgcctcagcctcccaggtagctgagattttaggtatgcaccaccacacccggataatttttttcacatttttagtagacacagggtttcaccatgttggccaggctggtttcaaactcctgatctaaaatgatccacccacctcggcctcccaaagtgctaggattacaggcgtgagccactgtgcccagccaagtgtagcgttttttaatgcaaacaagcatatgataaggaatttaaaaggaggctgcaaaaggtcagaaaaattgtacaaacctatttcaacatggagttctttcttgagtctctttattactttcacatttcctgcagaaagctaaaagttcactagcaacagtgcataaaagaaataatagtaaggcggtgtaatcactaaggagctgaagcactggcatctcttaaaatgctggattacctcagtgctgatcagtggaaaatcaaaaaggatgagaaggatgacaaacacttttgagctctgaatgaagaggatactgccttgctgaaaaatcgtggtcagagcacttattctaggcagattaagcaggttgagaatgacattcaacaacttcttaagaaaattaattatctcagtagtgttaaagagtctgacactagcctggccaccaccagcactctgggatttggctgcaaataagcaaatgctccagggtgaacaatgtttacaggttgcaaggtgtagaaagatagtaaatgctgattctgagaactcaaaatacattgtcaatgtggagcagattgctaagtttatggcagacctcagtgatctactgacattgaggcagggatgaaatttgatgtggaagaatgtaagtattaaattcatattcccatactttctaagattgatccaacaattaccatgatgccagtggagtaaaaacctgatgtcatatacagtgatgttgttggctgtagggaacagattgagacattgtaagtagttgaaaccccactacttcatccagagagatttgttaaccttggcatggagcctcccaagagtgtgctctttggtccactaggtgcaagacactctgtgcttaggtggttgctaaataggactgatgcttgcttcattgagttattggatattaacttttacagaaatatatctgcaaaggggctggaatgattcatgagctcttcccaatggccagaacaagaaacgcctgccttatcttctttgatgaaactgatgctattggaagagctcagtttgatgatggtgctggaggtgacaatgaagtacagagaaaaatgtgagaactaattcatcagttggatggctttgaccctcaaggcaatattaagtgctgatggccactaacagacctgatactttggattcagcactgatgaagccagggaaattggatagaaagattgaatttagtttacctgatctagagggtcagactcacatctttattttttttcttttttttaaaattatactttaagttttagggtacatgtgcacaacgtgcaggtttgttacatgtatatacatgtgccatgttggtgtgctgcacccattaactcgtcatttaatattaggtatatctcctaatgctatccctccccactccccccaccccacgacaggccccggtgtgtgatgttcccttcctgtgtccatgtgttctcattgttcaattcccacctatgagtgagaacatgcggtgtttggttttttgtccttgcgatagtttgctgagaatgatggttttcagcttcatccatgtccctacaaaggtcatgaactcatcttttttatggctgcatagtattccatggtatatatgtgccacattttcttaacccagtctatcattgttggacatttggcttggttccaagtctttgctattgtgaatagtgccccaataaacatacgtgtgcatgtgtctttatagcagcatgatttataatcctttgggtatatacccagtaatgggatggctgggtcaaatggtatttctagtactagatccctgaggaatcgccacactgacttccacaatgattgaactagtttacagtcccacaacagtttaaaagtgttcctatttctccacatcctctccagcacctgttgtttcctgactttttaatgactgccattctaactggtgtgagatggtatctcattgtggttttgatttgcatttctctgatggccagtgatgatgggcattttttcatgtgtcttttggctgcataaatgtcttcttttgagaagtgtctgttcatatccttcgcccacttgttgatggggttgtttgttttttttcttgtaaatttgttggagttcattgtagattctggatattagcccttcgtcagatgagtaggttgcaaaaattttctcccattctgtaggttgcttgttcactctgttggtagtttcttttgctgtgcagaagctctttagtttcattagatcccatttgtcaattttggcttttgttgccattgcttttggtgttttagacatgaagtccttgcccattcctatgtcctgaatggtaatgcctaggttttcttctagggtttttatggttttaggtctaacatttaagtctttaatccatcttgaattaatttttgtataaggtgtaaggaagggatccagtttcagctttctacatatggctagccagttttcccaggaccatttattaaatagggaatcctttccccatttcttgattttgtcaggtttgtcaaagatcagatagttgtagatatgtggcattatttctatgggctctgttctgttccattggtctatatctctgttttggtaccagtaccatggtgttttggttcccgtagccttgtagtatagtttgaagtcaggtagcatgatgtctccagctttgctctttttgcttaggattatcttggcaatgtgggctcattttgcttccatatgaacattaaagtagttttttccaattctgtgaagaaagttattggtagcttgatggggatggcattgaatctataaattaccttgggcagtacagccattttcactgtattcctatccatgagcatggaatgcccttccatttgcttgtgtcctcttttattttgttgagcagtggtttgtagttctcctcgaagaggtccttcacatcccttgtaaattggattcctaggtattttattctctttgaagcaattgtgaatgggagttcactcatgatttgactctctgtctgttattggtgtataggaatgcttgtgatttttgcacattgattttgtatcctaactgtttgccgcagttgcttatcagcttaaggagagtttgggctgagacaatggggttttctaaatgtacaatcatgtcatctgcaaacagggacaatttgacttcctcttttcctaattgaataccctttatttcctttttccgcctgattgccctggccagaacttccaacactatgttgaatcggagtggtgagagagggcatccctgtcttgtgccagttttcaaagggaatgcttacagtttttgcccattcagtatgatattggctgtgggtttgtcatagatagctcttatcattttgagatacgtcccatcaatacctaatttattgagagtttttagcatgaagggctgttggattttgtcaaaggccttttctgcatctattgagatgatcatgtggcttttgtctttggttctgtttatatgctggattacgtttattgatttgtgtgtgttgaaccagccttgcatcccagggatgaagcccacttgatcatggtggataagctttttgatgtgctgctggatttggtttgccattattgtattgaggatttttgcatcaatgttcatcagggttattggtctaaaattctctttttttgttgtgtctctgccaggctttggtatcaggatgatgctggcctcataaaatgagttagggaggattccttctttttctattgattggaatagtttcagaaggaatggtactagcttttccttttacctctggtagaattcggctgcgaatccatctggtcctggacgttttttggttggtaggctattaattattgcctcaatttcagagcctgttattggtctattcagagattcaacttcttcctggtttagtgttgggagagtgtatgtgtcgaggaatttatccatttcttctagattttctagtctatttgtgtagaggtgtttatagtattctctgatggtattttgtatttctgtgggatcagtggtgatatcccctttatcagtttttattgcgtctttttgattcgtctctcttttcttctttattagtcttgctagcggtctatcaattttgttgatcttttcaaaaaaccagctcctggattcattgattttttgatgggtttttttttgtctctatttccttcagttctgctctgaccttagttatttcttgccttctgctagcttttgaatgtgtttgctcttgcttctctagttcttttaattgtgatgttagggtgtcaattttagatctttcctgctttctcctgtgggcatttagtgctataaatttccctctacacactgctttgaatgttttccagagattctggtatgttgtgtctctgttctcattgatttcaaacaccatctttatctctgccttcattttgttatgtacccagtagtcattcaggagcaggtttttcagtttccatgtagttgagtggttttgagtgagtttcttaatcctgagttctagtttgattgcactgtggtctgagagacagtttcttataatttctgttcttttgcatttgctgaggagagctttacttccaagtatgtggtcaattttggaataggtgtggtgtggtgctgaaaagaatgtatattctgttgatttggggtggagagttctgtagatgtctattaggtctgcttggtgcagagctgagttcaattcctggataaccttgttaactttctgtctcgttgatctttctaatgttgacagtggggtgttaaagtctcccattattatagtgtagcagtctaagtctatttgtaggtctctaaggatttgctttatgaatctgggtgctcctgtattgggtgcatataagattcatacttgttcaatggatgttgaaagataccagatttgcatggttagcacaactacatctatacagcactggggctgagattagacgcttttgtgtagaagctaggtttttttgttttgttgttttgtttttggttttggttttggttttggttttgaaactgagtctcacactgtcacccaggctggagtgcagtggcacaatcccggttcactgcaacctccgcctcctgatttcaagcgattctcctgccacatcctcctgagttgctgggattataggcatgtgccaccatgcccagcttattctgtatattaagtagagaccaagtttcactatattagccagactgatctcgaactcccgatcaggaactctcgatccctcaggtgatccacccacctcagcctcccaaagtggtgggattacaggcgttgagccatgcctggctgtagctggtatgtttttgatcagagcatggtaaaaaaatgctactgaggattgcttggaagacgtaaataagatcattaactattatgccaaattcagcactactcactgctaacatgacatgactgagccctgaaggctttcaaatgaaaacacatcttttcattggaatcctaactttgtatggagttgttaataaccacttcacaaaaaagacttcaacattataaaataataatagtaattgtcatttactgaatacgtgatacttgtgccaagttactgtgctgaccatttatgtttatttgataaatatttattgagtacccactatgaattaggatgaggaagatgatcactgccttcaaggagcatataatcaaatataaacagatatgcccaaggcaatgataaggagactcagtgggaattatgaaagcaccgactagcctgaggtaaagctttctggaaaagtttttgattgagctccatattaaagaaattagaagattgcatttgaagatgaagagaaatgacatcctaagcaatgaatttgtgtggacaaaagcattgatgagaaaacactatctgtgttcaaagaactacaaagaagttagtatttgaaaggtcagaactgagaagacctgaggctggaaaggtatgcagaattaaaatcgtgtaagaattggcatgacattttaagatacccaaacttttttctgtaggtgagagaaatcaatcaagactttgaaaggccatacatggcatatatgcataccttacatacatgtcagggtacagtttgtatttatgaagatgtattagttcaggctgccctgtcaaattgtcatagatagggaagtttaagcaacagcaatttattttttgcacagtttaggaggtagagaaatcaatcatccaggggctggcaaagcaagttttacctgaggcctcctctcagctggtaggcagtcgccattttgctgtgtgctcacgtgacttctttgtgggagcaaagagagagcaagctctctggtgtctttccttatgaaggcactaatcctattatgaggattctaccctcatgacctcgtctaactcattacctcccaaaggccccatttccaaatacaatcacattggaggctggggttttgacatgggaatgtattgagacacaaacattgagtccataacaggggagaaggaaagaaacagaagagcagccgtgaggtgaaatcagtgggtttgaatggtcatttgattgattgattgattgattgtagctcagagagaagatacagtctacttttttctctacccattgtaacccatcaactctatgccaccaggtgaggctactgcactagtcttcatcctagttcccttcctgctctttacccaacccccaccatcgtctccactaccagccctcattccaccaccctcctcagcactattcagctcctttctagtacctgattctctcccaatttaggacatttgcacattctagtggagaaaataggtaagtatacaaataaatgcaactcagtatgctaagtactactgaatcacagaagttactaatggtagtatagtcagttctgttataaatatgacatacatgttcctgaaaaattatcacaccatgtagaattacacaatttaaaaaacacagggctaatgatcaaatgggcttggagttcagcattcaaaaattttgtcactgccatatttttaaaaataagaatctaatgaaaatgacaatgtttgtgtgtgtgtgaatagttaagaaacacatacatgatacaataatgtgggtatttttaccataaaatctggtttgcttttggaagtgagtattaaaagggttgcagcttgtgaattattaggaagtaggaggacagtgagctgaaatcagaggaaaggttgtattaggtgcagataggtgtggcttataaaacacccagtgaatggagagagctggtgcatgtttgtggtatgtgtggattagggtacattttgtgtatctccacttagcttggacacagctggtgcagtttttttgcattccccacatgtttctcatggaggaaatcatgcataagtaaccttaatttttttctttttatcaattcctttagaacaaatttactttttcaaaacaggcattatagcaaaactgacaataattgtgccatgaacagttggaaaaattatcacaaaagtggtgaagtaaactgagccttctaacatgaaaagctatatatcagcagaaaagaggaaagggaaccaggccaaggaaacaacatgcatagaggggaccaagtgtgaaagagaacatcatgtttggcaaactgccagcatgttatttagctatattaatacatcatattgtttgtttgtttgtttgtttgttttgagactgggttcagctctgtcgcccaacctggagtgcagtggtgcaatctcagttcactgcaacctccacctcccgggttcaagcaattctcctgcctcagcctcctgagtgtttgggattacaggtgcatgccaccacgcccagctaatttttgtatttttagtagagactgggtttcaccatgttggccaggctggtctcaaactcctgacctcaaatgatcctcccatctcggcctcccaaagtgctgggattttaggcatgaaccaccacacccaaccattacatcataatgtttttaaaagttttatcaaacatattttcatcatcataagtgttgtaattcacttccttttccaacatttgattatttatttcttattccccccaatgacgggaaaaataatttgacttcatttgatgtctaaaaccttcattttatatatgtgcctttctttttgtgtaacccacctaataacatggcaacattgtaaaaatttcaaatactttcactctaactgaattaactttgccttgacattaaatattacaaatagtctttccatgttagaaaatatctttcacatactttgaaataacaaaaatggcaacttcatgaattctaatccaggggtaatcatgttttcattttttgtgttctgatatattacaaacttgatggtttaaattaatgttaattagaatttttaattcagccaaagaaatattgttccttgaggtttaacctattctatttcaaattaacaaaatacaaaatgtattcttatattacatggattcattaaatcaattaatagtcacttattaaatgcctaccatatgcataaaatgatcttagggtctatgagtctatttcatttcatttcatgtcttataatttccaatgttccctcttgttgagtattgtatatctgtactcagaacactcttgatagaagcacatcgaatgggaaaaaatacccgagtgaaaacaacattattatttcactcaactgattaggttaattgatttcctgatagacgtaggccttattccacatggatgatcaaatttattatagtttccgatcctttgagaacactgaaatctaagttttacagtgacttactgctttatatagacaagtatcttgtttagctcagttacttgaaacacaaaaaattgtaataatttaaaaaatgtgttgcataattggcaaaattactgaacctattcaaactacttgtagtacactgaattttttagggttctatgaagtactctacagaagttttctagaaacttcttttattttctgcaaaaattctgtaattttttttgtttggggtattcactctctcactacatcttgaagacagttgtgtcattgaaattgctgagattgttaatgtaatgactgttataatgcaagctctgttaggtaaatcctttgattcttatttttatttctcatgatcccatccacctttttgctcagttcattttttgggcactttacagacagaaataatatgagaaagataatatactcataatcagttaattctactctttttggggataaataaaagaaaaagaatttaaatggacaaatggacactcaaagtatttcatttatttaattcctcccccaattgccattgatgaactaagctacttctcactcctcatagtttttttttttctttagcttaggaacgcatatttgtaatatgaaacaatgctggataagacttgcctttctgtgttaaataatatgtaatattcatcagtatagaatttatttggaagaggccttggaattccataatctagaatgttaggtgacaaaataacaggatacaaataaaggcaaatatgtatccaataagataatttcaaaatatactacaatgttgtagtaatcgaaacagcctgatgctggcataaaaacagatatatagattgaaggaacaaaagagagaacccagaaatacaaccacacatatgtgatcaattaaagtgtcccaagaacacacaatggggaaaggaaaatcacttcgataagtgttgctgggaaaactggacatcttaatgcagcagaagaaaaaaacttgattcttgttttaccctatatacaaaaatcaactcaaaattgattaaagatttaaacataagacctgaaactgtaaaactagtagaaaaaaacatagggaaaaagctttttttacattaatctgggcaatgcttttttactataaccccaaaagcaaaggcaacaagagtaaaagtagaaaaataggattgcatcaaactaagaagctttttcacagcaagggaaacaatcatggagtgaagagtcaacctatgaaatgggagaaaatatttgcaaacaatacatctcaaaatgggttaatatctaaaatacgtaagaaactcaatagcgaacagcaaataatctgattaagaaatggttaaagggatgtcgaaagaatttctcaagagaagacatacaaagggccaacaggtatacgaaaaaaaatttcaacatcgctaactatcaggaaaatgcaaatccaaaccgcaataagatattaactcatacactattagactgactcatacacattggaatgactttttttctttttttttttaaatttattattatactttaagttttagggtacatgtgcacaatgtgcaggttagttacatatgtatacatgtgccatgctggtgcgctgcacccactaactcgtcatctagcattaggtatatctgccaatgctatccctcccccaacccccgaccgcacaacagtccccagagtgtgatgttccccttcctgtgtccatgtgttctcattgttcaattcccacctatgagtaagaatatgcggtgtttggttttttgttcttgcgatagtttactgagaatgatgatttccaatttcatccatgtccctacaaaggtcatgaactcatcatttttatggctgcatagtattccatggggtatatgtgccacattttcttaatccagtctatcattgttggacatttggcttggttccaagtctttgctattgtgaatagtgccgcaataaacatacgtgtgcatgtgtctttatagcagcatgatttatagtcctttgggtatatacccagtaatgggatggctgggtcaaatggtatttctagttctagatccctgaggaatcaccacactgacttccacaagggttgaactagtttacagtcccaccaacagtgtaaaagtgttcctatttctccacatcctctccagcacctgttgtttcctgactttttaatgtttgccattctaactggtgtgagatgatatctcattatggttttgatttgcatttctctgatggccagtgatggtgaggattttttcatgtgctttttggaatgactattttcaaaaagacaaaagatagcaagtgtcatcaagtgtggaaaaaaaacagttttacagttgatgtgaatataaattggtacagccctgatggaacagtattgaggttcctcaaaaaattaaatctggaacagctacatcatccagtaattacactacttgtatattgaaaggaaatgaaatcagtatgtggaaatatcatcactcctctgttcattgcagcattattcacaacatccaagatatgaaatcaacctaagtttccatcagcgaatgaatggataaagaaaatgtggcacatataaatacagtggaatattattgagccttaaaaaatggaggaaatcttgtcttttataaccacatggatgtatttagaggacatgatgctaaattaaataagcgaggcacagaaagacaaatactacatgatctcatttacatgtggaatctaaaaaaatcaaatccataaaagcagataataggatggtagttggcaggggctgaagaatgggagaaattggaagatattggtcaaagagtataaagttgcagttttgcaggatgaataagtttgggagacctaacctacagaatggtggctatagctagtgctgggagagtagaccttaaatggtctcatcacacaaaaatggtaatggatgtgttaagtggcttcattatggtaatcatttcttaatttgtatgtatatcaaaacatatacaattataaattgtaaatatatacaatttttatctgttaattatacttcaataaagctagaaaatttaaaaacaaaaaaatttaaaaataaatttctaaggtaaaggaactattgtttttaataaaattaactgtttctcacatgcatataacatagaaatccatctttaagtcttatagccaaatattaaatattttaaatcagaaaattaaagagaagaaagtggatgataaattctaaagctggattatgaggacccagattttggagatattggtgatatcatccattaattcacattttaaaataaatttatcagtgaagcaaagttatagaaatgtaactatataggtggaaaatgacataactactttcaaatggtggaattgctaattttttatctttgtaagactgatttttgaggttaaaagaaaaagaaatctagcatctccaagcattttatagtaataacattttccaggcaagtcaaagcactgtttgaagaatttccacatgtctggcatttattaaacctaaaagttaaaattactttctttagttttattagactacaaacattttgtattgtttgtcaggataactttatatgggatctagaaatgataaatgggcttgtgatgaactctcctgaaggaaagccaaagggactttggtttctgtcatatataaaatacggcattctggtttacaaggaggttatctttgtccacagatcactcttgagatagaatctagggcactctggccatctctggctatttgcaagtacagattatatttcagttctctaaatgtttttgctggaagaaaatctgtgcactttaatcatagtttattttcatcattaagtagttgaaatgacagtgaattgagaaagattcaaaaacaaagagtaagacttccaaatcattatctgattatattcctaaggagctaagcacagccccatttaattaaagaaagagcaaatgagcaccttctaaaccaaacatgctgggctttcttcctcccccctcccctcatatcttgtatagaagtggtgaggcctatatcagatggattcctggggtgctaggaaagcaatagaagagagtgagtcccctggaggaaagggaggaaagggatattccaggtagatagaaagcacatgcaaaagaagtgatactaaaataactggagtgagaaaatatagtccaactttctcatgtgcatagatacaaaaatcctaaacaagagcaaaatattagcaaatcaaatgcagtgattcatagaaagtataaaatatcatgatcacattgggtttattctagaaatgcagatatggtaaaacatttaaaaatataccaaaatatttcacaataaatgagaaaaaattatacatcagtagatatatttgaccaaattcaatatccaatcatgatttttaaaaaaaactttggaaaatcaaaatagaagggatgtctttaatgtaacaagtttctgaaaatagaaaaacatgcacatgagtaaaatcatgcttagcaatgaattattgaaactttacgccttgaaatgaagagtgagaaaaagatgcacattctcaccacttatatttagtattacactagatgtcatagccactgaagacagaaataaaaaacatccctatttatagacaacttgattgaacatatagaaaaatcaaaaacaatatggactgctcagttagaattagttaagaagttccagaaggtcaatatacaaagtcatttttcattctatgtaccagcaatagcaatcaaacatagaatatgaaattttaaaggggtatcacttagaatagcttttacaattctaatgtttcagcataaatctaatggaaggtgtgtaagaccactaccctgaaacctgcaaaacctgttcatggatttgaagacctaaatatcatttctcacaaattaatctatagatttagtgaaatatctatttctcacaaattaatctgtagatttagtgaaatatctatttcaactatttctggtattcatccttttgctgcagaaactgaaaagctaaaaatgcaaagtatgtagcattattttgcatgtgtatgttgtaacaggtatggcatagttcaggatctggctgtttttctaaatgcttgagtcttgttggttgtagcagtgacagtgatggcagattatctggatgtgtcaatgtaatcacaagaatccttctactggagaggaaggagaatcaaagtaagaaaagggagacatggtaatggatccacgaagtgggatgatgcactaagttgaaggaagaggccatgagccaagggtggtaggtagcctctagaagttagaaaaggcaagcaaacaaattatctcctgaaatcttcataaataacatagcccaaccacaccttattttaaatgtctaacttccaagatcatcagagtaaatttgtgtggttttaaattatcaaatttttggtaatttgttaaagcaacaatagaaaactaatacactcatttgattcataaatatttgtagagcaactaatatatctcggacactggctggctgttggggataaatgtattagcccattctcacactgctaaaaagaagtgcctgagactgagcaatttataaagcaaagaggtttaattgacttacagtttcacatagctggggaggcctcacaaaacttacaatcatgcagaaggggaagcaaacacgtccttcttcacatgatggcaggaagaagaaatgtcaagcaaaaggggaaaagcccattataaaaccaacagatctcatgagaactcactatcacaagaatagcatggaagtaactgccccatgattcaattaccttccactgggtccctcccacaacacatggggattatgggaaaaacaattgaagatgagattttggtggggacatagccaaaccatattaatataatagcaaatgaaaacttgaagaggagagaatatttttagacgcattttatgaggccagcattactctgataccaaagcctgacaaaggcactacaagaagaaaaattacaggctgatattcctgatgaacatagatgtaaaaattctcaacaaaatagaagcaaataaaattcagcaacattttaaaagaatcagtgatcattatcaagtggaatttatccctgggatataagaatcattcaaatatgtaaatcaataaatgtgattcaccgtattaacataatgaaggagaaaaaccatatgatcacctcaaagatgaagaaaaatacatttcacaaaatttaacattctttcatgattaaaaaaaagctctcaacaaattaggtataaaaataatgtacctctacacaataaaggccatatctgaggaacccacagctaacatttaaccaatggtggaaagttgaaagttcttctatgattaggaacaagaaccccactctctccacttctatgcaacatagcactggaagtcctagccaaagcaattgggtaagacaaagaaataaaaggcatccaaattggaaaggaaggagttgaattttctgtttgcagatgacatgatcttatatagagaaatcctaaagactccaccaaaaatctgattcatatcagtccattagaactgataaacaaattcattaaagttgcaggatacaaaatcaacatgccaagatcagtagcattcactaacaaactattgggaaaaaaagattaagaaaacaatctcgtttacatagcatcataaaaaatatattcatgagtaaatttaagcaaggaggtgaaacacctgtataatgagaactatacaacagggatgaaagaaattgtagaagacacaaataagtagaaaaatgcctgtgtttatggattaaaagaattaatattttttaaatgactactcaaagcaatctgtagattcaatgaaatactcaccataattccaatgacattctccacagaaatagaaaaagcaatcctaaaatatgtatggaaccacagaagaccttgaatagccaaggtaatcttgaacaaaaagaacacagctggaagcatcattttacctaactttaaaatatattacaaagctatagtaatcaaagtggcatggtactgtcataaaaacggacacatttgccaataaattattgtcttatgatatgttctaatctaaccagaaacaccggaataggctgtttgttttttgtatatgttgtatttgatatgtgttttgaacatctacatgggtatagccagtaataatagctaacactatacttgtcattattctaagcactttttatgtattaactcatttaattcttgtaacagtcctgtaaatatataatagttgaggaaacatttatagatgagggaactctggtatgaaaatatgaagtataattaacgtcagatattaacaaatatcaagaagaattaggattaaccagaaatgccttgatttggtatttttattataaaagttttcttttttacattttctgaagccatattgattaatcactgtttcttgataatgtgtcaggtctttacacatatgtttcagcagttaatttttatgttgagtaattttttcagctgtcactaacctgttcatgtcatgggcaccaactcacaaacatacatctcagcttacatttttataatatcctctaagacataagtaatttattctgcttctgctgaaaatttccaaaatgtcatgcccagtgatctccatggaattaattcttgtcatatatttattgacatattacagggttttctatcaccactgactgccacttttcaaaactagaaccattatttcaagtgtcagggtactggttacattcattctctttgatataaacagatattttaactggtagttttatagaaatgttatttttgaaaaccttatgaatcacatatctattataagcaaaattttaagattaagatgatggctattttatctttgtccccttgtatcttggacaagtatatacttagtatttgttgcatgaagtaatgaggtatagaattctatttactaattattgtgttcttaatctgagtaatgagaaattgtttgcaccgtgattacaaattggtagcaaacttagcaaaacaaaaaatgtatcaacattatttgttgaacaccaattatgtatcatcatgctgttcttaaatcaacatattccactgaactttctacccctctcagtaattctctcactaatgcttaattattgttacccatgactccattctttaaacactcctaatacagcactcattccctcagcctcagagaagagtggaccagtcattgtcaagggccatttttttcaatacactgtcaaaggaccacaaatctgctatgaacaggatgatgaatcacatgaatgaatatattctgtaagtttgtgatcacttgattagtgtcagtattccccaataaaataaaagctatatgaacaatcatgtctgtttttacttagcattacatcaaccagatgacaaaatttaagtgcacaaagtatattatttaaaagactgaagttaagttcatttaatttaaatgagggatcatatgttaaatcctaaatgttaaaatttaaaaaaaaaaaggttaatcttatccagatgggaacatagctatttatgctactgaaaacacatgtgatcatcaacccaagaaaaaggcaaccataaaaaagaaatttttttcctcatcgaatcaagattaggtagtcacaagctgaaatcttggttccttctttgttatactattttcctacaaacgtttctttaaatggtcttagaagctgggagccaaaggtttttaaaattgaataatcaccttttcacatgctgtatttgtgttcatattttgtgaatcctctaatgattcatttaagtatttactgtgttctccaggtgggctttctatagctttccaaggcatgatttaaaaatattaaaaataatacaagattttgtgtttgccaaactaaagaagttttgaaaataaaatgtgagactctttttttcccaccataatttctgtttctgtatctaaggccgtttaagtaaacatctaaaaacggtttttataatggtaagagaatcatgaatttcatttacatatttactgttcacatactgctgtgctggtaatggcaaatgcagagtttattcaaatagttgtctttgaaacacatataagaggtcaaagaatatccaggtggttctgagccctttagcagacacaaatacacacaaaatgaggtttcgagatggatttctgaaatgcccttgggctatgtaatgctaaattatacctgaaaattcattctattcaactcagcaggctgaagtagctcatcaatgtagtgtaattataactaaataggaacaggaaaggaattaggaggacaggattgctgtgtataatacttttgtagacaggctgaaatgaattctattaatatataatatttatgcaaattttaaattggaaataattagaaattttggagtaaaaatgttgatactattcttagaaacaaaaatatgctgaatatgatccataaattgaaattgatattttttaaagcccataaagaattacttatcatagtattggtctttgtctattttaagcattatatttttaaactatgaataaatcttcttaatgtctagaccaacattttcaaaattgtttggttatgtgtgtgtatgggcacctaattttctgacataatgttatctctttttaattggaaatttgctctgggtcattctaacctacttgattattttccccgaagaacattctccaagtccataatggaccttagattagtgcaaatattatcatttcagtggacttcatgcaccaattaggctttacttgaatatctttagaatcacaatatatgcacctctagaattctttttaacttttaattcaggagtgaaagtgcaggtttgttatacaggtaaacttgtgtcatgggggtttgctgtacagattatttcatcacccaggtattaagcctagtacctattagttattttttctgattttctctcttctcccaccctccaccctccaaaggccctagtgtctgtttttccccgctatgtgtccatatgttctcatcatttagctcccacttacaagggagaacacactgtattctttttctggagtatgaggataggtaagtatcagaatgcattctctattgaaatctcacatatcaaatatattctcccattgtctgacactttaaaagcatgtatatttgccaaaatgacaataactccaataattccaactaaagtaaaatcctaggtagtgttctctattctcaactgttttctgaatttggtttctttgacaattagttttacaacacatgagatagtggtatcatgaactgggtacagtttttgcagctcacaaacgtacacactccagctctgcttctttcttgcaagctctttgaacttggcccttgaacctcggttcccttatctgtaggatgaggactcctacctcgcatcactgctttaaaattaaagcaacataaacaaaatccctcatacaaagcaagcacttaataattgttcatttttatgattccatttagcttctgcaattaattagggaactattttaattaaaatacctcatctatatttaattcattgcttacattataaagctaacattagtgaactctaggggtgatgatgtaaaattataatatagagtcccaatgataataacatatattctttgaagcagaatatgcaagatatcatacagtggagtgcagaatcccagttcatcgtttttttagcatcatgtatttattacctgcctcacaccaagaagaatttgtgccccactaccacatatataaaataaagtagaaatacaatgaattttatatagataaaacacagcagaggaaagaaaccccacagaatagaaagatgaaaccagatgctctagttcagagtccagaaagaagaaagtaagggcaagtttcaggaaagacagacgttgactaagatagaatcagccaggaaaagaggaaggcagaactctgagaagtcagcagtgtgtacaataggatacttgctactttatgtctctgccttcctctacttcacgtgccacgtgccacttgctggtccccaccattgtcctgagtcttctgtgcttggttaagaattttctctagctacaatctggccactgaggaaggacgcatcctgcaaacacctcagaaccgtgttttgctaggaagctttaccactcacaaccctgtggcttttaagataggtaggtacatagatagatagatagatagatagatagatagatagatagatagatagataggataaatagataacagatgaatagatagatagtagatagataagtgtatacatcctattctgtaaactctttcatagtaaaattctatgcataattttcatgatcacagaaactaatatgacttcaaggatgttttaatttctcatcaggattccctataaactcagtactatcccttcatctcaggacacagtggagatgctctgagacaaaagttgtgagctgctgaggaagtattttttataagtaaaagatctctagggagcatggtacagcaattctcccacatcatgcttgtctagtccactcggctgttataataaaatgccatacattgggtggcttataaacaacagaaatttgtttcccagagttctaaaggctgggaaatctaagatcaaagtgctggcagattcagtatcttgtgagggccttctttctggtcaatagaaggcaacttctctttgtgtcctcaggtggaagaggcaagggatctctctggggtctttttaataaaggcactaatcacatttgtgagggttctgctcccatgacctaattacctcccaaaggccccacctttaaatacatcacaggagggattaggtttcaatgcactaattggagaggaacaaaaacatttagaccatagcaatgcacatctccaataaactatataatcacttccatatgtctgtgaggtagtttgttgcagatgatagtaccttttatgtggctatcatccgaaaagagaccttgtacctttttaggttcaggattattttacgttatacctttaaggtaaaatatagccaacatttattaaaaatatattgaagggaggtgaattatttacataggcataagtaatttccttcatacttttaagtataatcgctaggaaattaaagacatttttcaactcttttgtaaccattaaatacttgaacccatccaaaggatatgataaagaagatagaatttcattatccttaaaacactgcaaatttatccaagtataaatgagaaaatcaggcaaccaagaagataaactaagtctggataatcaaatttaggctacaaaaagataaaactcagataaaattgaaaggaaagcatatagagaaagagaagcaacaaaagcaagaatgctaaaaaacaattaccactaaggagatgcagtaaaaataaaatcaattgtaattgtagttataaaggataaacattttaactgtttaatacatgtaagtattaaatatttcagaatcataataattgtaaagatttctttgacattaatgcataggaaactggacaaagtccaaagaaatgaataaaggcttaataataaaacccaattatagtttaaaaaaaatgaaagtctcttccagatacataaaaaaactgaacaaaactaaggagtacagaattgatttgtttgcttatttcacttttagcaacagtcaagaataaagaagcatctttctggaaatcgttatttttccctaatttgaaccaataccacaaatgaaaacttggaccaaacttaagaaagtcttttatttccttcaattcaaaaaagaacaatgataaataaagtaaaatgaggtgttgaatgaaatgacaagatgtttttaatatgatagccgttaaatattttagtaactatttttagattatctacttacaggacagcacttgacttggggcgaatggatgtgggtccagatctccagacagttgtcaagacagcaagtaatttaatatagatgagtgtcaaagatacagatatatatttgtttaattgctgaaaagatgggttggtgattgtgctggggttgaaaattatttggttgttatccttgaaaaaacctgaggaaagtattcatataaagaattcataggaattgtatgaatagggaggtgtttcaaaagaaggaagaatttatctctaagaggagaaaagccagtgttaccacaggggcagctgataagataaggaggaaagggtaagagaagggtcccacccatacatcaggggcgctgggtgatatgaatgacctaggagaaaggttaactgtgagtaactttacatctaaacctgataaacattttctgttcctacctgagaaaggagagttgagatatcacttcctatcactcttggaagccctgattgaagcccctgctgggagtacatggtccaagttgcatgagttcatatacctcatcttccttcagttatcttttcagcaaacttgtaggagctgtctggtctctatcggacatctgtaaatgaagaatttgggcaacagaactttgctgcatcttttcggttttaatatttaattattctagcaattctctgaaacggaaccatcataaaattcaagttaatgatttctatacactctatatacagtgtcttgacaaaatacttagaaggtttatgaaattcaacacgttttaacttgaaaaccagataaagatgtcaatactccgagtgagctaataattcgatacatttgatcttctggaaatatccagttagggtttcatttggaggaaaggatgagggctggaggatcaggaagagagggggtgaggtgactccagtaagacagggtactcacccctgctgcagagctgagaaggcctgttctgtcatcccaagtcagctctggctccaaacttgaatgtccctgccgggaagccagaagccctgcagtcaactggattcacccctcctagaaggtagtttagcacaactagttgttgtggaaacatgtcccttgtggggtgtcatctcctgtttcctgcacaactactcaaagtatcccttcacctcacatggcatgttatgttgaactgtctctggagaaatattagccagattttaatcaggacactatgtctcgccctctgtgacactttattcagacataacctcttagcttcactttactgaagcatcaaataagaatgatgataagaataataaaaatgaaaccaataataacaatacgtacatcataggactgttttcagtgttcaatgaaataatgcatataacatttagaaaagacctcagcacctaatgaacattctctaaattttagctctttttaaatcacacagcattcactccctgtgtcacattctggcaaacatgatgtccttggtttcagtacattactagtgacaccatagagcccttttaggtaagtttcccctagaagctacccagtgcattgccacttaattcagccctaaatcatattggcctagttcctggtaaaatgctctcaacacaactatgtaagtcatgctgtgtccctgaccattacctctacgtgttctcatttggctaaagtttccccattttcaaaattgggatagagatactcaagtaacagaagattatgtgacataatgtatatttagcatagggctagttgcatagtctctctctctctctctctcacacacacacacacacacacacacactcattctttccctttctctcttcctctttccctctccctcctatctcactctcccctctttcttccttttcttcctctctctccttcctttcttctgttattctattactgttaaaaggacagtttatattatacatttatattaaaagtatatatcttataggcttttatttctactgattccttccatcaataaatgaaaggtatagatacaattatttgatttttaatgagaattaatttatcccaatgtatcaatgctcactagatttgcattttaagtgtggagtataaagattcaatttaagtaaaagaaaaacagattgtagggagtagatgaggagaatgtttgttaattaaggcataaaactgattttgcaaacaaaacaactctagcccatttgggattcttgaagagggcaggaagaagagtggggtgcctggacgtgcccttctcttcagcttctctctctgtcccttatgtctatattttttcttcctacttttcggaatgaaggttccccaggttccactttcaccaaggactctgctccccctcagccactgcccctgcctttctctcacctgcctaccctactgcagcatggtgctcatgaagttggcttgtattcaccgggtatatgtaaggtccccaatccctccaagattcaagccactaggcccagatgtgaggttcaggagtagatgctctaaatgcactgaggcgagaaaagtaacataagaaaggattgaggagctggaaattgcctatatggagcctaagaaactcagccctgatataaggtctggaggagaaaggtgggccaaacattgacgagtacaagtctggctgtttgttttagtgtgtatctgtttatatatacatgtggattttaaggtgtataggtgtgatgatcgatgaggctggagggtgggggcttcttgtacatatgaatgaagtgaattgtcacatggtctttccaaaaactgttcagattgatattaattatacataatggagaattaaaagtgtgaaaagtgaaaaactacaaatttgactgtatataatcaaatagtaatgctaatatcaatgacatttgagtcattagtccattactgcctaatcatcaccacgtttattcatatcataaatatataccacctatatactgcctaaaacagaaaaactgttttaattctattgaattgccacagttttcgtgccttgttggtcttatggcattggtgtctaagaaatcagcaaatagcttttataaaggagacattgcttattaaatatggctttgttcctgtgaatttaaaatacatcattagatcttcatacctgtgaatatgtacaatttcatcaaaatctatatactgagaactcacgtaatgagagaatgcattcaaattaacactgggactaaaagatgtgaaatgacaagtattttaattatataaaaaagttactgtagtcaataaacatgaattggctcttgtctaaatttattgaaaaagaatttgtgattgtatggactttatcattgaaacttgtttattaaaatttattcatggccgggcatggtggctcacacctgtaatcccagcactttgggaggccaaggtgggcggatcacctgaggtcaggagttcgagatcagcctggccaacatggcgaaaccctgtctctaccaaaaatataaaaattagctgggcgtggtggcaggcacctgtaatcccagctactcaggaggctgaggcaggagaatcgcttgaacctgggaggcagagtttgcagtgagcctagatcgcacaactgtactccagcctaggtaacagagcgagactctataccaccagccccccaatacacacagacacacacacacacacacacacacacacacacacacaacaactcatttattccacaaatgtttattaagagcctactttgtgccaggcattgatctaacctctggacatacatctctggaaaaaaaatgaagttttatcctcagaaatgtatgttctaataggaagagaaagacagcagtggaatgtacagtaatgcagacactgactatgccctaaagcaagatataaccataggggtctttgacaaacagtcttaccaaagagtttagttcatcaaaagtcaaggacactgaacagaatattgctgaaaacttatagaatattattcttggtatatgtggttacaaaatataattatttaagtaaaaaaaaatcctttacactgaaacaatgcttctatgaagagttatggagatgatatttcccgctactagtaggtagcctggatttgttcacacttaaaaaagaataactttgaacagctgagtatctccacttctgcttcttggcaaaaaggtgaaacttaatacataacaaggaagtcttatgacatagaaatttttcactagcatgtgggtccttctgtattttaaataacaactaatttcagacacccaagtcagcacccaaaggtgtctttgaaaccatgttctcatttggagtgtttgggagaggcagtgttcctgggcttctgctgaatgccaggcattgctctcagaaaaggacagtacaagctataatgaaggcagagcttccaccttgtccacttgagtgacagtgtgaaacatattcagatagggatatgccccaactactgtcaaagtagagaactgaggactaaactgaggccccaggggttgggggtgggggaagcttctggagaggcttcttgcaagcaggagcagagtgcctgctacatagtaggcactcaacaagcctgagaacctattgtgtgcaccttctatgtaaagttctgtggatataaatgtgaaaatgtgcaatttctgttttgcctgagaagtatagactggggaaatagacaaaactaaaattgagaattgctttaataattgaacatacaaagtgtatcagagattctcagaagaaaagaatttagcagagtttcaaaataatatacaaatttcagtattctatagtggttaaaagatatatgaacctaatttttaatttatataaatactaaacaaggtttttatatttagattttcagttttgcaattcttgctaaatatatgaatctattcttaatccaacattgcttcatggacagcagtttagtagtacagatttcattagagaacttaactgctataggatcgggggaggtgaaggaaatacaattttccctagaagatttacattaaacagagtagttacaggctgtagcatctcccctgtaattttatgagaatggtattaccctggctttcactgtgtgattgctggttaccttctgtcagtgagcaacagtcttactgcaaagcaggagcacaacccgtctctttgtctccgtggtcaaatcaattacttcttagaaagtctaatttttttcaaaatgaccatgtacaagagcaaacgcagacatcagagatgtaagtaaaatctgacccaactttttcatatcactggggtagggaaaacatacttgatttcttaaaagactaatcatgacttcttcagatacatcctggtagtagaaaagatactgtagcttttctcaccctaacctttatctttattcctgtaacatgcatgaaagatgttgagggcagaggggataattcgcttgttaccatggaaacccttggaaaggtttacaaaatcaacagagaaacagatcaaatgcaatttcagtctagctcagcatccttcattcaggcatgatcactggacagttctcttttttgcttttctaggagtgatagattttctttcctggaagtctattgaaaggtttgggaagctagcctaaaacttctcgttattcatccaatttcaattacaactcttagggagtagaaagcagttcagaatggaggggagagagttaattgtgaatgacaagctaaatatttaacaggatattcattgccaaacttcttggtccagagcatgctagtgacataattcactacaggcaccatttcaaagggttaaaaggagtcatctgcagtcttccctaaaggaactgattctggctgaaaaggagcagcacaattaccctggcgtaaagtccagaacaaagattattatggaactgaaagctatcaggatcttgctaaaaatcaaaagattgttataacactattttacggtaaagcaatatgcctctcaagaaaagctttacaatcacctctctctagtaagtttaactctttatcactttatcttttctattgtctaaagtaaataataccatatttagcccaaaatggtctgtcactgtctctatttatcgtcatagacaggtaacggcaacttactctgtactcaaagtctgtactttttcattatttcttttgatgtctttaaatgttatcaaatattttgaaaatcaaagtctatcagtcacaattatcctatcaaaaagccaataaatcatataaagataatttttagtgcgataatttattctttggtctgttttcacctaagatctgaaaactaacatttctcctgttcaaagaagtttcatgcaccacagaaagctctgagggctaggctgccagtttgattctgcaagcttgattgccttttgatgccagttctttcttgtgataaagaaacaatatatgataactgctacttttttcaggtaaaaatgattggtgtgaagtctacacatatattgctgattaattttcttgtgatttcctcttacaagaatgaatctaaattatgcatagatttgaaaaccatcttgtgcctttactcctgtatcttttatatatccctcattttttttccttgtggattatcaatgccttaatgcacatggaaaataagagattcacagaaaaattatactgagtgtctccccttaaaatgtgctcactgaagtctgcgattaagcagcaggaagaaattgtgaattacatgagacaagtcagaagatgtataattatacaggcataaacacagtagggtgtactggaatggttcagttaaaaaaactaatgtgttacttaaatttaattgtatcaactattttatgttgcattaagtttttctatattctaataatataaaatatcagagagcaggaacataataaaattaaagtatatagaaagcttagcaataaaagcaaatagaatccttaaatgaatttcttaaactaacaatatttgcaaaagtagaatgtaatacaatggtttgcattccaatgcgtaaacagaaaaactggaattttcccatcaccaaaatccagggcatttccattttcagtcatatcttttatgcgtgggtttttgatcatataaaaggcataaacttacctagaggcaattgtaatccaattaaggcaataattgtacattcaagaaaacctcactgtaggaaagaaggaaagtcttcttacaattttctttaaaaatgagatagtacataaatcaactttctaatttttctcattatccaaagatttaatatggtatcttttagtaaaaataagtgtttcctttcagaggatctgacaaaaggaatagtaaaggtgcatgtggctatgtcaggagtttgaggaaaaaggagagaacaaaaatacttatgagagagattttaaagtacaaattgtactaaacctttgaagattcatgtggggctttgaaattcattctctactcatattgagattagttatttataattcactatacaagaggaggagagggagggaagagtgcccattgccttgcttctgatagtacaattgctaggtaaaaggaacagcttagtgttcactcaaatagcagatcttacttgtgcaaaactgcattaaatactttcaactgtatacagaatattttgagtggtattaaaaaatgtttgcatatatcagatgctgatattgccagagccaaacaggtacagaccaatttaaggaattctaatacatgcaaacctgtttttttaaaattcggattgatttgggaattaatgtttaacttttgagtccatttaaatactaagtttttatacatatataataacaaaatttatttaactgtgaagtttatgtttaaattttcaaaaatttctgtatacaacaaggaaaacctgtaacctcccttgctgaaactccacatgaccttgagaaaacatttttggagttttataaaagacacatgaaggtacatttttaaaaaatgaatatgtttttaaaacactgacgtagaggaaaaagtagagtagaagccataggattttgaaaatagcacaatacctgtgccatggcaaagaaaacagtgtgaatcgagtttcagatatgtaacatttcatcttattttactgaattggaacagatcatgtattttttattcctaataatatctttgggtgagcttatcgaccttatccatattatcatggaaatacttgagatcacttcagaaatctaaatactagtcatcatagccctcttcttatagtcttggccaattatctattatttctgtgggttgcaatctcttctgtaagtttagtagattgcactgagaaagtgttctgtagggtaccttccatctctaaccctcattgcctccataacacaaccctcatcaggtcattcccctactcaaagacattaatggtttctcattgactagataatggtggctctgggcttgtgtgcttcagatccttgggtgcccatggagttactacaaggttactacatattaatatttacataaatatgaatcattgtataatgaagaaaaatatatgtgtatatggacatacacgtgtatatatacataaacatatacatacatatatgcttttaaagttctaaaatatgtttaataaaaacaaatgtatttaaaaggtggtgtactgcatttgtaatagctttttataccatatattttactttaaaaaaaaactatagtacatgcagccctcattatgttttggtattcttttttttaaaaaaaaaacttcatactcccgaaggttgagaatcactgaactagaaagtgagtacaagcaagaccttataatgtagaaatttacatgattgtcatctgcccactactttcttctcttcctggtaccacctatattctaccctttatcaagctaccaattgtcagccaggcgcagtgtctcatgcctgtaatcccagcaatttgggaggccaaggcgggaggattacttgagttcaggagttcaagaccagcctgggcatcatggtgaaaccccatctctactaaaaataccaaaattagctgggcgtggtggcagacacctataatcccagctacatgggaggctgaggcacaataatcgcttgaacccaagaggtggaggttgcagtgagccaagattgcaccactgcactccagcatgagtgacagagctagactccatctcaaaaaaacaaacaaataaacaaaaaagctacgaattgtccttgaaattcactatattctcttatctctatgcctttgcctatttatcttcttgttgatagatggccttcacctgcaccttcacacctctctgttgaaggtttcactcacatgccacatccttcctaaatgcctctccagtttctaagtcaaattgctctttcccttctatcttttcagttcatatatttttgtttgtttgtttgtttgtttgttttgagacagagcctcactctgtcaccaagctggagtgcagcggtacaatctcagctcactgcactgcaaactctgcctccaggttcaagcgattctccttccacagcctcctgagtagctgggattacaggtgcccaccaccatggctggctcatttttgtatttttagtagagatagggtttcaccatgttgcccaggctggtcttgaactcctgacctcaggtgatctgcctgccttggcctcccaaagtgctgggattacagttgtgagccactgcactcggcctcagttcatatattgtaatttttcttaaaatttctatattctgtcttatatatagaaaattatctatttacaccactaatctctaagtttctttcatataaggtattctttattcttgtttgatacattctcagtgcataatatgatgctttgcccatcaaaatccatggctgtctaatgaagtttatcgacttaaatatatatttttgaccacctactactttccagagactgctctaatggtagggctatagcaatgagcaaaacaacattttattgaagataagatgacacacaaataaatatgtaatatgctatgtaatgctaagtgctatggagaaaaataaagcaagtaagggagaaatggagttttggaatgtggagtgaggaatttctattgtctatggggaagtcaggaaaagccacttactaaggggacatttgatcagacaccctaaagaaggaggaaattggttcagtttctctctggatagttacaagtagaaatagcatatgcaaagtccctgaggaacattgggataattgaaggaccaagaaagagtccaataagtagagtgactaaagatgaggtcaaaaaagcatgaggaacattggatagatagagtaggacagacaacagattttaactgaaaagtccatttcatttgtaactgaattaagacataatatgtatatactaacttttagaaatcactatccatatttctaagtgacttgtgcaataatttttaaatgacaagttttaaaagtatttttaaaataatcactctccatacatggcaaggcatgcagtcattgactggaagacaatcaaattttggtcatccagaagtccaaaagatattgtttgaccaggaatattttctgacttatcttcttataaatatccttgtattctttattacaagaattaaaattaagtctacctctctttaaaaatcttcctatgagaaaaagtaaatttacattttgatagaattgttctaaggctttttaaggcattgacagggaaaaacaaggctgttgccagtctcaattgatgtgtaaaattggtctctcagtgatcaacagtgataataggtttgatattttgtaatttttagaatatgacttgtcttagcagtcacatatttattaatgtgttgtgttttatagaagtcttgtttaaaggtacttattgaaattgattacaaattaaatagcaatataaaaatggattatttaaaacaaatacttatgttgataccatgatttctttgtaactgtgaagacagaagaaataatttgttattaattcccaaattacttcatatcttaagtgttgatcttttttgttacctaacgagttgaaaatgtgatctaggttttaaaactttttttaagtttataccagaaaaaacaaactatttttaggcttgattggtaaaggctctctagaggacactattaaattcaatctttgatttctctattattgatgcttgtagggaattctggtatgatatatgcaatgtcttcagccctttttattctcaagttctagtatgaattctataactggtagaaattgagaaattgtaattttatagattcctccatggaatcacatgtgcatggatagaatcagtgcagtctgaatgagcatgcacaatgggactataaatgccagtttgggagcagagacgtacaaaggctgactgataacaccccgatacagattgaccttaaatggaaatgcatattggtctgcctcatatccttaatcacaggcttttacaggctccagcctgtgactggttctgcctgcagaaatatattatctctctctctttctctctctgtgtctctctcagaaaaaaatctgatgatattcatgtatttttctgtttaacaatgccccacacattcaaaggtcacttttgtaccaggtgagcatttgtccatttctctcctgtactttcagaaaacaacttgactatcatatgtcacctgctcttttaatttctcttctaagaatctgtgctgcatttatatctacacttgcataaaaaccgtggcatttactctgtccccaggtgtttaggtaattgttttctgcagagtatactttatcacttcaaaaaatgttacagttaaaaaataatgttaatttgtatctgttgataaaagaattatacatgtgaaacaacaagacacttaggaaaataagattggtgttaaatgaagatattagtctatcattttaacatactgtcatgtggtttgcaaacattttcttccattccatggttgtctcttcactctgttgattatttttctttgctgtgcaaaatctttttagtttgatgcaattctatctgtttttgcttgtattacctgtacttttggggacatatccaaaaagttttggctcaaactaatgtcaagaagcttttcttctatgttttcttctagtagtttcatacttgtaggtctcatatttaattctttagttcattgtatttttgtatatggggtgaaatagagatcaaatttctttcttgtttgtatggatatccagttttccaacaccatttattgaagagactatactttccctattatatgttcttggcactttggtagatcagttgactaaaaatgcttagatttatggctggactttctattctgattaacatattttcaatattaaactcttcatgtatttttaatattaatcataactcaaacagctcaatagcaataaaattaataacttgattgaaaaatggacaaagaatgtgaaaaagtcatatctcaaaagaagacatacaaataatcaacatacatatgaaaaaagttcaaaatcactaatcatcagggaaatacaaattaaaaattaaaaccacaaggatatatcacatcacacctgttagaagaattgttataaaagtgtcagtgagtacataaagtgacaacaagtgtcagtgagtacataaagtaaagggaattattttacactgttggtaggaatgtatattagtacaaccattatggaaaacagtgtgaagtttcctcataaaataaaaatagaactaccaaatgatccagcaatttcatttttgggaatatattcaaagaaaataaaattaattatctcaaagagatatctctacttccatttttatagcagaattactcacaaaagtcaagattggaatcaacataaatgtccatccacagataggataaaatatatgatatatatatatctcatataatatataaatatcatatctcagacatatacatgtttcatatatcatatatatcatatgtaaatgtccatacacagatgaatggattaaaaatatgattatatgagatatatgtatctcatatagatacaacacacacacacatactcacacacacacacacaccccaatggaatactattcaatctataaaaagaaggaaatcctgtcacttatggcaacatggataaacctagaggacattatgctaaatgaataagccaggtacagaaagataaatactgtgtcatctcactaatatttggaatctaaaatagtggaagtcattaacagaagcagagagtagaatgggggttaccagaggttaggtggacaggaagggcaatggaaacatgtttgtcaacagatacaaaattttagttataaaagcaatacgttcaggagatctattgtgcaacatggtgactacagtcataacaatatatcatatgcttgaacattgctaagggagtagattttaaatgttttcacaaaaagacatggtaatggatatgtttcattcattaagttgacttagccactccacaatatgtacatatatgaaaacattatatatatatataatttttattaatcaataaactaaaataaaatactgtcatgaatgcaagcagtttgacatgactaaagaaaagataaccattcataagcatcaatgcagtgtaggaagtagtgttttctatgctctaacatatgccatctttgaaacatcagaaagcaactttcttaaaaaccatgatctgtcataattatgtgttttgggaaatctttttggttgagcaatatgaaatcaccagttttgtaagtcaatggttaaatctaataaataccagctattgcataagtgggcaagaaaaggggagaggtgggtataataagccattatgccagcacaagttggcattaaaagcatagggctgttacagttaaccaagtgtgattatgtaatacactaaaaatatctaattacattagggaatatatgcattgttgctctttaggatatataaggttaaacttcctacaaaaaaaatgaaagtatgttcagtgtcatcaacatagattaactagatgactttattttttcaagtgacatatcagagcttttctagaaagtatctaccttcaactaaacttacaatgtttattataagcatttgaattctaattttacatattttatcattaaaactttgttttcatccaaagggaaaattgagtagttctaaatgaattgggtaatgataataaaattgacaaatatattgaatgtttaccatatgtcaggcactgttttaagcattttgttatagatgactaatgtaatttacataagagagcaataatcaaacatgtaatagaataatgaagtaatttgtgatacttcatttttattataatttcaaaatgttatttatgattttatttctaatctctaggaaattggacacccaaaattaaattaaaatatgaacattgagtggagttaaaaagcaaccttatatatctcctaaggaatctaataaattaactttaaaaagcaaaatataagttttaccaatatccctaccctttaaatcatatagaaacagaaaaaatatcttgaggaaagttttacataaatataggcaaacaaaatatctgcaaatgaatgtatttgtctcatatgctatcttttctgcaaaggaatgaaaggtttccagaacttagaataagtgaagttctctgcagtgattttagtaattcattgtgaatcattacacacttcttgatctagaacagctaagttgtttggcataaccttttgattcattttcctttttctacttattgattttcttagcactatttactgaattacactcttattctaacaatggaatttctgacacctttagttatataggaaaacattatatgtgtgtaaatattgactcaaagtattaatggtctcttattattgacatattatctctagaacttcatttgtatttaaaataaaaattatgtccacatttatttccttagactccgtatagagtatgtggcatatatttttgtaatgttccatgccttgggctacctatcattggaaaatgttatatttcatattagacgattcttttgacccctagtaaacctgaaactgccttagaggaacagctgaatgtatttccttaaataaacacattgttcttcaaattgctagtgtttgtcttcttaataggctccacaggcaatgggaatgttgactttgaagtcacctctactgggttcatgtagataagtctatttcataccttttttcttcccacacttaacagtgtctttcaactcacgtttgttttaagacaactataaatgcatacatactacatggaatatttaatttttatttaatttatagtctcagtaattagtgagaggttggctcacaattacataaaaataaacttagacaaaaatcagaaaaggtttacttttaattgaggtatgaggaaaaattcatttacttggtcacatgcttggccttcataaggtagcaaaagataaatggtcacttgcattgtataagtggtcgtaaaatttttctcagcactgaactgtcctccagagctatttatatgaagctagtcattttctaatgatcacttgtaacatagatgatacactcaattttgataaatgggtccaaactctcctaaagaagctgtaccagtaatactccatgaagctttctagagtttgtttgcttattcactatccagacagaaatattttgcatatttttcaccatcccagttttcaagaacccaagctagagtttgagaaaattctatttgaatggacataaaaatttatttgattttgaaataaaaacaaatcattaaaaattctactttaaaaatatgctttgaaacttgagtatctaggaaaaaagttaataaccaagcacaggaacaaaatacaagaaattgtagcataaagatcatagatatgctttgggaggccaaggcgggcagatcacgagatcagaagtttgagaccagcttgaccaacatggtaaaaccctctctctactaaaaatacaaaaattagccatgcatgatggcacacacctgtaatctcagctactcaggaggctgagacaggagaattgcttgaacccaggaggcggaggttgcagtgagccgagatcacgccattgcactccaacctgggcgacagagcgggactccgtctcaaaaaaagatcatagatgtgtttgttactatgattctctttttggtctctgaaaatgggtccctggaaattagaaccatattaagttaaccatttcttatatattagaaacagttgtttatcaggttaaagatgctatattttttgtactgtataaacagccatctaacatagtcatttgtttggggaagatactagcctttgataatactatttctcttagattactactggcagcaattaatcaacagttgtagtaatttaccctatacttcaagccaaattaacagtcttgccttgcttatatgaatattaaaggataatgtggcattgggcctggaattctcagtaagttgcccacattgttaatatttaccaatattaacttaggaataggctgcaaggtgtaaggaatgtctgttttaatattcattttaaaaatacatgttttaaatattgtaattcagtgtaatcacatcagttatgataatttcattttgggtccaggataattaaatctggaattgcataagatgcactacaatggtaatattatttcattattctttgtaactaacattccaatcactggtatagattgacatttggaatatgactatcatcacacaattctttgccctaggagacttcctaatgggcattttttataccttgctgtagccttttatgtacttaataaccgtacagtttcatgtagcttcataacaaataactatcattgccatatttatgtggtaataaaactagtttaaggtatttttatgaagctatttatggcttttagtcattattgagttttttatgactattataaagtggtatggcttaagaaaaattataaactcccctatgggtatttgtcatgattgaaaataatagaattctttttgttgttatgtcttgggaaattttattatcttctgtctagaaaagcaaaatactagggatcttcaatcagattattaccaaattattaagattttgttctacgtattgaatgaaagcatatattccattacttgtcccaattgaaataaacataaactgccaaatttcctggaaaacagtatatctagaggtcatttcagttgttaagtatgtgttatcaacttaaggttttattagttgctccttgtaggtattctgggtcagtttcattattatttactgaaagcattaatattatttactcatacaaactctatttcttagttgttatagtaaagacagattttttaattattgcataaaattgtatgttaagaaacattctctggccgggcgcggtggctcatgcctgtaatcccagcactttgggaggcctaggtgggcagatcacctgaggtcaggagtccaaaaccagactggccaacatggtgaaacctcatctctactaaaaatacagaaaattagctgggcgtggtggtgcatgcctgtaatcccagctgtgaaggaggctgaggcaggagaatcacttgagctcaagaggcagaggttgcagtgagccgagatcgcaccactgcactctagcctgggtgacagagtgagactctgtttaaaaaaaaaagaaaaagaaagaaaagaaaataaacgtctaattttatgacttttaaaaagcaaggcatttcttgacctggtattatcttactttgaaggttcatttgttgacatctcaccttgcatatttcagattagtatatgatactgaaaattctttctgttctctgaagcactctttccatcattcatacattatgttgtttccatttagaacactctcctctcctcttgtctgagctaattcctactcatccttcaggtgccagcttagataatcacttccttctgatacatttctctaagctgctggtggctggtagagtttatctttgttatggattcctctgtaacctgtatgtattctgtatgtaattgataatttatctagtcatttggctataacccccaaagacagagatcaggtcactattttcattctatatccccagcatggtctggcctaggaagccctcaattaatagacgttgaaggataaacagaacggattgccttatttatgtacctgttgtagcaactagaaattttagtcatttgccccaaatatgttactatgatataggctgtttgtgaactatctcttgcctttttatattcacagatgtgtatgcatgatatcacctgccaagtcctttttgttctcaggttttggagttactttttctactgacaaccctaatttccttatttgatgagaagtatgaaaaggaatctaaaaatacttatatgctgggcaatttaacaatgtttaaggcatactttgaaagtgccatgaaatccatattataattttctcacaagccctattgttgtactaattattaagcaatgatactagtttctagttaattcatggcttattttatttattatactttttaaaaattgacataaaaattgtacatatttatgggttacagtgagatgttttgatacatatatattggataattatcacatcagggtatttagcattttcatcatctctttgtggggagaacattcaaaattctctcttccacctattttgaaatatatcatgcaatattgttaactatagtcaacacaccagaacttactcctcctgtctaactgtgaccatatatacagttaatcaatctctcattataccccagcccctttccactctccaatctttggtagccacaattctactctctacttcaatgagaccagcatttttagattatttatataaacgatatcatatttgtctttctgtcctagctcacttcacttaatgtagtgtcctccaggttcatgcatgttgtcacaaatgataggattccaatcttttttatggctaaataatattccagtgacatactgtgttgaaatagaaaaaaactcatcttaaaaaatgtgtatggaaccacaaaaaacccaaatagccaaagcaatcttaggcaaaaagaacaaactagagtcattacactacctgacttcaaaatatactacaaaactacagtaatccaaacagcatggtactgtcataaaaatagacacatagacaaatagaaaagataacccagaaataaacctgtatacttacagccaactgatttttgacaaaaatgtcaagaacatgtagtggggaaaagacaacctcttcaacaaagggtgctggaaaagctgaatatgtacatttagaagactgaaactagacctctatccctcactgtataaaaaattaactcaaaatgtattaaagacttatgtactataaaaagactagaagaaaaataagggaaatgccttatggcattggtctgggcaaagattttttgaacaagaactcaaaagcataggcatcgaaagcaaaagtagaaaaataggatttcatcaaaccaagaagcttctgcacagcaaaggaaacaatcaacagagtgaagagaaaatctacagaatgatggagaatatttgcaaactatacatttaataaggggttcatatccaaattatatgtagaactcaaacaactcaatagcaaaaaaaaacaatgtgattaataatgaacaaaagatctgaatagacatctctcaaaaagagacatacaaacggatagcagatatatgaaaaaattgtcagcatcacttatcatcagggaaatgcaaatgaaaatcacaatgagatattatctcacccagttaaaatgggtattattaaaaagacaaaaggtaataaatgctggggagcatttggagaaagggaagtgggaatgcaaactagtacagccacaatggaaaacagtatgaagattccttttgagactaaaaataagatggggcaagatggctcagatctgtaatcccagcatttcaggaggctgaggcaggaggatagcttgaggccaggagttcaagggaagcctgggccacatagtgagaccctatctctattaaaaaaaaaaagaaagaaagaaaacaaaacctaaaaataaaactaccatgtgatccagcagtttcattactgagtactggttatatacccaaaagaaatgaaatcatatgtccagagatatctgtattcctatgtttactgcagcactgttcacaatggcccaagatatggaatcaactcagtgttcatcaacagatgaataaacaaaatgtgcagcatatgcacaatgtaatagtttctatttaatttaaagcttccagattattttatcattttaagaaatgaagactcatagctgataacacgttcagaattaaaacttgtctctctatattctgtttcctcccccatcaagggttgtctctgctgctaagtgtctttattccttaaatcaattttgcatcagttagaggaacaaattgtttttccacagatttgtagccattaatctcagcagtaactcagtgaatattttttttaacatcaacatcagaaatacatggacagaagggaataatttgaaccaagtccaggacatactggctgaatctatgaaagttaagacttcatgtcatataataaatctttgtcactaatttatgctactttaaaatttggggatatgattagaatggtcatataacataatgcacactttcttactctgttctttcattgtcttctccattattactgctactcagtaatggtatcaactggaaattcttgaattgtaagtaaaaatgacctcatttccgaagcatttaaagttattgcaggtgaaagctctctcaagggctttcagtgtttcaatacgtggatgtacaatgtctgtcaataatgaatgccacacattaaattaacttgaatagttatagcccaaactttattctcagctttggcaaatttctaacataaaagcttagaatgtaagaattgaaaaaaagctattagaataatacagatactctgaaaggacctctagattgctacacatatttctttcttttctgagtataattgagatttccaaaaatttttactgaatgttcattttatattctggacttggtaatttaaaaaaaaagataaaattgttaaaagagcaatgagtaattcaaagaactgaagacaaaatattgtatggttgataaattcatatcaaccttcttagctgagatgattagaacaccagggtaaagtggccaaggtcatagggttgagctgtctgtggcccaggtagtttatcctctttctgggtcacagaccattttgggcactatgcccagacattctttaaagaaggacctagtcccaacacaacagtggatgaaagagggaaacaggtcagggccaatacacagctgtcagaactacaatgtctcaaggtcagtatattcctagagtgattttatatatatatatatatatatatatatatatgtatgtatataaaatattgtgtatatacatatatacaatgtatattgtatggtatgttttgtgtatgtgtgtatatataatattatacatatcactctagcaatatactcactttacatatggatacacataacactagatatatacatatatatatatagtgtgacaattttgtataaaaaagggagaataactgtgtttgaataacaattatttgtttttgttttaatttataaaggcagtaaaaatcaaccaggttcacttcacttactttttgagcaggtgtcaagttcacacacttgaaatttcacaggacacaaaatatctacaatttcaaaaaaagcttgcttcactgaagtatatgaaggtagtcccaatatttttcattatatccttgcatgcataagtaaaattttagataatttaaaggacattgaaataattaagtatgctgttgtcttttctcttgaggcatcagaatgggtgtaactaaatttatataggaaacttgactttgttcaccatgaaagaaccgaagaatctgagatttgttttattgaggaaggcttaggcttggttcaggccctactgtgagaagaattagtaggaaaagttccagctttatctagtgagattgacattgtgtcatggcatctttcttaatttaataagtataaatcttacacctccactaccagtgcagtactgacttactgtcgatttgaacctaaagttatcacatgcatcacacttaatcatagtggttttcataaacttaaattcagttgggcagaattctctggatatttatattgattctatgctccagtttttataaacataacccagcaatgacatggaataaagcaaaaaagacttcagagttatcgaagctaaacttttgatttcatagaggaaataggtttgttctattgcccaccagaaatggtgactaataaatgtgtctttccatctttcttctatgagtaactaggaatttcttcagcattagttacttcactttttttagaaaaggaatgttgtcactgaaaagttaagatttaataaagattcacatgagaatattcttctcttctgtttaacatcaatctttaagtagttatttttattattgcaatagtctctcttcctaataagtcatttttttctatactcaccattcccccacccaaacctctaatgctccctcattaccctttattctattaaaatgcttatcatgctgtaaattatatttatttctttgggtcactctttccagtaaactataatcattaagagtagttctgttacctttgcatcaccttatctggctctgtacctggttcatagtaggatctcagtgagtatttgatgaacaaataaatgaatgaataaatgaatgaattcagtaatattgttgagtctgtttttattatacttttaaaacttctgcttatattcagtaatgaaacatgaagaaattaaatcagatatttacctttactaataaaattgtaccagagggagccataatattattgtcagtttctaaaatgtgcaaggctacaaagggtgaaacctctttgaattaatgcctcttaatggttggaaatttaatcagtagtcttcattcacaatttaagaactttacattgtctctctttcagtaacagtataaatgacaactttcatatctgaatcataaataattcatcatcatgtattcacccctttagagtgctaagcataccatagaggaatctttgttaaagatatttggctagccatctacttagttatgttagaggaaaaatattcaaagctcttgacctagtattccaatttctggcaaactttaaaagtaccatctttgacattcatttagaattcatctccttgatcacttttggcccacagtcacaggctttgattcagaacttctaaagcaactttgttttgacctctgctctgttattttccaagtcattttaaaaccaagaccagaaaaatatcctgcttcatattttatcaaagttttcaattatcccattggattttatttcatcatcttccccacactatgtacagtaagttgtttaagattttgtaggcaaatttctcatttccatagaatttgtgcttagaaattcaccagataatcatcaaatcaatagtccttaattaaatactaagtatatatactctttatttttcacaatgcttaattaatctctccaaatagaatacttcaatgctatgttcatcatggaagtaataagctctaagaatattttatgttgcaatcactaattaattatgaagcatagcttcattttttccttgatgtgctatcaacctgctgtttatcatagtctgaatcttatggcaggtaaggtggttatatatatttcaattatatgtaattaatgaatattgtataatttttctactgcctaagatctgcctaaatcaatactattttttaattatcttagtaccaatgctattcaagtgttttatgtcaaaaaagtcattttgatagtttaggcagagtcttaggttttttctttcttgatataatgtgactgctaaggccattaaataatatatgaaagtacattgctatgacaaaatatcaaccaagaatggatataggccacacttatttctttttccattactatagaaatttgatttgtggtaatggcagttaattattttgaacaatgaatccaatcagtctagtcagtttaccaaggaaaaaggaatgtattaaacagtaactttgataatattgggatggactactgaaacagattaagtagactgattcatgctttaatcaaagcaatgttgtgtcctttagtagctgatacatctgttcacacatagaagaatgatgttttgtgagcaaacttaattttcagttcctttaataacaataatttttatattcagcatgttctagttgagttctcacattaggtaatatacgtctgtgagcccttcaatttagaaatatgagttattagtaagaaatatgagttataagtaagagattattaaactaccagaatgcagataaatgaaacccataatgaataatacagattcctatatactcttttcataaacattagaaaagatgaaaagcttaatttagttgaccaatgacccacataaatatattttatggatatttttctggatgtatataggagtcacaaacacatttaatagtattaagcaatcttagtttgaaatcatcagtttcgtttaaatttaaaatgaggactatgaaaacaattatgctttataagcaactgtttatattttcatgagatttaaacaaagcaatttaaatttacaaaaatttaaggcaactaagtatttctttgttataaaagtaaattcagatgtaaaatagcctcaaagcaacttgaatatataaaatcaagaaatccataaacaatcatcattttgaataattgcatttatagccaaacctgctcagtggtaatgtaactaatctagatcacacttatataaaaataaaattgtgtataattttatttttatatataaatatatataattatatctaattttatttttatatattttatttatatatttttaaaaataaaattatatatatttataaatatataattatatataattttatttttgtaggtatagtcctgtgcaatgtcttccttacagataatggttgaaaattagagtataaaagaggtatttttgttactacctagcagttcacttgatgttggtagactataactaaaggataatctgtaacctaatatgatttcaactctattttgactttcaaaagagagaaataaaatagcactatatcatttctaacaagtgtttataaggtagaaattgccttaaattcacatttaaaagaaaccatgcaaaaccttataaaatagcaatatatatatgtacatatatatgatgtagagagaatctattactcttacatggaggcaatttccaataatttgctatatttgtcctgctcttctcagttttatgaagtttttttatggctccagcccaagtattctcagattttaaatgaagagagcattaaattcaccaatttacttagcaaacatttattcaatgggaaatgtactgtgctaggccttgtgagggttgtaaatataaataagggcgatccccatcctcaagaagtttacacagacacaacacaaggtagttaacaaaatgcctttgcagccctcaggaaaataagattagttctgctacagtgtttaaaacttgaaggatgggtagactatcaataaatggaagtggagaataaagtatagaatgaaacagcagatgaagcttggaagacactaagtgtgtttagagaatgaagaggggttaagttaagcaccaaattccccttggaaggctctactgaaaagtgggttatgagacattataataaaaatacacatcggatttggaagatattcaacagtatacttagaagcgtgacattcatgccaagataatgttatcaaatgttgggcatctcttaagatgtatgagacatgattctgcgcttctgaattcatcatcttagctgatcttcacaacaagcctgtaaggagttattaccttcattttataaaaggaaacattaaaccctgaaggtatgcaacgatttcccccaaaattgatgagtgtctgaatcaaaaaacaaaacaacaaaaatctttcttattccagaggactaactcttcactatattttcttttcattttttttattttattttttattattattatatttcaagttttagggtacatgtgcacaatgtgcaggttagttacatatgtatacatgtgacatgctggtgcgctgcacccactaactcgtcatctagcaataggtatatctcccaatgctatccctcctccctccccccaccccacaacagtccccagagtgtgatgttccccttcctgtgtccatgtgttctcattgttcagttcccacctatgagtgagaatatgccgtgtttggtttttttgttcttgcgatagtttactgagaatgatgatttccaatttcatccatgtccctacaaaggacatgaactcatccttttttatggctgcatagtattccatggtgtatatgtgccacattttcttaatccagtctatcattgttggacattcgggttggttccaagtccttgctattgtgaatagtgctgcaataaacatacatgtgcatgtgtctttatagcagcatgatttatcgtcctttgggtatatacccagtaatgggatggctgggtcaaatggtatttctagttctagatccctgaggaatcgccacactgacttccacaagggttgaactagtttacagtcccaccaacagtgtaaaagtgttcctatttctccacatcctctccagcacctgttgtttcctgactttttaatgattgccattctaactggtgtgagatggtatctcactgtggttttgatttgcatttctctgatggccagtgatggtgagcattttttcgtgtgttttttggctacatagatgtcttcttttgagaagtgtctgctcatgtccttcgcctactttttgatggggttgtttctttttctcttgtaaatttgtttgagttcattgtagattctggatattagccctttgtcagatgagaaggttgcgaaaattttctcccattttgtaggttgcctgttcactctgatggtagtttcttttgctgtgcagaagctctttagtttaattagatcccatttgtcaattttgtcttttgttgccattgcttttggtgttttagacatgaagtccttgcccatgcctatgtcctgaatggtaatgcctaggttttcttctagggtttttatggttttaggtgtgaggtttaagtctttaatccatcttgaattgatttttgtataaggtgtaaggaagggatccagtttcagctttctacatatggctagccagttttcccagcaccatttattaaatagggaatcctttccccattacttgtttttctcaggtttgtcaaagataagataattgtagatatgcagcattatttctgagggctctgttctgttccattgatctatatctctgttttggtaccagtaccatgctgttttggttactgtagccttgtagtgtggtttgaagtcaggtagcgtgatgcctccagctttgttcttttggcttaggattgacttagcaatgtgggctcttttttggttgcatatgaacttgaaagtagttttttccaattctgtgaagaaagtcattggtagtttgatggggatggcattgaatctatgaattaccttgggcagtatggccattttcatgatattgattcttcctacccatgagcatggaatgttcttccatttgtttgtatcctcttttatttcattgagcagtggtttgtagttctccttgaagaggtccttcacatcccttgtaagttggaacctaggtattttattttctttgaagcaattgtgaatgggagttcactcatgatttggctgtctgtttgtctgttcttggtgtataagaatgcttgtgatttttgtacactgattttgtatcctgagactttgctgaagttgcttatcagcttaaggagattttgggctcaaagaagtgtgtagagggaaatttatagcacttaatgcccacaggagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaattaatgaatccagaagctggttttttgaaaggatcaatgaaattgttagaccgctagcaagactagtaaagaaaaaaagagagaagaatcaaatagacgcaataaaaaatgataaaggggatatcaccactgatcccacagaaatacaaactaccatcagagaatactacaaacacctctacgcaaataaactagaaaatctagaagaaatggataaattcctcgacatatacactctcccaagactaaaccaggaagaatttgaatctctgaatagaccaataacaggatctgaaattgtggcaataatcaatcgcttaccaaccaaaaagagtccaggaccagatggattcacagctgaattctaccagaggtacaaggaggaactggtaccattccttctgaaactattccaatcaatagaaaaagagggaatcttccctaactcattttatgagaccaacatcatcctgataccaaagctgggcggagacacaaccaaaaaagagaattttagaccaatatccttgatgaacattgatgcaaaaatcctcaataaaatactggcaaaccaaatccagcagcacatcaaaaagcttatccaccatgatcaagtgggcttcatccctgggatgcaaggctggttcaatatacacaaatcaataaatgtaatccagcatataaatagaaccaaagacaaaaaccacatgattatctcaacagatgcagaaaaggcctttgacaaaattcaacaacacttcatgctaaaaactctcaataaatgaggtattgatgggatgtatctcaaaataataagagctatctatgacatacccacagccaatatcatactgaatgggcaaaaactggaagcattccctttgaaaactggcacaagacagggatgccctctctcaccactcctattcaacatagtgttggaagttctggccaggacaattaggcaggagaaggaaataaagggtattcaattaggaaaagaggaagtcaaattgtccctgttggcagacgacatgattgtatatctagaagaccccattgtctcagcccaaaaactcttcactatatttcattccacttaccatgaatgaggatctgtacaacgttctgagcagcaccatgggacataacaaaactcgtaatttggggacattaatctaacagcagcatgtcacatgatttgaaagccacaagactagaagcaatgacaccgttcatcatggtagaggaattaaaaaacaaaggctgatacttgatgatgggaatgagaatgtaaagaaaactaaaataaaagagataatgaaaaaatatgctgtgatggaatttaggttagtgaataagaaagaggaggaggagaaagaaggaaaaggtggtgcagaaggaagaaaaggtgcagaagaaataggggatagaggagaagagaatgtgagaaagaggggcagaaacatttttttggtgaaaatcccatttggcaaaatgtaaactaacaactaagccacttggatgattttatttactttttatgataactctatgcattagatactattactatctctaatctatcgaatgggaactgaagacttggaaagcctcccttgcccgtggagacagagtctgtagaataggaggctgagatctgtacccacagaattgaattcagcaaaactcatgttcatttggccctccctgtctgtaactgtgagatcagcagggatggttaaccctcttttgaggataaggatcagagaagtattttatttaagggcatagagtaaagttttctgctgtaaaaaatcttcctctattttggggtacagagaggcagcatacatattgattatgcaagcagtaaatctggtaattatctttgaaacgtctttctctttaccttccatttttaatcgatcaccaaacgtcagtgattttatctcttaaattgttctataatccatccaattctctccactttcactgctaccttgctattgcaaacattaacatcttgtatctgggctactgcagttgccttctaaatggtgcctcctacatctgttattttcctgctacagtttgttttgtatactatagccaggatgatgtttttaaaatccaaacctagtcttcacattctgccccctaaaataaaagtaaaatagtaatgtaaaaaaactatcgctttctattgccctttaaaaaaaccaaagtccttcagtgaccaaaagatatttcataggcagcagtgccaacctctgtatcttccctcatttttccatgtagcgctcacactggtgttgcttcatgtgcttggataagctgggactttgttcatgctgttccctttcctaaaacattctctagtcctcatccctacccttccccctttatttgtttaataaacgtttgtccttcagacctcaggtgaaatgtgacttcctcaggagtcttccttgatcctgcaaacagagaaaattcctcttctatagattcttatggctctgtgcttttcctgtggaatccttatccctttcatacatatatattaataagtgtgctttttgttcagtatctgtacctcttgttagtctaaaagcaccatgaggaagatatcacgatttttttgctcttttatgctgagaatttacatccaacatagaacaggtattcagtaaatatttgttgaatgaaccatgaatgattaatagcctcatctgtgcttaaattctagcttctccatttactaaatgcatggacttgggtaattttcgtaagctccacaagcttctctttttccattggatgaagaaggatagtcacaatctaataagtaagattattcatctaaagtttttgacatatagaaagtactgaaataattagctattattcaactacaaaaacttcagggtcacaaagaacaaaactaatgttttttgagggagaaatgtcatttcagtacaaatttaagaaatataaaatacattttaatgttcaggtagtacctgaaaaggataaaacatgtaatttatctgagaagtctaattttattatcataattattaaataattatatatatatatatacacacacacacacatatatataattttttttagatggagtcttgctctgtcacccaggctggagtgcagtggcgctatcttggctcactgcagcctctgcctcccagattcaagcgattctcctgtctcagcctcccgagtagctgggattacagggctcaccaccacgcctggctaattttttgtgtttctagtagagatggggtttcaccatgttggccatgctggtctagaactcctgacctccagtgactacccacctcagcctcccaaagtgctgggattacaggcatgagccaccatgcctggcctaagtaattatttttgaaaattagtatgcattttaccttggtcctcttgtggcccagagtcagatattagttgtttgggaaagtcatagtgaccgataaaagtggaaaatgtggcccagcatactattaaattccctttttcctgtgctgatgcttactgctgtcaggtaaatggagattatgaagagggcacaaacgaatcactagcttctggctcaggaagcagatatagagcaataggcccttcgttatactcagctttagttctgtcacctgtcatcagcatctgtcatttgtttcagaccactaggatatactttctcatccacctgtaccatctccaaaatttccttatgctaccaagttaaaaaataaaactagatgaactgtaaggttcctttccattctgacagtctattattttatccctcatccatctacctcatcaaggagagttggtcaccacaatgctttgaggacatacaatggaaaagtaaataatattattaatagtattgatactaggagcacaaagttaaagtcctaaatatggagaatgagggaaaataataacatgtcatttataagaaaagagttaaaatttagcctgagctttaaagtgctggtcttgaaatctagtgaaccagaaaatttgaatccctccctgttcctgccagtctgttttctcatctgtatgttagtaataataacaggatttacattatatggttgttttggtaaatgggaaagtatctgtcaaatcttttgcactgtgactgggacacagtgatcactggtgaatggtggttagcattgctactgcatgaaatacctgacccatcactatcagccaagtccagagatgctactgatttgcatgtgcagaaaatgctaccaatttctgaattgtatgttcaaagaagactaacaagaaaatagtaaaaaggcagaaagaatacttcctattgctacaaaaggaatgttagttctgtatacaaagtattattttgttgcaaatatacacaaccttttcacgtggggctatggctgctaataaggcttttactctttgtgtaaaaaatgcgtgatttatgcagacagactgtaatatgaaaaccctgcatagtctatttgaatcagcaagtgggcagccacatttatctctgtttactgctgaatagctttcattgttaattccattttctattcctgttgtgcatatcaccccttaatttaaatctttgacaagctaatttaataaaggggatggtttttagagtggaaaaaataaatatctttactcatctttttaaaaattataattagcttaaacaaagaccttaggtatagttcctgtgtttattagccataagagaatatttatgctaaaagattagtttttcttaaatttttaaggtacaactttataaaataattccttcactatttcttcattgttaacatttcattcatataaaggagttgtattttgggtcttggaatgaaaatatccagcttccagagcaaaaaattttcagtcaatcagtatagagaaacagaattttagaagcaataaagtcctagaatgctaaaatgcattgtactacctggtgatattctgttcttgacagtcactaaagacatgttgactattcttatgagatagttctgttctgagtccctgcatcttggttgttctaactgaaaatggcattatctatgaaataggaaaaaaaatctatgaggtatacattagcatgaattctgacgctacagataaatgtaaaaaacatggatagtgtggaaaaatattacagtaaaggagttatgataaggtgcaccaaagtacctaggaataaaaatggaaagaaccaacaattaaataaattagtttcaaatttaaaacatgggtttgcagaagactaatatgaataatactgctataaatcatgatttaaaacatgaatatatatatatgtcactgaataaaatgaaatatatagatatgtttgtgtgtgtgtgtgtgtgtgtgtgtgtgtgtgtattccatttacctgaaagttcagtcacattttattggccacaaatggtcagaagcacagtttcatttgccatattgatggactgttcgttaccaacttagacacttctcagtaccaagccgaataccccaaggagtagcctgggtatcagcagactagataatgaattcttgacacttattcctccagtactgttccaagttcttcatgctgtatccacaggacctaaaacagtgtctgccacactgggctcatgaaataaaaattaataaaggataaaaggaaaaactcctatccaactaacaatttagtatcttaggttaaaaaacaaagcaacttaaaggcaatttttaaaaatttttctcatattaacattctacaaattctattatgcatggcttcagaaaccacagagagccaaatttagctgtgtcagtcacctccaccccagcagcagagtttcccatgtgctaactgccaactgagcctcaactgaagttcatgtattgagtctcaattactgagtcctaacctagttttagacaaatgttccatttcctttcttaggctggtctgctagcctgaaactcagcccacttaactggaacactgacaatctatctaccctttttactagtacccttatacaatgaggttctctccagccaattattgagcatgtggttgaacttgaatcaaccttcttgcaaggacgattttactatcaactatgggtaaaaaacatgccccattccttaagatcatccaaaccgcgagagagagagagagagagagagagagagagagagagaacgagaacacacaggtccagagatgtcattcaggatgtcatctcagacacagaaatttttatttctgaccatgctccttggagaccagcctcacagttgtctcaaaatactgcaaagtcaaacacatgtgattatgacacattaggttctaagatattctcccagaactgcaacactccaacacagtctctagtcatacttttctagcaatgtgagaaacacaggaggcagatgtgagaccagttaattttaaattcataacgaacaaagaattagaataataagaaaaatattatatctaagtttcttcccagtgcagtaaatatattcatatactgaaagaattaatgctgttttcaaagatgccggaattccacatcagcacaaaaagtatggattaagcttctctgtaaccagccttgggctaggaatttgatacaataatccaacaattctatctattacgttaagaagataaggaaaaaaatcatcttctctttctagtaagtataatttgggggatgactggaaacaagtaaaggacaacataagacagaatataatccagtggaaactttagtggtacctgtgtgttataggaacttagaggttgaaaaagtttcatgagagaggtgcaatataagctacacatgcaaaatatgtaaaaatagctcaggcacctgaaacatcagatttgtgaaagatgtcatcatatttcatactgtctatcatgtgtgagtataataggtaataggtaaacagttcgatgtccattgaactataattactccatttgaaatgcttagaggtctattatcaggtgattcacaattacatttgattgattattctgaatttaatgttttctaaaacaatattcaaccacttcttattgtattccagtgtccagagtttctttctatgcctacctagaggtctttacctgaagtttagaacaatcattgttcttattgttatctacttcatgatagatattatgttaccccttcacctattcctagtatgaaaacacctttaaaagaaatatttcattgtgttttcttttcctaaatcctacttgctattcaacacattttgaaggatgaaactgtaatattactactaaaataatgctgttttcaaagatgcctgaattccacatcagcacaaaaactatgtattaagcatttctgtaaccagccctgggttaggaatttgatacagtagtcaaacaactctatctattaagagctcaaagaagtaatagtgagaaagccaagacagaaattttctgtctgattccacattctgtggtctaaatcaccacacttttatgcagaaatatttttaaaactcaatcactgaaaagctattagctgttattattagcagttacacttaaattttgttgcagtaaaactaaaggtaaataaatccttaatttcattgtaactcataaggtatgttaccaaatataaatattatattgacctttatgcaacattgcttgatattaccctatgtactactaatagtcaaacttttaatggagatattttagattacctcttttctttctttcctgacctaataatctatatcttgcaggttattttacacatttatataatatacacagactagtgctattgggggaactatatattaagtaaaggacattcccatatgaaatgtgtataatttcaagataattagcctaactttaaatctagtttatcaaaatcaatcatgttttcatttaaaaatatattgattgtatgtctgtcacagactaaatgtttgtgtccccaaattttatatggcgaaacctcatcagcaatgtggtggtgtctggaggaggggtattggggaggtgattagtgtataaggacagatcccttatgatgggatttatgcttttaaaaaaagaggctccacagagattccttcctccttctgccaaatgagcacacagtgaaaacatggccctctatgagccaggaagcatgctcttaccagacacagaatcatctgctggcaccttaatcttggacttgcctccagaactgtaagaaataaatttctgttgtttatgagccacccagtccatggtgtttttctatagaagcccaaacagaccaagaccatgtcagacattgtactaggtgttggtgtgtgatcgaattaggtgtgatttcttcccttcaggaacttacaaccaaataaaagattcagataagtaagtcaatgattgtctaagttctgtgattaaatgaagcacacagggctatgggagccaaaggacccccatctaaatcacatagtatagtataattaggaaaggctggaggaggagtgactggtccagttgagttttaaagagtaggaattggaaggaaagaaagatgaaggacattcctagtgggaaagcagcaatagtaagaagtacaaaaaaagtcctcaagagacatagttaagaccatgctatgatcttcaccataatcttaacctcagtcaagaccatagaaccacgctatgatcaaagatttaaaatgctatcctgaaatccatgagtcattgcaggaatgctagtggagaatgggtatagatcttacagacacacttcaaacttagatttgcatcactggcagaaatactctttcagatatttttcttaccctttcttattttttacttttaccttctttctatatgggaaaataagttggaaaagcataattgatattgcctctgcagctacatcttcagcatagcatcgttatatattactatcaacatgagcatcatagataacaatacaatgttattttatactaattgggcatactttagcacattgtaaaccataactctagatatcttgacattagtatgtataaggtcttggaaatagctgtaatactgtgataaatgcagtgaacatcaatggggaagtactaaccgtaactgcccgaacctattgagtgtttaattaatgaatgtttgcaatttttgagagacttaatatcaattattttatcaaccaatgggacttaattcaaaaattaaatatgtattcctaaaccaatcattccatgtgaaactgattaagatgtggaaggcccatgaaatatgaaccatttaacatgtgaatacacgtcatgaagatgacattggaaattccaacaaaaatctaaaataagataatggaaattcaaaattaattaatgtgtccatgattaagatataattttaactcagacaatttacattcatatgttatatcttccttagttcctattaagaattaaactcatttagattattgtatttggctgaaaagattctggtaatgccatggtgttcttttgtaagttcataaacaattatcaaatgcttttgttggttcataaacaattatcaaatacttcacatcgtataatcactggaaagagaaaaaagctatcacagatcttagccaattaaagagcttatagtttagtatcaaaaaaaactaggaaaaattaatgtcaaatagaaacatgtaaaataagataatataaataaatgactaagtgtcaaggaaataaagaatataggaaagatatgaattagaattgttcaaggataaatggttccacctacaccttgaagaaaatagtaccaattgttgagcaggaaagagtgaaaatattttaggtgaaatacttatgtatatatgtatttcatatatatatatccacacatacacaatatatgtatgtatttcatatatatattcacacacaaacatgacagaaaagtcatgaagacaataattatcaatgtagttagatgtagttaggggattgaatttaagtggttcacttgaaagaaacagatgaatcattaataataatgaaagatgaattttgagaaatgaatctgagactctgagtatgatttaatgaaaatctttaaagttaaacttttatacaaactttgatgttaaaactaactagaacaccttaaaaagagtgaaataatatacataagaattggagtcactatatataagaagaaagcagtaaatccaaacattagcccaggtttgctttgtggggtttgcttgagggtggtggctttagcaataacaaagaattatatcattagagagtggttccaaggtaaagcaggaagaaaaaatagaatagaagaataaagcctaagaataaaagtctgatgagataaagaaatgtgaggaaggaagacatgctaatacttatgaacgagcagatggaaaagtgtctttaaggaaggaaggcaactagcttagttttctgcgttatacttcgggtgtgcataacgtccaagagctcaaaaacagtgtgaaagactaaaatatctagattcatccactgggagatgatttcaaaacttggagcaagtcagttactctctgcaggatcaaatgctgagaaatgaggaaaaaagattaagtattgaaggttattgttaaaggtcaggagaagaaaagagaaacaaagagggcggaataaaagcaaccagtgatagagaagagattatacaataaagcataatttattctaaaaagaaagtaatttatttttccctttttcctaatctttagaagctgtgaaaagtcagtcatttaaaggtaactttttattgtggtaagaatacttaacatggatctaccttctgaaagttttaagtgtgcaatacagtattgttagctacacacacaaagttgttcagcagattactagaacttaattattttgcataactgaaacttgatacctatttatgtctataacacatttatatactcctgaatttgcgttataactccagaggttaaaaatgaaccacagttgaattgtgtagtgtggataaaatcgatggctctgcataagtggttgagaaatttctgttattctggcacaaacttttggtaattgtaagctatcaaagtctttgccagactgttcagtgatgaaaagtccctgggaataggtaataagagggttgtgttcttaatgtaactaaagtaccaggtgacatctatttgagttactattataattacgcacttttgtatattaggtactctgagacctgaagagtcttgcaagaaaaaaacaaaggcaagaaggcaggaaggacaggatggagggttttttaatattggagggccagaagaaaaggagttatggtttatcaggccccagtccccaaaatggagttgggagcaacggtcattttagaatgatttgactcctctcctttgtatggcttatcctggatgggactcagtaaagacatggaagagaaagaacatcgtgtctcttggagtagatgaaaaggaagatgatgaccacagtgttggcctctctgaggcactgcttgatgcagcctcctccagggtcactgctcatcactccattcctcagtgcctattcctcaggagtgatatcacacagctagctgtcttagtttgcatgtgctgctgtaacaaatacctcagactggttactttataaataatgcaaatatatttctcatggccctggaggttgggaagtccatgatcaaggtgaaaacaaattcagttccaaaggctgctctccgcttccaagatggtgccttgaatgctgtggactcacatggcagaagagaaactaaagggtaaaagtgattagctggttctctccagcccttttacaaagtcattaatcccgtttgtaatgactgagcacttatgacttaatcaccttctaaagacctgccacctcttaatactatcacattgggtcttaggctcatcatatgaattctggggaacacatacatccaaaccatggatatatttataatttacagaagaaaatatcactttcaaaagaaaaagaatttgctccagagtgtataaaccttttattgtcatagaaggaaatacttactttaacaaaatttaagttttacaatattccatactgcatactgttttcattgttagtagactaaaaatttgggccattaacattcaaggtttggacattagacaggtctattatttccagggccatttttttttttattttggttctctttcctttgagcctgggtgggggatatgggaggaactgagaatgagagaagaaaaagaagaggtgaaaagatacaaaagaaaagtttgtggtcatacaaatgatacatttttaaggagctcaaatgttcttgataacattttctattacaagtttaggtagggaaacactggcaaggctctaaacaagcctcagactacagccttatgaatctaagtggataaaaatccagtcttaccatcaaatatattcatggacatttggttaccatttttatatgtaatagcaaaattttctgccaacaagaatcagtgttcagataaaatagtgtttttaaaaatatgtgagaccttcaaaactatggttaaatttgtttttacctataaaaaagctattagcaaatattagacaattgcaagtgttacaaataaacactacatgaaaatactgtaaatatctgtataatcatggaagttagttggaccaaaaaaattgttttaaaaaaaaattaacctgaaaaagttaactatatgccaaaaaggaagatgaatatatccacataatcgattacctcatttttcaagtttattccattctctgcctcagtcccatgttccatggctgtgactccagaaggagtaagcaagaatcagaggaaactgggaggggtggagaccaactctcacaggtcaatgattttaatgtttaccaagcattaaaagcaaagaaacggaggtataatggaacatcccccaaggggagaataaaattagtcctaaaatagtacattacatattggttttggtgaagtgttgcagagaaacaggctgtccttcaagcagtccggttatgttacccatcaggctgacttgtgcacatacggtttaaatcaagaaaggatagttgtcctaatttctttgtgctcataaggggaacaatagttgaaagcagaagttactactacttattgagatccttgaatgtgagatccttgaataacattaagcatggtatcattcaatttatccatcccttttctgctgcctgacagagtcatttctcttctgttatttcctggcaattttaggaaaatatattatggtcacaatatctactagttttaaaaatgtattcaattatttttgcagcgcttctgatagctgtaacactttgctaacctcagacaaattgactacaggattaatgtaatcatttctacagaaagtatttcacagctttaaaatgacagcattctaaaatacgatagtgattccctgacacaggataaagctaactggagaagtttttcgttctgtgtcctttcctctgcttcagaggtcactttgcatttgagttctccttaggctttcatttgaaactgcatgggatcacagtgattatcaggaaatgaaagatccaaccaatgatgaaatgtcatttagcattcttgctgattgtcttcccctcaccaccaacaaaaaaaaaaagtgtctcttatggagacgctgtcaatttatgctcaacatttgaaaacatattggcctaagaaaagggttctcacatttcagtcacaaattttattcacagctagggagttactgaatacagctacttagtctgcagaagaaaaggctgaaaagtaactgagtagttttatgctttttgagacaaccaagacatcaggtcacatcttatcttaacatgctacaacaaaaaggcacaagacaatgtctagaaattaatatgtactttttagtcaacattaaaaggaaattagagaaatattatgcagccttaaaaaggaaagcaatcctgacacattgctgctaatggataaattttgaagacattacgctaactgaaataaaccagtcaaagaaggatacacattttatgatttcacttatataaggtacctagaatagttaaattcatacagacagaaagcagaatgctggtaggcaggagtttagagagagggaggaatgaggatttattgtttaatggtatggagtttcagtttgggaaaatgaaaaaaattggagacggatagtagcaatgattgcacagcaatgtgtatccacttaatacctctgaactgtacacttaaaatggttaaagtagcaacttttgtgttatgtatttggcaacaatttttaaaaaataaaaataagaggaaatgggcaggagatagttagatattggagaattgtgagaggaatggaatcagaacaggaagcaaacatttgcttagccactgctcactctgtaatgtccataattctaagctcaaagctcctcctgtcatccctagccccacagattctggtctcctctttgactgagataggtacagggaagcagtctgagctccactgtggattgcccagacacaaaccaagtgttgcttattttgccttaaaatgctgcaggattgagcttgacattctcctgtcattgcctttttctctttaggtcccattgaagcaaagcaggaagccactcttaaagagacaaagaaatttggagtagcccagtacactcagagtctaatttcttgacctttgtgggaaacaaactagattccatttaattatacagtagtctcattgaaaacagacctcagaatgtgtattactcaagtattgtttgtggaccacatcttgaaaattgcctatctaaactactcacaaaaagaccaaggccattcagagcttttcaaaggaaggtcattaactgtgttccagaattatcttccattttgctgatactcaaatcagagcaaatcatctaattcggtgaagaatagatctagtaccggtatcaggatgatggtctcgatacagaacttctcatctccaaaaatgatgataaaagacgatatgaaggagttgaagtacagggagttttgctataatatttgtttgaaaccatgaattctgttgcaaagtaattgatatactattgaataatttataaatagcataaattttcagtattcttacacataaattcatctggaaaaacattagttgagcacaaaacactcacctccatgaacccagctgaacagacacatgcaacaccccactcccaaaacaaacacacacacacacacacacagacatacacacacatctgagtattaccttggttcaccagtcatcatggtccatccatatctagtgttaacaatgttctgtatgatttcagatcaccctccctctactccttcacattaatgcacatgctgtaatccttccaaagcccacttccacaagcaaatatcaagtcttcttcaagacgaactgccacgtttatgatagtatttatatagtttttaatggtttaatttatgtaaaattatgctactgttttattaagatcctattttttaaatgcgtctatgatgaaaaaattttagtgctacacaccaaccccagttttttcataagccctagggtttctattgtgtaattaagtgtactacagtgatttttaggcatacatatgtattagagaagaagtgattgtattgtgtaagtttgtgtcacagcattactctctattgattcacagtgcaaagaaaatgtgccttctttatctctaatggcccatagtatattttttttcatgaggtctccacttgcaaggtagcatataagattttactctcatgaagtatctcttattttataaagaaatggccttctaggccctctcctcaagaatctcaaacagaaactgggaaaactgtaattttgtctttggctttgttctagtcattggacctaatgtgtatagatctcactatctatccagtgcttccatccctgtctcctttccatatcccttgggcctaaaagtatatgactttcattcctgtgtttttttagcctggacttctcttacatattattccccttccaaggacagctagcatcatggttcagccagattgatgcaagcaataggcactccaggctatggaagaacctatgattgagttgcagggtatctcttgatattaactaggataaagaattggaggaaattctttcatctctcaacaaagcctggctttaaagattatgttttaccttcagtctcaaaaatcctacactggatatcaaaatttaaaagttgattgtttctttttgcattcctgcaataacaatttgaattctctccaaagacagaagatgcctgtcacaggatggggaaaatcacttgagaggaaatgtaaaaaatagcaaaaacaatcaatgttttccaacagatattagctctatcacatatactatatgaccctcttctctttgagttggcataggtactacattttatatgatacttaaaaatataaacattgaaaaacataaaactgaaattttagtaatgtttaaagcatattgagaaaaatctcaccttcctgaaattctcagattcatgtcagaaaattttgcttgtgtaattttctaccctagaaagagcatagccatttcttcatcacatcaaacccaagtacagtatttggtaaagaggaaataagagaatcagtcatggtccatgaagagaagtcctgtgacctttctagtgtattggactataccaccaaactttactcttgaaatacatattttctcgtaacttgtgagtagaaaaataaatatttatttcataataagaaattacatacaaatgttccactattcccctaagatagttcaacatgaaactagccccatgcataaagttgaagaaatatggaagaaatttgttggagtagacttaaatttcaaatacttaataataaagtcatttaaaataattaatacaatttacttaataaccaaatattatgctactatttaagatgcttactgtctaagttttttatgtagataatgtaaggaaagttactttatgtaaattaatattcaatttattaaagttatacattcaagtcttttcttaggttaggttcaattaattgcaaattaatgatcacatatttatctggaagagtaggaataataagcattgtactctgtaacaaaattaatacaaaagattattttatctgagcataaaaaaagtctgcaagagataaattttcagtgaaaatataccatatgtccagttaaaattagactgtgaagaataagttgaagaatccaatatttctttaaaattgttaggagtatgtttaaacagaaggcatgattgttttctcttttaatgcttttctgaattttgatacccttactctgcagcatccagcagaatgttttatgtaaaaaaaaaatggtgctaataagtgtgtgtggagaaaatgaataaaaatatttttattggaaaaaatatttagattcatcttacatgattttttaaaaccaatttatacattaggtaattgttttgaaataagagcaatacaatgtctcctttgactaacgttcaaattaattttaagagattgaatttctctatatagttaatctcatttacagagagttaattatattatcttaaacacttatgacattaaatatgtaactttagtacatctgattatctcaccattttaaatgtcggaaagtgcagacaagcctagcatacagtcttcctaagaacataagcagttcttgtaaagatttctaaattttatttattacttcagataactcaaataaactaaagcgattacactatatatttttaagttgaacagaaaaataataatagtgacttgacttaatttattatctctctaattatttgttaattttttcaaggttttacacatacttaggaaaagagttactattttagacagaatctaaatcatgtgatagacatttgtcacttaatcacatatttgagccacaccccccaaaaaaataacctgggaccttacattctttcggattcaaaccaagttacaagtaaataccctgaaactttttgtagttggtttctatctgcttgttcaaaaacagaagccaaatccatatatttctgttgggaattagttttgtaagttggtgaatcacttgtctcctttgtcaagtgtcatcttaatactttttaaactgcttttagctgtttgggtaggaaggtagaattcttaggttgcaggtatattccagcaccacttgaattaatttatttaatcttactaactgaaaggattcttcattcttttcatattattttctcttttgactcttggccatgattcaacagagagtatatgaatacaagcatatatttgaaggtaggaatggtaggtctgtagtggaatgttaagcacaattgacctaattgtcaaataaaatgtgcagctttcagttgacatggtatgagcttgaatgatatttggataatatggatgaaagatggataagataggagagtagcagctcagatgaaaaatgggaagatctaattcaagcctggctcttgtatttaatctttggaagatctctcaaggacaagatgatctattgtaatcctgccccattttcctaattctgaaattctttgagttacttaaaaaacaaaggaagctatatattgtcttgaaagtttttgaagccagtaactactattgcaaaagatgaagctaacagtaaaacatctctttcttatgttatcatgctacctgaatgattcactttaaatagatttactttgtatcttaacttcaaactatgctaatatttaatccttgaccagaaccttggaatcttatattggttgaatgcaaatatttactaattagatttatgtacccataatcaacattttctaaatacttttaccaacacatgatgttactatttaacctaatgattatattttgatgtaggttttgatccaatgaaaaatatcaacgagccggcatttccccatcttctcttgttttgtttatgtcctttgtctcttttctactttccttggcaactaaagttcccctaacaccttcttatctgcaattaacttgatcatatttgtttttgctactttctgaaaagagaattttctgtaatggcagcagcactactctgagaattgaattccacattaagttaacctctctgttgtcaaaaaattaaagtactaaagtgtttaaaaaaaacttacatcacaaatgttcaaaaaatgcagattgaaatccagacacaggaatcctttgatgatagataattggaattactgtaaaaaaataagtattattacctttttccaatggttctcagcctaaacactgttattgttgaaaccttttcactttttatccacattattctaatagtgtctgaactgatctctctgcctgatatatttgcttgtaccaattttttttatagacttctggccatatggctttgccttaaatgcaattctgcacctattacactccttttgagtctagtattcatttgtttcacaagtcacttgggagcacctactacatgctgagaatctggcattttctcttaggagaagtcaccaataaatacaatattccacatactatgaaagaggtaaacctaaacatcatagacaagggttcctcgccaagaagtcaggaacaagtgtcccctagaagtgatagcaaaactcagttgaatgagtcagacaaaaatccacaggacataaattagtaagagaaagaatgtagcattgggagagggaaggatctatgtgaagcaggttcactgtgcactggttaccaatttgtctgagtctagggagacaacacatttataagcaacaggcagatgtatcacttacagataggcagcaagaaacaacagaagcccaagatttattgtgagctgaattcaattctgtgaacagaagtccaacattcattgtaagtcagaaagctgcccagggaagatgagctctgggctgctcatggccccacttgaaccacagatgtggaaccctgagaggcagctcatcctggcttatataccttggggtcacataaatcactgagctaaattattgaagggcattctgctctgggagaagcctggaacagaacctagctgctccagccagttagctttatctcaggatgctgcactctcagcacactctgtgattattcttaagaattacacataagaaaggggaaagaactgggtcactccagagccagccagaaaactgtcctgcaatctgtagtacagtaaaagccttgttactttacataatcaggaccagtttctgattaaagagttaaagagaagaattatttcttttacaaaaagatacatcagtcttgtattggatacagattaggcaacaaaacaaaatacagcggtttttaacaagatagaaactacctttacacattagtctgaacgcaacctatctaagaatgatgtggtaacttttgtaaagacccaggtgctttctataaagctgttgtttttaccccttgtgtgatggcctctggctcctggttgaagatgatcaatcagccattccagagggagtgttgtccacctgctctcatgccccctaccatggtttgaatatttgcccccttctgaactcatgttgaaatgtaatcctcaatttgccagtactgagagatgggcatttaagaggaaataagattatgaggtttgtgctcttatgaatggactaatttattcgtagattaatgaattaataggttagtgaattaatgggttattatggaagtgggactgatggctgtatgagaagaggaagggagacctgacctagcatgctcagcccccttaccatgtgatggcctgtaccacctcaagactgtgcatagggtccccactagcaagaaggcccccaccagatgtggccccttgaccttggacttctcagcctccataactgtaagaaataaattatttttcttcatactttacctagtttcatgtattctattataagcaacagaaaatgaactaagactccctctttttcttccctgcatttatcttgctgatgtggggaggataggaaagaaagtgactatagtcactgtctttgtacatacctgctcttgagaaactgttagtcctttatcggccatatcactgtgcttttcacctatttcctgtgaccatgataagtatgagtgatggctttagcaggctcccttgacaagttggtcagcctctggagacactggggctttagtctgacacccagttggtaaacatccctcaaaaatgctctggtttatgctttttttttagactgagtctcattctatcacccaggctagggtgcagtggcatgatcttggctcactgcaacctccgcctcccaggttcaagcagttctcctgcctcagcctcccaagtagctgggattatatgcatgtaccaccatgcctggctaatttttgcatttttagtagagacggggtttcaccatgttggccaggctggtcttgaactcctgaccataggtgatccacccaccttgacctcccaaagtgctgggattacaggcgtgaaccaccacgcctggcctggtttatgcatttttttgtccccaagatgatatggtttggatttgtgtgtctgcccaaatctcatgtcaaattgtaatacccattattggaggtggggactggtgggaggtgactggatcatgggggtggatttctccctttggtgctgttctcatgacagagttcttacaagatatgatgaagtatgtagcacctccccacaaccttcctcctgcctggccatatgaaatcctgactgccccctttgccctgtgccaagattgaaagtttcctgaggcctcccaagaagcacatgccagtatcatgcttcctgtacagcctgtggaaccatgagccaattaaatctcttttcttcataaattacccagtctcaggtagttgtttatagcaatgtgagaacagactaatatagaaaattggtactgagaagtggggcattgctataaagatatctgaacatgtggaagcagctttggaacaggcagaggtcggaacagattggagggctcaacagaagacaggaagatgagggaaggtttggaatttcctagagacttgtcatatcactatcagaaatgctgatagtgatatggacgatgaagtccaggctaaggaggtctcagatggagatgaggagcttattgggaagtggagcaaaggtcactcttgttatgtattagcaaagaatctggcagcattgtgctcctgctctagggatctgcggaactttgaacttgagagtgatgacttaggttatctggcagaagaaaattctaagccacaaagcattcacagtgacctggctgcttctaaccacctatgcttgtatgtgtgagcaaagaagttacctgaaactggaacttatatttaaaagggaagcagagcataaaatttgaaaaatttgcaacctggatatatggtagaaaagaaaagcccattttcagtggaggaattcaagcaggctgcagaaatttgcataactaaaaggaaggcaagtgctgatagccaagacaatgggaaaaaggcctcaaagccatttcagagagctttgcagcagttcctcccactagggaggaggtaaacatgatttcaaagtacaggcccagggcccagttcccctgtgcagcctgggaacactgctccctgcttcccagctgctccatctccagcagtagctgaaagggtcccaggtacagcttgggccactgcttcaaagggtgaaaaccataagctttggcagtttacatgtgataataagcctgcaggtacatggaatataaaagttgaaacttgggagcctctgcctagatttcaacggatgtatggaaaagcctggatgtccaggcagaatactgctgcagggctggagccctcatggagaacctctactaggacagtgtaaaggggcaataagtccccactaaagcactgcttagtggagctgtgagatgaaggccactgccctccagcccccagaatggtagatccactggcagcttgcattgtgtgcctggaaaacccatgggcactcagttccagcccctgagagcagccatgacaacaggggcaaaactgtccaaagccttggaaatccaccccttgcatcagtgtaccctgaatgtgggacatggagtcaaaggagattattttggagttttaagattaatgaattccctgctggctttcagaattgcagggggcctgtggcttctttcttttggccaatttctcccttttggaatggcaatgtttacccaactcttgtaactccattgtactttgaaagtatctaacttgatctttattttacaggctcataggcagaagggacttgccttgtctcagataagactttggaccttggacttttgagttaatgctagaatgggttaagactttgggagactgttgggaaggtatgattatattttgcaatgtgaggttgtgagatttgggaggggcctaggcagaatgataagatttgagtttgtgtccctgcccaaatctcatgtcgaaatgtaattcccagtgttagagatggggcctggtgggcagtgcctggatcatggggatggcagatttccccctttggtgctattctcataataaaagttctcatgagatctgattgtttaaaagtgtatggcacctcttccccaccctttctcctattccagccaggtgaagtgctggctccccatttgccttctgccatgattgaaagtttcttgaggcctccccagaagcatgctagcatcatgccccctgtacagccaattaaaccgcttttccttataaattaccaaatgtgaggtaatgtctttataacaatgtgagaatatctcatagtggttttgatttgcatttctctgatggctagtgatgatgagcattttttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccattttgtaggttgcctgttcactctgatggtagtttcttttgctgcacagaagctctttagtttaattagatcccatttgtcaattttgccttttgttgccattgcttttggtgttttggacatgaagtccttgcccacaatgtgcacatgtaccctaaaacttaaagtataataataaaaaaaaaaaatgtgagaatagactaatataccaggttgaacaatttttggcaagtctattgctaccaattacaattttccttcatagataactcatgctggttgtaggtgggcccaggaggaatctgtcctctatacctctctggaattattaattcatactggtgattcttgtccctctctacttagacattccactttgccctctcctcagtttcctttcacttctccaggtagcatcagataagctgcaagattaagtataaatgcaatggtggaactgactatcagtctttctttcatgttgaaatcctcatacttgaagagtgtttttctaaggatcctgcccttggcaggatgttcaccagttgggtaccattctctcctttttcagtgtagagatgaaaggagaggacagttcacaactattgcatgctctcaaaaggcaacttttcacatccaatacctcctcttttactgaatggggacagagagatgaggaggaatgattactgatagatgccaccatgcggtaggtcttgtggggaggtagatggcaataagaagaagaagaacagtaaccattgagtacttatatgccaggttctcttctaagtgttttacacatattaattcatttaattcctccccaaaccactatgaggtggtacaaatttctttttggtagatgtgcttgggtaacttgcccaagtttgcagtcttacaagaagtggagctagaatttgatccaaggcactccagttttaatgcctgtttccatgagcagctatagttatactgatgcttaggtgctatggagcattgagggtcaactgtcaagatgactcaggaagagggcagatatgcaatttgaagtagctgttgaaacatggcaaacacaacatagtatgatgctagagagtggatagatgagaaaataatgctggtgtggcccatcagataaagaagcagtcacatctcctaaaaacagatgctatgtctcacaaaccaaatagcagtctttttgtatatacatggtaggaaaattgttgttaacccgatatcagtgttgtctgccacaaatacacacatgaataacaagctgtcaacagaagcaccttctcaaggcatcaaataaaatgatgtgtagcagttactttaaatctccgtagtcccttttgttcatatttgctgtatcactgtacccacatattcaacaaactctataaccataaataaactggacttcagttcagtcctgtgacatcacataaaatgtttgaattctagacagaattggcaaattgttgtttttacagaatgaatagaatttgcaacatgatcatattagtatgcgtgtgagtgctgtgtctgtataaaagtgccttgttaagtgataagaaatcatctgccaatgttgtttcttaatatttaatcatatatatattaaatatttatacaaaggtgataatagaattatgtggccacagtagaaatacaagagaattctaattctacaatattgtgcctaaaattgtaatccacttaatcatccttcattgcaaatgttttgtaacttgacagctattattaaaaaaggcaaaatgtggcatattgtaaaaaaaaaaaaaatcctcttaccaagtgttcttgacatttgacaatgccattaagctaaaagtatcaaagacagagttttaaatcatgtgaagctgtggttaagctgatcttttccaaaaaggtttacagaaaatgtgttttaacttattgccatgaacaaatggaggcaacctacatttttttgaatttttgagattagtaatatatccataaagtagcagggtcatacattgtctgtaccaatataccatggattatattacccctatggcacctatttctcatcccccccaaaaaaaccaataagattatttgaaatatagagtgataaaatgtttcagacaattttccagatgccgaatttctaagcaaagaaaacaagacacaaagtaaagcaaataacagaggcttgaggtaagcagatataaatttcttcatagatggccatccaaatgaacagaaagagattgtaggatcagtgcaccaaactaccaagacaacttcagtaaatagtttagaacacatagcagcccccactccgtggctaatgataatgaaatcctagtcacaagctgctcctacaattgaaaaatgttgattttgctagctttgaattgtcatctctttaagaataaatattgatgacttagtgccattttaggtagatattttaagaacccactagtaacacacacacctatcttcccaacagccgggctgttaacataataatttatacaacgtcacctgctgatcctggagccccactctgaggagagaagttatgcataattaattatattcatattttaatattcatattgctgattatgattgtcatgatttattatccaaacttcatatgtgaggcaaaagcattataaaagatatgttgtaaaaggtgtttttttttttattagcagaactaattgatttgtagatgaacacttttctttacataatggaagcatattttgattactctgtgaataaaaccacaattactcttctcattttaaaaaggtacaaaattatttgtcttttttgccaatttcttacttgatttagagaccgtgaatgtgaacacaccatttttatttaaaattccctgtcatgctatagcttgcctctctcttaaacagtgataacatgtgtattgacatactaacaagaagaatttgaattaaggaggaaaagaccatctgaaaagaattccatatttctccatgtagaaataaggaactaatctgttatttcttaatatgaataaaatttagagatatttttgataacctatgaatattagattatctgctgttaattaaactcaggcctgatatgatgcctgaaacatcatatgcagcagaagatgccattacaaaatgaaagtacatcatctgtatctactggagtttccttgagatttagcttcaaaaggtaaaaactagttccgatttcacagagaaaataataatggagaccaatttatatacaagtacagtttttcctgttgcaacatttcggtacagacattcattcaaattcttgggaaaaaactgccgatgtgcagtttgtatatctcttatattcatacatggaggagatgatttatatgctagtcaatatttaagctgaatttggggaattctattttagctatgcaggggcggcgaatatgatgtactaacacttccatttaaaagaacttgtgagcactgaatttgtaatctaaatgttagtagaattaaaaagagggatggaggtggaactgggctacctgccatgtaatatagtgtggctagtacatatatttggttagccaaaacaaattaaactcagaaaggaggtaaaagatgctttattgcaatagtcatattcaatctgaaagtcaacataaaagtgtcttagcgtgaatggttattttctttctttaatgaatgtatatggtaggctggaagtcattaagctttaaaaatttagagaatatttctatatggcaaagtaaaaaacctattaattaatctgagtttctggcatgctttgttccattaagtatagacttataggaaaaagcaaaatataggagaaaaaacaacagagagaaaaactagaggttaattgcctttgttgatttccaagtagttttgacagctctgatccattaaaatatgtgtaaaaattgatgaatgtattcttagtaagactgtgttttgagaaggtttttctcaacactgaggttttattccattcgtaatccaaataaaagctgactaaattaaattaatagaaatgtcagcttctgtaagtgtgcattcttatgctaaaaatattgggtaattttctcatagctttccaatggagtttgcacattcacatcagagtttatttggtggaaaggagtaatacctgattagtactttttctttttcttactattttccttctttgggtaggtaaataaaaaccttagagtaattgcatgagttatctattgctgcataacaagttatcccaaaatatcatagcccaaaacaacaaacatttattatttcactatttctgtgggtcaggaacctgagagtagtttacctgaaaggttttgggttagagtctctcctaaggctgccaccaagttgttggttggggctacagtcatgtaaaggtttaggtggaggaggattattctaagttcacctatgtggttgctggtgggccctggttcttcaccacgtggccttcccacagggtgcctgatgacatgacagccagctccctcagatagggggagaaaatgaagggtaaacacaagtgcacccaagatgaaagacaccatctttttatgacctaatctaggaagtgacatcccattttctgtcacattcaattcattagaagagaatcactaagtccaacccacacttaagtggaggtagttaagttctacttcttgaaggaaggctattgtattaattttctattgctgttgcaacaaattaccacaagtttagtaactttaaagactcaaatttagtatcttaaagttctgtagatcagaagtccaacataaaggtattagtagggctatattcctttctggaggctccagggaagaattcattttcttgtcttttccaacttctggcagcctcctgtattcctttccttgtggccccttgttccatattcaaagccaacaatggtgggttgagtctcatatcatggcactatgacctcctcttcttccctcctcttccaaacgtaaagacacttctgattacatgtgaatgtacccagattatccaggtaaatctccctattttaaagtcaatttaatttccctttactttgtaatgtaacatatttacaggttccaggaattggaatgttcacatctttgggggactgttattctttctactacagttgtcaaataatttgtggatatattttttaaacctctacagtaataatgtacctagaatcatcctcctgcccaaatacacacactcaaggtccagtcctttcagaatatttattaaagtctagtggatcactaacccaggtaacaaactgcctgcactagttattcagtatccaaaagagatcaacatccatacctttctctttctcaggtatctatggttgcccagattaagtaagataaaatttttaccttaaagtaggagaaagtaactgggtttagtttaagaaatatatacatctggtgtcagaaagaatttgttataatctgagttttgctagaatactgccatgtggtcttatgcaggttactcatctcttttgcctaaggttttcttacttataaaatgagggaaataatattgatgttgcacagatattgtacagattcatttataattcagaaattgattatttcatcttctctgttgtccaaaatctactgttttataaaatgactgctattgatactgttacgtatctgtgatgtgatctttttcttctaaatcttgaggttactgataaacaatatctttttaaaaacatagtctagacctccaccagtgatttatatgtctcagccctttcaggcaggtacccagcataaacatcaagactcctttttgaggaatcacatgttgccccatttgcctatcttataggccattgctagacatagtaattatgccaaaacccttttaatatttattcataaacaagccccaagctaatttatccatgtacccttagatattatttttcaaactgaaacttctcattgttactaactataaaattaaaaattataaaattgattgttatttgtgaatgacactgtaaatttagtttaaaattcaacattgaagataaaattagattttttttccatgttgatatgaatacaaatttgggtggaacagagcatggtggtaaaaataatgttcttactaaattaggagacctatagaacaaaaatgtacttgaagttggttatgttatacaaataatttattgttgcatccaaagagctgtgatattctaccaattcatacaagcagagatataagtatcacattttataaatattttatgtatatacagtcatgaaacagaaatacaaaaatttttgtgataatctgatattgagacgaaaagaaaatatcagcgtatttccacagaatctatctctttactacctatcacagttggattttaaaaatgtttacatttaccacataaattatttacattttgtttacattttattagaaattagttggaaatctctaatcaaaatgttaagcaaaattcagatttttaagtttgtaaagaatttcagttattaaaagtaaatctcatgaatgaaaagacaaatttattctcataaaagcaaagaagggagtaaataaacattgagagatctgaaggaatacaagatttaatttgaatgccaattattaggctctgaaatatctcaatttgaaggaaaaggttttaatggagcttctatttataattagatagttatcttctgtatcagaatagaatgaaattgagaatgcctgtaactgcatgatatctacatttgctgagacattcagaagaaaattaaaacatttttgacagttttaatcatagaaaatatgttaaaagcactctgtgaatggaggtaaaaagaccacacttataaaaatattggggctaaaatatgtacacatttcactacaaaaatagaatagggaatctcttccatttatcataattggctctcagcttattttcctcagcacctgtgagaggaagtattttctcaattaaaaatgtaatacttacaaagcaaagtcattggaaaagagtcaacaatgtcaaaactattaatgaaaaaatgcaactttaaagacctttaaaattgtatgaaaaattagaaataatacagaaaaattaattttcagaaaaatataactgaccaggatatgatacataagtcaaaaaaactaagcaaagtgtctggaaaatcattcagttcatttatatttaatattcagagagtcaacctaaatttgttttaattacactttaaatatgtttattaaaagaatttatggaacctatagaaccagtgataattacattatccaatgaattaattaaaattttgaaattatataattttaataattttaatgccccctttaactgtaaagtgaccacatagatactaaattgcaagatcatcctaactagaaccttgttcatgaccactttttaccttccacagcaatgttgagtcacagaagctcagataatacactcattaattcattgattaactcattcccatatttaacaaacacttattaagctccatctatgagtcaaatattgttctaggttcattgaatatatttttgagcaaaacaggcaaacatgggagggggtccagtaatatacaacatacataataaattttaaaatagcattgtgtattaggagttataaatcctttggaaaacatacattcaagaacggtaagggggcttatgagtgtgaggagtggtagggagatgacaatttgcaatattaaataggtgagaaggtgacacttgagcaaagatttggaggaatttagggagttagccgtgcattatctatggagagagcaggccaggggagacgaaactgctacagggaagggcaacaaagcaccaggcatgtttgagaggcagcaaggagaccagaatagctaaagaggaataaaggggcagtagcaggatatgagacatgaagggcaagagagggaatgcagtgggatagaaagaggagagatacagatggcgcacttcaaaaatcctctaaacactcttgtttacacaacagctagaagaatttttatctcattggatgttttgtgttcttacttttatattagcttggctttgttattaaatatcatatatcccatttctctcctgtctttggtgaaggatcttagatcttttgtatttccttgatgccttgctctttcaggtttgtattctcagtcaaaagagctctttgaagttttgcttccttatagaattcttaagaatcacatttaatttaatggctttttactttacatatgctcatagacactttatgaaaagaatctttttgaaaataaaatcactaaatatttggtaatttcccaacaaattatataggccttgccataagcaatggattttttaagttaaaaagtcagctttatccacagaatatgatgtttggagtgacagctgaactcagggtcctggcatcactaattattagctgcattaccttgtgcaaataagactttctgaacttcaatatctataactgggaatcaataataagacccacaccacaagatcattgtcagatttttctaaatgtgtgtgaaaatttgatcaactatgaaatgacatacaaatgttaccaaccattattatcatcagtgcattaatatagcattattccattctgagctttagaatggaataattagaaaagcatttttcaaatgtctttcctgaaagctttattcttctgctcagaattcctagtattctcttttcaaaacatcttaaaacaataaaatatttaaagatataattgaaggaaaagatttaagctaaatgtgttatattctagggttgtatacttctctccacatgaaacacatttagtttcctaacattagctctggcatttcattatatttatgaattataaaatacctcacatagcagcctcggttttttaaatgtggaatacaaagtcatcacaaaaaggacctaagaaaattaagtccatatatacgcgtatgaaaagagagaaatgagaaaagtgaaggaacaagaaaagaaataccaaaatcttggggtctcctttgcttcaccaaggtaaaacctgagagttctcaaggaaactgatgatcccgactttctgttggttgaatgttaccaacaggatattctttaaggaatgttttgtcctcaagtatgaaactaaataaactcttgggatgcaatgaaattaatagtgctaagtctgttcactaatgatgaatatatagctgagatttttcaccatgtgatttttagtcttgattttcttaacagttgtattcaccgttgatgtcaataatcactgagcatatttgtcaaattgttaagcaaagttctaaacatattcaggaggctactggtgaacacttgtctggattttcttctattcattgggtttctataggctttatctcttgataaaatatacctccttcatttttaacttttgtagagagaaagatgttcatggaatatagaaaatattttttcagaaaacttattcaagataacagaggacacaaaataactttttttaaaatccaaattataagctttaggaattaagtaaatacaaacttgttaattaacggcattatcatttcgtgtttgctttgtatcctatatgaaacgtgcttctgttctcagctaaaatttttagactagacatagatgaagcatgcaccaaagccacaaggattcgtcaactttcatggccacttatgcttcaaggcaaatcaaaggtgttttgacaattagctaatagaacaaacaaacaaaagaacagagacagatctctatgactcaactgatagagctgaggcatttgccgagtttcctggtagatgtggttcgataaaacgtctaacgttagaatctgtgtcttgggaagaaaccacctcatataccaagaacgaaccctgagggtggtctcactgatagttctcagtgtactgccatgttcccaaagtgtgaaggctacatctttattatgatgcctgttacattttctatagttagcggcaggtttgcttttctctgtgatatccttgagcatacaaaaatgttcatgtttgtttacccaaactttagcatggcaccgggcatatgttgtatgttcaaataattatttgatcaatgaaaatgaatgctccctgacattttaattttattcctaatataacctttgaatgaaatatataataaatatagaaaggcatccaaatatatatgtgctttttttcacttcagtttctattagggaaaaaacagtctaaatctaaataagtcacatacaatgatcaagcttaccaaataactagtaagaagttcaagtttccactttgatttgcccttgcagacacagcctgggagcatggagaattttctggtaacaaatgggaatctggccaaccaatgatctctacattagcattctaataaccagaggccaacgtgccatagtgctgtgtcagaactaatttatgaaactaggtccaaaggctcattaaaatggtcacaattcagtgactgcccagtaaaattagactacagtttcattcttataacaccgaatattttaacatactattaaggacatacttcaagtgttaaaactagctttgatgctgtgaagggaaaaacaacaacattagaaagctatttacttttgtagaagattggctccaatctcagattttcgctcaaaatgctacaaatgtccatattttagagccctgggtgtgctgtacttgcttttgcaactctggtacatttgtgggtttttttgttttgttttgtttcctcagagtaaaagcactgctgtgtagctcttgtaaaccacagggctgtgaacccacctggccaggaaattgcaggcagcacagttgggagttgaattttcttctcctctgctgccagacagatctctctacagcactcctttaatcatgcatcctcccctgtgatgccagagctcctgggacacagagtgcattgctttacaggctgctttccacagccaaactgggtttgagtggcatagaaggtgtgacattcaaaatcttatgaagaacaaggagaggtagtggggaaagttctagattaggagtctggtgcagctgcagttcaatctgctgctaactctcagacagtcctgtctgctgctggggcagggtatcacctcttttgctggttcaatgcttggcacgtgggctttgctcaataggaaaggtggttatagtgaactgaactaacagtacaaataagaaagccatttaatttctcagtatctcaaacatctatatatacgaagtgggaagaatggctcctgctgtgcttatttcacagggttgttctgaggatctcaactaataataactaccaaaacactttttggtggtatggtgcttatacttgggtaatgtatggttatgtccgttcacttgtcaaacataacagactgttttctttatctcctgaatttttattcaatggaacagtaatgaatccctaaatcttctaaatgtgaacagtaaaagagacagaatgacttttcctggcagtctgcatgccatgactgaattatttagacttctatttaaacctgatgaggaaaaaaaaaaaaccctaagaataaagatttgtcttttaaccaattatttcagaaaaatgtttcttttagacttattcacatttagaagatactattgatagtgtggatgtcctattataaattagataccatttccatatcaaagttaaatatatctgaaaaatgacagagccagcagggattgctagtggtagagtaagttgcaaatgtcagtttattgtagcagtgtaaattatatttaatttaaaagactacgtttaacttttaaaatgagggtactccaagttgaatccatggcaaataaataaatataaaatattttcctaaacatgtcagggtatctcataaagcagtatcctagaggagctctgatttgctggatgctaatagatatatcgtccaaaatatcctaaattcatgtatatgtaagaacatttgagttaaatgcaagtgaatctttttttgcagttttatctgttaagtgtaaatagccaagaaaaggatataatgtagcatttttactaacagttttactgtgataaatttgtttcacgatacctaataacatctcccagccaggcgtggtggctcacacctgtaatcctagcactttgggaggccaaggtgggtggatcacgagttcaggagatcaagaccatcctggctaacacggtgaaaccccatctctactaaaataaataaataaataaataaataaataaataaataaataaaattagccaggcatggtggcacacgcctgtaatcccagctacttgggaggctgtggcaggagaatagcttgaacccgagaggcagaggttgcagtgagctgagatcgcgccactgcactccagcctggcgacagagtgagactgtctcaaaaaaaaaaaaaaaaaaaaaaaaaaaactcccaaaacattgttctgataaacaccattttataaaatgtgttggcaacatgtgtttggttagacttactggagcccaaagttatgccttttggtctgtataaatttaattaacaatagacttattgagcatctattgcataaacaacagtgcgtggggtgctgaagggcataagaaactgagtgaaattatgactgccctttagaagtccaaagtcaaagggcacccatactcagtgtcatggaaatggtataataaagtaggtgcgaggtgggagagtcacatctatttgggtgcagaattgaaagtatcttcccaagagtcaaaagcatgaaataatagaaatccattgtgatcacctttaatagtatgcttacaaagattggtcaaataaatgtagttacatggctggttagtattctggtggatgacactttggaatagcacccgtctccatttgcttcatctcatttgcctcaagttagaataggttcagctcattgacttttttcagttccataagtttatagttatatctgtcacggcatcatggtattgcttattcagttttaaattaaagaagaaacaaaaattggctaaatttttgagagcagttaatacatttttaattaacttactgtgaaaagatacagttagtagcccaacaggatatttttcaattgtttgaacctgaggtttaatatcagagggataattttggagcaaattttactttttttatacttttttcatgctaacttgaaatattgaaacttcagaatgagatgggtctattctctgcttagagagaatcatgacaaaatgcaaatggcccttctcccttcaagtgggggcgtgccaggcatcaattagccacaggtagagttctcttaacctgtggtttgttctcttctgctttatccctatggctggaatggagtgagagtagctagcttctccacgcagatgtgatgtgtagtgcacccaaacataaataagtcttatcaaaagaattcatttaaatggtgcctgtttggttttatcaatcctcactcagaagaacataattctaatagccagataacaacgtggaccagcctggtatataggcatctgtaaaggtacttctgcacaatgactacaaatttaactaggctttttgaaatatgccaaaagcatttattgggagtgattaaacccacatcatttcttgagaacagtttaagagctctgaacgttgatattttgtataaatctctttgtaaatccagaaaacaaagaaataacaccttactttttgtgtctcatgttttactacaaagcccctagcttatgagagcgtagaaaattgaaccttggtcattcttccatttactctactttgtgagtaacttacacagtgccaggataatcagggaacaaaacctcaggagacttctctgttgttggtgaccacagagttactgctaggatgccatactgtgtgtctggtcccttcaaggccaacagctcttgaggcatgagaacctaagccttggcttccaatgaagctggattgtcctgaatacccaattaatcttgtatttataaagttcaatacaaagggactgctcgttcattcgaatcttggcaaagcttatgttcactatgattacctgagctctttgcccactgtaccctcctccatggaatcctttctgcccctttcacccttctccctgtctactaaaaccaggttttagatgataaacaacatagcactgcagaatatgtaaatatgcatacagatatccttcacttaggatggggctgcatcccaaaaagcccagggtaagttcaaaacgctataaattgaaagtgtgtggctgactaggagctatggctcacttccactgcccagcaaagcgagagaagtatagtttctacagaatgcaaattgctttcctaccattaaaaactcaaaaatcgttaagtcgaactgtcataactcggcgaccatctgtatttaagcataaatttccatacatccaaaagaaaattctgcatttgaacacgtttcattgtatataagtggcaaagtattttctttggcattttttaatacctttgaaaggaggttaatgtgtggaaatactgagtttaacaacatttcatgaaaggtttttcattgtatgaatatgctgtcaatctaagtgtgttttcagaatcactgacagtatattatttttaagaacaagataaatgctacaatattttgtcaataaacttaagtctcaagctttttatttattgatgagaataattttacatgttcattttatgtcattaagtctaagctagaaatatataaaagatgtctgatgatattttcatgcgcatgtgccctctaccatcattacagagcttaaaaaacttgtagaaatctgtttttattttacatgctttttttgttacaactgtgtcacatctaaaagattcagacagcctcgatctggctgtgccttattctaagtcatacaagagtcactattttcctgagtgattcttgggtctttcctctactcagaaccctaaattacatcccactcaaatcagctttgaagctctaatggggtttctaatgatcttctcacacccaataatccacccacaacatgttctcttttcttaaatataccagctcacaatctgctaaaaccacttgttcactaaaacctaatgtctctggcccagcacggtggctcacacctctgtaatcctagcactgtgggaagccgaggctggaggatcacttgaggtcaggagttggagaccagtctggctaacatggtgaaaccctgtctctgctaaaaatacaaaaattagtagggcagggtggtaggtgactgcaattccagctacttgggaggctgaggcaggagaatcacttgaacccaggaggcagaagttgcagtgagccatgggcgacagagtgagactctgtctcagagaaaaacaaaaacaaacaaaaaaaccctattttctctgatgtgaatatttatcaacacataatttacagttttcattcctattttcttaaattccttattagttataaattacatacagaataaagtaagtaagttatgaggaataatgctgtaatttacagccatgctcttaccacccaatttaagaaatactaccttactattaactttaatgtcttctgggtgtcgtttccaagtcccacactttttctactcctttagaggtaaacttcatcctgaattccttgtttatctctgccttctttttttagaaaaatgtttatttccataggttttggcgaacaggtggtatttggttacataaattctttggtggtgatttgagagaatctgatgcacccaccaccctagcagtatacactaaacccaatttttagtcttttacccttcaccccctcccaccttttcccccgagtccccaaagtccattgtatcattcttatgccttcatatctccatagcttagctcccacttatgagtgagaacacacgatgtttggttttctattcctgtgttgctttacttagaataacagcctccagttccatccagattgctgcaaatggcagtaatttgttcctttttatggctgagtagtagtccatcatatatatatacacaccataatttctttattcacttgctgattgatgggcctttgggctcgttccatatttttgcaattgtgaattgtgctgctataaatatgcacgtgcaagtatctttttcgtataatgacttcttttcctctgggtagatacccagtagtggggctgctggatcaaatggtagttctacttttagtttcttaaggaatcaccacactgttttccatagggttgtactagtttacattcccccaccagtgtagaagtgttccctttttaccagattcatgccaacattcattattttttgatttttttattatggccattctcatgggggtaaggtggtatagcaccgtggttttgatttgcatttccctgatcattagtgaagttgagcattttttcaaatgtttgttggtcatttgtatatcttcttttgagaattgtttattcatatgcttagcccactttttgatgtgattatttgtttttttcttgctaatttgtttgagttctttgtagattctcgattttagtcctttgacagatgtataaattgtgaagattttctcccactctgtgggttgtctgtttactctgctgtttcttttgctgcacagaagcttttttttctagttttatcccatgtatttttctttttatacaatatatcattcaattttgcaattaaatttacatgaaagaattcatactgtcagtatttttccagggcattatttttgttcagtgttaggtttctgaggttatcaatatttcaatatttcctatggccctaattcattttctctctctctctctgtctctgtcatttctctactgttgtatagtattccttttggtaaatatgctaccatttgtttatcctattaaaaatacaatgggtatttgtgttttttccaggaatcttttcaattccaatgtactacaatgaacaaacttgtatataccgtatggtacacatgtgtaaaaggttttttaagtgtgtacttcctggatcacagagtttgaacattttaagtttattagaaactgatgaattatttttcaaaatagtttttaccatgtacatttatatctgcattctacacaaattctatttgctcagaaatgccagcatttgatattaccaggctttgtaaaatgtaaattcaatgggttttatttgtatctcatgatgttttaacttgcatttcccactactaatgaggttgagcattttttcatgtgtttattcaccactcatgttttcccttgtgtaaagtgcttttactaggctttttattaattttctatttggtgttttgactctctttactatgatatgcatgagtttcctatatattcaagaaacaaatcctttgtcaaatttatggttcttttcactgtctttatgtggctttttatgaccagaaattcttaattttaatgaagcagaatttatcaattttgtattttaaggttagcgattttttatgtctggtttaagattatcctcccatattcttagctcaaaaagatattctattttattgctttctaaacattttatattttttcctttcatatttaggcaatagtaattgatttttttggtatggtgtaggtagatgttcaatttcatatttgtccttgtggataaccaatcattccatcattatttatttaagaatcagtctttccctcactgatctgctatgtcggctccatgtgtttatatatgtcaattgtatgcatgtacagttttgtcatatatacgtgtgtgtatttcatgttcattggtccctttcctatctctctaccattactacagccttaattaccacagctttaaaataaatattgataaggcaactttaccaacttcataccttttttccaagtgtatcatggctatgtttggcctttgttctattgtacaaattcagaatcagcttgtcaagcttcaggcatatacataaaaaatattggggattttattggaattacatggaatccataattatcttgaagataactgacatatttattatattgagtcttctaatttttctgtttatataaggtaactgtaaaatttttcaatacagttttataatttttttcattaaggtctttcaagtgttgtaatagattaccccttaatactttgtcttttatagtatgtaaataatatactttagactgtattttatacatatgattgttgtatagagatatacaattgaattttgtatactggctttgcattcaataaacttattaaactctcttattaattgtaataatctgtggatgctttacaattttttacatgaacccacatatcatcagcaattagtgacagttttatttcttctctctcatttctaaaattgctttcctgtcttactgcactgactaggacatctagtacaatattatataaagtttaatatagtgggtgtccttttaaattatctgatcttaaagcaagtgtgcccaatgtctcactagacatcatttcttgaagcattaggtataatgtttaatatagatttttgtaaatcttctttattaagtaaggaatttttcttctcttcctagttgctaaggcttttgtcacatatttgtcacctatgttgaatcagatgattttatgtctcacattctttaacctgggcatagtgacctgtgcccgctgaaccacaaggatgtaaaaactaaaactcatgttctggcagcaacaagtatctttaaggaacaagccaggtgcagtgttctttttccatttgatttcctgtttccactcaggtggaatgttcttcaaatcccttactttcttgctagttttatgttgcattctttaaaaggatacatttatattttatccagaatttttggttgttttcagtggtggatagctcagtgtatttagtccactgtgcaagaaatagaagttttccctttcctttctgtcaaaataatatccctcatttcttgaagcacatctcctttagatttccctttctatcatcatttggaaattttaactttgttcaatctagttatttatattactttccaaaccttctcctcccaactttccaatttcttaacagttttacatatttctttaagattgaggttggtcagttgtatgcatagactgttttgtcacatacttaaacctctttttgtgtatcccagagacaataatattttcagtttatgaaggcaaagtatgtgctctcttctcattttgacaaccttggaattcaataactacatattccagttgctgagtgcattttgttgctcctttagtaaacctggtatgatttatgatcaaatccttctagcttccttttctatataaatggaaaatatatcataggaaatttaataagtcctcctatgaacagaactctatttcatacaaatgtttatgcatactgaaaaattcttagcgaaaaatgaaaatcagaagaacatttcattctctttttgtttcatgaagcatttctggccagtcacagcggctcacacctataatcccaacacttcgggaggctgaggcaggagaattgcttgaggccagaagtttgagacagcctgggcctcctagccagacctcatttctacagaaaattttaaaaattagccaggcatagtggcacatgcctgtagtcctagctacttcagaggcagaggaaggaggattgtttgagaccaggagttcaaggttacagtgagcaacgatttccccactgcactccagcctgggcgacagagcaaaaccctgtcttttagggaaaaaagaaaagcatttttgattctcctcactttgctcaacattttgattgtttatagtactcatcgttttctaatatggtatatagtttttaattattatgtttgtttctcactgtcttcccccagtaaaatgtaagttccacaagggcagagatataatctgttttgtgcatgacatatcccaaacagtgcctgacatagagtaaatgctcaataaacatatgttgaatgaatcaatggtgtacaatatttgcataaacaaatagtaaaaagaaaaataaaagttcatgatttacttttctcagatggtttcgtattttcttaatcagtactgttttattttatgctttcagatatcaacatggcaggagagcccaaaccatacagaccaaaacctggaaacaagaggcccctttctgcactttacaggtaagtagataagcactgttttactctatatattagtgaaattttcttgcagctttataaggcaatataacttgtaaggcatccactatttaaaataataatccttattggaataaagtacaacaaatgttgttggtcaacatataaatatatcttgctgcattggcaaggatctcaatgcctaaccttctcatatctgcttatacaacccttctacgagatacttatctaataaaaatcactaatgactctacctgacaagtaggtggaaaggccaatgttggttaactttttttattttattttattttttgagatggagtctctctctgttgcccaggctggagtgcagtggcacaatctcagctcattgcaacttctgcctcccaggttcaagcgattctcctgcctcagcctcccgagaagctgggattgcaggtgcccaccaccacacccagctatcattattattattatttttagtagagacacggtttcaccatgttggccaggttgatctcgaacttctgacctcaggtgatctgcctgtctcagcctcccaaagtgctgggattacaggcatgagccaccacgcccagcccttggttgactattaactgcatgccatgttctttagctattttacatatgttgtttaatttaattttcacaagactcttgcaatgtagatattcctgttctcataatgcagctcaggaacctgagatgcagtttcttagtgattttttcaaggtcacaccactggttaacaatggcaccaatactcaaactcatgccctctgtaccttaaattccactcagtcagtcagccttctttattacaaagtacatgtttctctcatgaccatttttcccagacaacaaatatagtccttctcttctccagagagacagatccaattcctttaacctttcctgaagtgcttgggtctgagtcacttaacactctggtctttcccctctacgtgccccaatttgtcagtgtctatatctatgcggagaatccaggtgaagagatttagcacctttgttgttctgtatatacttctattatgttaagtagaattgagttgattttggggaagagtacaagagtaaacttatataactttcagttctttaagaacagccacttctgaaaaaattatgttctgctgttaaaccatatgtcccacttcatgtgcttttgccattagtttttgtactgtaagtgctgactttgtgtctattgctgtttaattctcttttgttagatatagccaattgttccaggctattgagatctcctgtcatcctatttatttggttttctcccagatacatatcatcagtccatcagtatctgcatctgaagagttaacataaaagtgttgagcaaggcttcctttttctctgatatcatttggataaaggagaattaagttatatgtgttaaaattgattattttctgatttagtatagtaagaagagtgctcaaaaatagcctggagcactttccttgtttttgttctctgaaaactagcatatcttcttttcagccacttatagcctcattttttgaactctaagatgagggtcagaactagatcacttctgaggtcctagtcatgcctagtaccccagggctctctactgtatggtattcagagatttttaaagctatactgaaaaatacatcataatttctcttattttggttgtttttgttttaataaaacattttcttaaaaatggaaagcaatagagtataacaaatgttgatagtgggtcatggggtaatattgacattaaagagcagagatgatgttatcaacaagaagcaaatgacacattctgtaccttgtttgaggtaaaggagatgatttataaaaccgagaaatttttatcagattcatttgtaaatgtatacattagagctgcagctaatgcagaacatttgaaaagtcttattttcaattactgctaaaacaagctgccaatggcttttttttatcatcaaagagttgctactgtctgtgcaatgatgttaattttcatattttctcttttcttggattgttttgattttcttatgagaatggaagctcatgacatgaatgtcattttcactattatttctctattactgttatattcaattgtgttcaaaagaactagaagcagaatttcatttaaatatgctatattgcatacaagccacattagtgagaaagtgcttatttatcctccttttatctgtttacacaaattaaggctgtacactgaaattgcaaaacagtaataaaggggatacaaaaacgtgaatgtatagctgaggaagcccttttatacacattttctcattctcacgtaagcttaagaaaaaaattaccttaattttatgtggacaaactatgctttcatagtcattcacctgttcatcagataactctacaaaattggtagtatatactatgctgtataaatgagaaacctgagtttccaagacaataaagggtttgttcaagacaagatcacaggattaggaaatgtgctcggttttcagccttcacgtctagtattctcaccactagattatagctccctgtatttagtcacttgctaccatctaaacaacacagatagggaaagtagagattttctgagcatcaaaccaatcatcaatactattactgtccatgaataccatgccagcaagtggcagaggaaatactatacaataaacactacataagaaaaaacagatataccacctatctgtgtgatcatagggcacaggttttaagcttcaagtaagtaagttctttttgtaacatagtagttgtataattttcctgagaggatagagttgcataaatgaggtaaaagcatttagttcaatgtagagaatatggtggcggcttggaaaagggatggtttttgctttcctgttctttgcatctctgagtctgtgttttgttttgttttgttttattttgcttttgagacagagtctcaatcggtcgctcaggctggagtgcagtgtcgtgatctcagctcagtgcaagctccgccttccaggttcatgccatacccctgcctcagcctcccgagtagctgggactacaggtgccggccaccacacctggctaattttttgtatttttagtagaggcagcatttcaccgtgttagccaggatagtctcgatctcctgacctcgtgatccgcccacttcggcctcccaaagcgctgggattacaggcgtgagccaccgcacccggcttctgagtctgttttcttatctgtaaaatgcgagagggggactctttttactcggtcattcattcattcatttatacaagatatatttagtgtgtatctactatggtctagggactgtaatagtgcttttctaggaaactagcatagaaaatggcaagaacagggtgaagagagagcataacgtaatgaaagtaagttatttgtatgaaggtagtctctgatttaccttcctgctctaaactgctatgtctctataactattctatttggaccactaagtgaactgccgccagactttcttcttcacgtacatccactttatctccaataccaatcacaaagtggtattcacatgaaatatccactgaggcataactttgatttgtttcttcttttaataggattttcaactcagccaaacaaccttcaataaggccttattatgtgctaagtaaacatggtatacatagaaaataaaacagtgagacttcaaaaagcttacagtcttatgcataagttagatgcacagatgaataaagacaactgagaagtatgcatacacttctgtaagagaataaatgaggaagttactgattctgcctagggagcagggagtaaaaacatctggaaagttaaaggaagaagacaacacttgagctgacttttgaagggaaagagagagggaagggcatctcatagtaggagctaggatagtctaccttgtggggaatggaaaactggggcattatggtgcccaggctgtgaatatatctatatatcaggttaaggagagctgacttttattctgtaggcaacaaggaaccacttaaacatggtgactgatcggaaatggggtgtgaggagagagagtcacaaatatgtccagggttttctagttcaggctactgagggaatgatcacatgagctgaatagaagaaataggaaacacatgataagcaatggcaggctcaggtgtaagatcgaggaaagggagcaaaaaggaattatttcagtcttggacatgaattcataaagacagacaattcattaaaatagcacttgcaataaaaatgtctcccattagagtctatttgtaaatgaaacataattaatcatttgtgaacatttcataaatattggacctggccctaatggtgaatagctaatccattctctagggaaaacattgtaacttttaataaattgctgcttcaaatacgttatgtacattacacaatatctgtggcactctaaaataataattctcccccaggaagtgagttttccagcatgccaactttcaattaatgctcaataattgctaaatgagaataattgtatgatggttttacttctatttgtaaagtagacagacctttcctctttgatggaaagctaacaaaaaatatcagagaacaaagacactatttataagagatgaacaacaatggattttttttcacctagaggtgactcccttctacttgcagggaactcaactcagtaagacatgtagtatatatagtttcatcccattgattctgtaaaaatcaatcatctggtactattgccaaatattgcttttggctatcatacaaatgcctcttgtagcaaccttcccatcccacccagatgaccatgagaatcaagattgtcacaagtcatttcaagagtctttaagattgtcagaagataacctacagttacagccaccattttaagatcatcacaattggtggtggtcaccatgaatgtgggttatattacagtaactccaatgataaaaaataactttcagagcacagaccaagtaaggtgactgcagcaaaatatctccggtgattcattcaccactggacctacgtgagttttgttttcttccttcatggtggctctagcacatcatgggaaaagggacccttgaatcacctaaaatgttccctagaaccttgaaagtagaaatgaaagtaatgtaagctaatttcagctaatgctaaatagcaaaaatcagtatgaaggaaaaacatcctggtcatcttcacttcattgacttatactgtttgctgagaaatgtttaccaattagctattgatcattttattcattttctgtctccttttataacatcaaggataacacacattccctttcagaagcttaatatttccattatcattatctccctttgcactggcaaaggcttccttccatttcacctacccagccagatggttccactcaaactacagtgtgaggaggagagggaaatattttctcctacccgccatattaatacatcctgtccttctgaaactgacacaagcccaaacactgacctgcctccctggtttactttgaatgtatgttattgcttaggtctacatagcaattgcagtctctttctgctcaggatcctatctttcctgtgcaaccaaattactaatgtatggttatcaagatccacaagagaaaataccaaaaacggtgtatatttctaaaactcaaacctgaatatccatacatctgggtaattgagggagagttctctaattcagaaatctccacaaatgaatgttgaaatgcttttgttctagaaaaggggtcaaacattcactttattgattgtttaaatttgtgcaaatgttttatgtgtgcttgttcagtttgcttggtgggaaaaatgttagacatacctcctaaaataacctgagcattatcagtgctttgaatttgatttttttgttcctcagctttttgggctgcataaaggaagatataaaatttcctaaaaggtaatgtatttaaggagcctgcaactattagagatactctacaaattttagttatcctcatcattatgattattcaaagaaaacatctatgataaagtattttaggaggtttttcttgttttttgtttgtttgtttgttttttaagacagggtctcgcttcatcacccaggctggagaacagtgggcgtgatctcagctcactgcaacctccgcctcccaggttcgagtgatcttcccacctcagtctcctgagtagctgggactacaggtgtgtgccaccatacctgtctaattcttttttgtatttttagtagagacaggatttcaccatgttgcccaggctggtctcaaactcccaagcttaagcaatctgcccgcctcagcctcccaaagtgctgggattacaggtgtgagccactgcttccagctttgaaaggttattttatatgtttttagctatgatgatgttgctaaatctcacacagtcaactaaacaggttaatgttttctataacttctttaaaaataaaattttttaaaagattattttacttatagtatgttcctcacattttaacactaagcaaatataacttatagaccttttatttaaaatgttcaaaaaagtgctgacacaatacccattaaatagttctgctgcgggcaattctctctgctaggctaaagaatggcctatttgcagttttctgttatgtttttaatgcatgaatatccattaatatcttctggcatatagaaagaatagagtagaggtagagggagaacttaatgcagagaatccatctctaagacctttgtggtttatgttgctagtcttcaggttatttgaaagactacattactatttgtttggtttgacatagtttatgataaaaatcaaaggaagtaaaaccatgcaatcaattttaaaaggagaaaagtagcaagagtcaataattcagtgggaattgagggaggtgggcaggtaggatcaagcaaatcaagcaaaaatttaattatactaataaaacttatgcagtcacaaagtattacatgagcacaacaaacttagccatgtgattcatggtagtcaaggcgaaaacaggagcaaaataatctatgtaaccatgtagtaaaagaaaatacttgaatatgtgtgagaagaaactatgttttcctaactctgttttctgatgtaaacttattatataggccttcataggaagtcatctaaacagcatagcaggtaccaccttgagtagcatttagacaatacgtgcatgctgtgcacacgcgcgcacacacacacacacacacacacacacacacaggttttaaagctgatgccatttttcttatgaactcaataaaagaatcacacgatattcctttcctttctgcttctcccaaggcagtttactatactgtgacaaatttatcatcctataaaattctaggagtagtgttccatgtagctagatctacagactaggccttcaaattaccacacagctgcatacttggaggagatagaaaggaaaagtgggctgaccccttgcttggcttatccactcagcttctaagtctagaagaaaaagacaatgcttgaatgtctagaacctgtaacagtgaccacttgagctgctacttaagactcctctttctttgaggtagggagaagtggaaaaggaatagtaaaccaagcatgggatagaaagggctgaaatttcacatcattcttacagttggcaggtgccaatgaagacaggcaactgattctttctaactgttggttttactacaccttggaaactgtagcctgtcatgaaattgttgctttcttttatatataaaagcatggttctgtgctgaagctaagatctcttcatcagcaggactcacattatgatcttttatgctatattctcctggcatctcactgtggggtattgcggttagagcaccaacaacagcgctagtccctactggagcttagcaggaacgtgtgcatctcatatgctaggtcattgcgcaagtgctccctgcctgggatgaagatgctttgtgggttttatcttgcaaagggcaatgcccttgcttgcttgtaagttgaagtatcttcattgtcagtgttgatttcatttgttttcattattttatgggtattgttcattgtctttctatccagtgacctgtttcttgttttaggacagtccttagtagagaatgtagggtcttgagcgtccaacctatgataaatttgtaagtccattgtttgttttaattttgaagtgttatctcattccctttgtgctcaccatatcaccttctccttctcaatctatccctgtattcaagattccaggatatgtttttccttccatattactgtatggagggtagcatgaaagaaattgaaatgtctctaaagatttatctctaaatgaatcaaattaaagactaaaaatttttaatgttccagtgttactctctcatcatactgttggggaaatgtaattaaaacaagtattttcccaagtcagaaatcctctccacaaagctaatagagaaagaaaaagcttgtattatcgaataaacattaagccaaaatgtggtgcacatcacaggcaacctaagagactgaagaccgaaagagatcttacctttttatgtagctaaacacatgcaacctattacatacatattttcaatataatcaacaagtagtcctcaagtaagaggattgacagcaccatttgtcatagatccttcattctaactgtttctggtaattggggtgaccatttatttatgttaggtaattgactttatgcaaaagaaaaacaaacttttcatattctcatgaaaggaggtagttctgcaatttggaataagcctcctgcccccactctgcctccccaggtccttgagaaagacattcccaggtcacaaagctgacaaaatgccaatctagtcttcaagtggattcatatgtatttaaaaaagaagatgaagtaattgcaattcacagttttctaaagtaaatccccaaatcaaaaggaagggagggaaatctctttctttattttcaatagggagaattaagccacctgtttttaatttgtatttgtccttggaagcacaaggaagaaaaatcaaggcagaaaaagtgagcaaccagccaggaagtctaaaagctagggctcaggttcaggtttcctgcctccaactctgaaatcattctgtgtttttcttctaattttaggtttttagggttttgtctcatttctttttaaacaatagtacaattggcagtgccatttaaggactgactactgaagattgatggaaagttcctcttttttcacgcattctctggcagttagaaccctgtgctccacctcctggttgctcctctaaagcccctgcagccacatcagggcttcttctataacacagtcttcacacatgcagagatgctttagcagcagacggaccgtgtaacttctaacaatgaaataaatggtaataaacaatttgacaatgtgtagaagaatgtttgagcccatataaaatgaggagaggagagaagaagaaatgaatattaacagtgtagatggacgtgattaatgagaaaccaaacagccctttttcctcggtcatctagtctcactcttacaatgtgaatgattttttaaagacatataaaatcatttacaaaattggcaaattctattacctttgtaaaaatgtatttttccctagtccattaaagtttgaaaatacttattacaaatcataagctagaagactttaggttatataaatatttttaatgttaattatgaacaagttctgcacggtagaaaagtggcttataggttttttaagtgttggttggttttaattatattaattagaaaataatctacaatttccttataaaacttacataaactgtttggtgtctttgtgagagtaattcttctgatggaattataagtactagaagtgaagctagataggcctcctttttccatgtttagacagaaggcaaaagggaacaccacaaagtctcactagattatcagttggctatgcatgatgaatgcttcacacgaaaattcattattttagaagttaattaactgttaaactttctaaatttctttctagtggaattataacatgattgataatttatttttattggtatttccaaatatcacaatacttagggatcttcttccaactctgagagttgacatctattttgcttatgtttattgtatgaaggaatcaaaagacaaggggcttgtttgaaataagcgtattacattggagctgaaactgagatgccacatagtttatgtagagtttgggggtgctttttgttttttataattttaacttttgttttagatgtagggggtacctgagcaggtctgttacctgggtatattgcatgatgatgagagtttatgttttaatatttgtttgacattatctcctcttcccactcagtcctgaagatttcagtgttcattagaagcactggactggaagtcaggaaacctgcaactaagttgtgtatctgctactacctgcccaaactaattaagtgattataaaaaaaaatcaacctctttaagccccattttctcatagtaaaatgaaggagttgaattaaaacacctcttactttatttccatttctaacattctgggattctgctgtttacttcccaatccagagactaaagtcagacatacatgctttattgttaagttaataccttttttccttcaaactcggtgcagtgtcttaaagtattcatgtcttttgactaattccatcctttgaagtatatctaaggagataattttaaatatttttaaaaacatttttaaaaaattaaatttttccaagatgttctttgcagttttatttataatagtgagtaatttatttataatagtgagtaatctgatccaaccaaaatattaagcagtaatgggtatggtgcacctattagatgaaatgttcacaaagtgttaataatgacatgaaaaaacttagcatttgattagagaaaaaaacattttaagttctgggatacatgtacaggacgtgcaggtttgttacataggtaaatgtgtgccatggtagtttgctgcacctatcaacccatcacctaggtattaagcccagcatgcattacctatttattctgatgctctccctctccccacctcaccgcccataggcccgagtgtgttttgttccccacctgtatccatgtgttctcattgttcagctcccacttgtaagtgagaacatgtggtatttggttttctgttcctgtgttagtttgctgaggataatgacttctagctccatccatgtccctgcaaaggatatgatctcatttttttatggcagcatagtattccacagtatacgtataccacatttcttttatctagtctatcattaatgggcatttggtttgattccatgtatttgctattgtgaatggtgctgcaatgaacatatgtgtgcatgtatccttataatagaacgatttctattcctttgggtatatacctagtaatggggttgctgggtcaaatagtatttctggttccaggtctttgaggaatcgccacactgtcttccatgatgtttgaactaatttacattcccaccaacagtgtaaaagagttcttatttctccacagcctcgccagcatctgttgtttcttgtttttttaataactgccattctgactggcatgagatgatatctcattgtggttttgatttgcatttctctaatgaccagtgatgatgagctttattccatgtgttcgctggctgcataaatgtcttcttttgagaagtgtctgttcatgtcctttacctactttttaatagagttgtttgtttttttcttgtaaatttgtttaagttccttgtagattctagatattagacctttgtcagatggttagattgcaaaaattttctcccattctgtaagttgtctgttcactctgataatagttgcttttgctgtgcagaaaatctttagttttatgagaacccatttgtcaattttggcttttgctgtgattgcttttggttaaaaggaattatataaacatcatgaccaaaactacttaacaaataaaatatatgcagagaaaaaaatagagcaaaatattaactgtaattttctttgtatggtgggaatatagataaatttttctttaagcttttttaaaaattatacttcaagttctgtgatacatgtgcagaacatgcaggtttgttacataggtatacacatgctatggtggtttgctgcacccatcaacccgtcatctacattaggtatttctcctaatgcaatccctcccctagccccccacccccaaacagaccccggcgtgtgatgttcccctctctgtgtccatgtgttctcattgtccaactcccacttatgagtgagaacatgcggtgtttggttttctgttcctgtgttagtttgatgagaatgatggtttccagcttcatccatgtccctgcaaaggacatgaactcatcttttttatggctgcatagtattccattgtgtatatgtgccacattatctttgtccagtattactggattcagtattactgaagggcatttgggttggttccaagtctttgctattgtgaacagtgctgcagtaaacatacatgcgcatgtgtctttatagtagaatgatttataatcctttgggtatatccccagtaatgggattgctgagtcaaatgatatttctggttctagatccttgaggaattgccacactgtcttccacaatggttgaactaatttacactcccaccaacagtgtaaaagtgtttctatttctccacatcctctccagtatctgttgtttcctgacattttaatgatcgccattctaactggtgtgagatggtgtctcattgtggttttgatttgcatttctctaatgaccagtgatggtgagctttgtttcatatgtctgttggccacataaatgtcttcttttgagaagtgtctgttcatatcctttgcccactttttgatggggttgtttttttcttgtaaatttgtttaagttctttgtagattctggatattagcccattgtcagatgagtagattgcaaaaattttcccccattctgtaggttgcctgttacctctgatgatagtttctttagctgtgcagaagctctttagtttagttagatcccatttgttaatgttggcttttgttgccattgcttttggtgttttaatcatgcagtctttgcccatgtctatgtcctgaatggtattgcctagtttttctcctagggtttttatggttttaggtcttatgtttaagtctttaatccatcttgagtcagtttttgtataaggtgtaaggaaggggtccaaaacagcatggtactggtaccaaaacagatatataggccaatggaacagaacagatgtctacaaccatatgatctttgacaaacctgacaaaaacaagccatcgggaaaggattccctatttaataaatgacgtcgagaaaactggctacccatatgcagataatatttttcttataactttaatacataatgcaatttttctttaaagagaattttataaccaaaaaatgatgtattttaaaattagacattttcagtgaaaaatgacaaacaccatacaaatgactcatgcaggcaatagtgaaggttttgggaggtggggctggtgttaagcaaagccagtgaaacacatacagcacttaatctttagtactagactgctttagtctccatggttattagaaaagttaattttctaaaagggcaacttcattaacattagtctcacagttcagcgcagtccagtgaccctgtgtggaggcatagttcctactagagctaactgcaggaagtggcctatcagtcagcccaggccaggacagaatgccgagttcagtatgcagagcgaagggcaaggagcaggatatgggggccaggagagcagctgaagtcgtctaatcttcaaaaagaaaaaagtcaaaatatctgagcctttaagtggtgcagtggaatgagcaatcaggaatgtgtgctaaaggcagttcttatgactgcagattagtgagcaggtaggaagacaattgtgcctgcctaataataactgccccctggtatttaaagctgtaattcagctgctttgctgctgctttgaaaggacatagcgtgtgtgagctaaaagagtaacggaataaagtccaggttgtagccttagtatgcagagcgtgggacatgacagaaaaacaggagacacatgatgtattcctaactcagagaatctatcatcaatgcagagcaacaaatggtaatgagtctgagttcagtaaatgtatcagaatgtactttttaagaatgtgatacaccaaccaatagctgagtttgaaaaggaaacagaagatgacccacaaattacagataatcaagagtgaaaaagcattttgagttgaattacttagcaattgttaaaggtagtttaaatgctatcttactaaaactatctacaacatcagtggcaaagacacttatgatactgtgagaattcaggaagaatttaaatggaattgtaacataattttatgatttgttgaagattatctttttctcatttttttccttactctttgttactccaactcaatatagcaaatctcatgtttagaggatcgaaaaaaaaacattatatgatctcattgaaaatatgggctgggtgcggtggttcacacctataatcccagtacttcgggaggctaaagcaggcagattacttgagcccaggagttcgagaccagcttgggcaacatggtgaaaccccatctttacaaaaaatacaaaaattagtcgggtgtggtcatgtacacttgtagtcccagctactcagaaggctgaggtgggaggatcacttgagcctacttgcagtttgaagctccatgagctgtaatcactccagccagagccacagagtgagaccctgtttcaaaaaagaaaaagaataaaagaaatatgaactaaattgagtatagaaaagttgcaatatttggcattagaaaataaagatattatgaaagaaataagtaatatcaggtatccattttaactgaaaaagcaaatgtattatgtttttaaatgtaatgctaatgaaataaaagcaagaaagactagtcttaggggtaggtgaagcacatatagacaggcagttagtagtctcactggagtgagttgccatctggggagccagtcagtgtgttacaagtttcttggtcatacaataaagtccagaacaaagctccagtcctggaatgttaattgaaaaaagcagggcaagctagtcagctggtcttcatgagggattgtggggtggcagccattagaacttaagagccaagacagccaaattttagggacaaaccaaattggtggcaagagagatgaaacgcaaaataaatatttcacatacggtcagccctgagggtctatgtaggaacaatggagacttgcaaaagaatttctaatcccagcatttggagcagatcatgggatctgaagcctggagggatgacttacctcttagcttctatgaacagagtttgcccaaagactgaccaaattcagcctatattaaagattcttaatggatctggtgcagaaggaaacataaatttgtggatgtagtcatttattcatcaattaactattaagcacccactggacatttttctgggtaccaaggatatcccagttaatgctacaagaaaatctttagctgaattaaatgtaaaagaatttaattgagcaaaaaacgatttgcaaattgggcagtgtctcaagccagagtacattcagagattccagtgcagttacattgtggaagaagattcatggaaaaaaaagagaaagtgatgtacagaaaatagaagtgagatccagaagtagcggattggttacagcttcacatctgccttatttgaacatggtttgaacagttgaccacctttgattggccagaacttggtgattgccacaagagtaagctacggtctgtttacaatttcatttaggttataattcaccgtgtactgagaaacctttaggctgaacttaaaatatgtaaagaggcaactttaggctaaatttgatttatgacaaagtagacaaaaatctctgtccttgccttcaagtttgaggtaactaaagacaaacaaaagcaaactaattataaattagaaggtagtagatgttatagaaaaaaattaagctagaagattttggaagtaggaagatgacaagtactgcaattttttatagggtgctcaatgaaggctcagctgagaacatgacatttgagcagccgtgaagggggtgatgagcaggcaaagtgatgcctggggaaaagcattctaggtaggggaactttgctagcaaaggccctaaagcagaagcattctcatgtgttttaaaaagcaaggatgccaatgtttctagagaaaactcacaaaactttgggcaaggaggaaatgagaggaataatggcagagatgtaaatggaggcaccaaatgatgtaaaagcctcacaggcctttgaagcactttgggtttcactctgagtaaaataaagagcttttggaaggttttaagcagaagagtaccatgacagaacttaaattctgaaaagtcccattagccatatgttgacaatggattgtggagtgttagggtagaatgtgggagaccaggcaggagatggtgatgtggttaaacggtagcaactgagatgtcaaataaaaatggttatgttactgattgattttgaaagtagtgccaacaagtttattaacaaattggaagtggactgtgaaagaaagaatggagttgaggataaacacattatctgctgctacgtagcaagatttattaacttaaaaaaaaacatttttgtcatattcagcgatgtgggctgagttcagtcaaatagttctgctctgtgtgtcccagattgctttggcactaacagagtgaaacaggagagttccctgtttcccccccggcaggatgtgacagggtgtgtctccttctgtctgttcagccaccgtatgtgtgcactcaaaccccttaagggagggggagcatgcaaacaggcaggtgcagaagccaaagcaagcacccctggtctctggccccaggccagcatccagggaagggagctgagactcccaaagcccaagtggacatgtgttacagtgcactcctttagccttgccatctgaagacagcttaagtgttaactagctcagtaccctcttggtacccgggtccttgtccagcatccaggaagaatcaggtcacacacagacttgaaagatgaatgcggggttttgttgagtcctggaggtggctctcagtgggatggatggggagatggaagggggatggagtgggaagatgatcttcccctggagtttggccacccagcggccaatctcctttccaactgtccccagccaaactcctcttggtgtacggacacttcttctcttctctctgctgcaccgttctgcctttcttctgctcttctgtttgtcctctcatctccccctggagctggtggtttggagtttacatgggtacaggatagggggcgttgcaggccaaaaggcaaatttgggcatgaaaacaggaatgccttttctcatttagggccacgggtttccaggcttaagggtgggcccttcgctggggaaccaccttcttcgacccagtactcccgtgtgttctgtccatatcaacagcatgtaaggttggaagctgaggttggcaggaatggctgtggtggctgagcctttttcttcacatagtctctccctggggccagcttaggttttatcacattatggtagtctcaaagcagttagagtttgtatatgatgactgacttcaagagagaggaagaagctgtttgtactcttcaaacctggattgcaagttccagaatgtcccatctgccacatcacattctttgtataagagcaagtcacaaggaaatagattccacctcttgatgggtgaggggaagaaactgatgatagccagactgtctaccagagatgtctccaaggtttttggaccaagcaactggacatatgaagttgcagttaagtgtgatgggaaagactgacagaagttagagtaggccaaggtgggtggtgagtaaagatatcatataggcaattgaatatctaatctggagttcaggggagagatctggactgaatgtgcctatttgtgagtcatcagtatatagatggtattcaaagccacaagactgggtgagaacagaaaggggataagaaaagatagaaaagagaagaattccaaggactgagctctacaacactctcaaatttgaagtcaagaaccagcaaaggtgactgggaggaagcaactagtgaggtagttaggctgggtggtatgaaactcagggaagaagatgtttcaagaagaattaatcaattgggtcaactgctcttcaaagttcatgttaactaataattcatcattgaacttagcattgtggagaccattcgagacattgacaaaaacaaacaagactttgaatccatcgggtttggtgttatggcttgatcctgcacaattatctcagagagcattccaggaggggatgtagaattataaacctacatcagtataagatagatacagctctatagagtgggagggattctaatgtgaagccaaaatgcagccttgccagtcacttggagcttccaacacaatccaggagtagataatattcaataatccaggtaggtgactggtatcacacaattttgtcaacctgtggcagtttaaataattacattctaaaattaagtgccaagatttaatgccttcagagaacaagggtccaggggagggtgggaaagcttggttagagaggggctgtggttaccaaaacaaaaactcagacaagaaattaaccagccagaccagtatgtgactgggaagagggaagaaacacagctaagcaaaacacacgtaaaaatgagttgtagttcaccaagtctatgtcagacattagctatgacttggtctgaatgagtttcaaatgttttattaagagaaaggatcagagatggtgaggttgaagctgggacctgatgggtatgagactgtggggcacaggtgaagagtatggaatggatggggggcagcagggagatacatggaaggacacacaagtcagctgctcctcccaacctactaggccagggccttgaaaatacatagatcatgtcatttagcaccatttacactctgcacaacttattaggatgggcgatcaaaagactacagagtattgactcttatatcttcatcttaaagtggagtaaaagataaatggcatcggcattctgcaaagagcaggactgaggatgaagatctgaaactggataactctgactgattacctccttccccaggctgcactcttgacagaaggcacagtttctctgtaggatttaacagccattagcaagcaactaagacaattgaaagagacagctgagcagccacatgctagtttttcttaaatttacttccctttacaagtctggaactgagatgagcaaatcttgctacatgaaaataattaagtttgaaagtatttcttttcagaaaatcatttttcttaatagaaacatctgcagaattgtgtggactcccttccagtgtgaggagcagtaaagttaatcctgtaatcatattggagaaaggatgagaccccactctttaccctaaccaaatatcttccagcaccatcctcactgctgcccccaaagctgttggagcatttcaattatcctaggagaatctgccagtggttaatgatctttcttgccaggaggttctttatccttcacctccattcctgttgctacagttcattcctccctgtagaattatgaaagaacattacagtccatccgagggagatgagccctgcagccttaatttccaatgtggcaaaagtcatgagtctgagtgtcagaactgccacagagattcttggttgataccacagccatccattaacctgtccctggagttagcagcccagatggtggtaactgcaaatgaaacttaccaaggggcttgatgatagccctaagcagagatttcagttgcagagatttcagttgagcatgaaagcctttgaaaaagatatcacaggaaatagaggggaaagctgcattttactccagagaaattgattctatataggaaaatcccataggaatgaaggagcctggctgtctcctcaaccttgtaggtaaatatgatgttcttctaatgatcaacaaataaagtattagaaaatagtataaatattctaaaatattaagactcaatgtcttaatcagactgcctgagttatcaccctgctctatgtcttcctagctctaagagcctgagaaagtttactgattcctttttatctctgtttttgtcatttataaaatagacatgataatgatgtcaacttcacaagaaagttatgaggattaaatatgtgaaaatgcttaaaatagagtgtcaaattctaaatattggctgtcatacatggggcattaaatatacattattatttgtacattggtttatggactatatgtctggaaatctaagttgtactgtggattttataccttttcattacttttgtagccttgagcaaatttctgtaccttccattagcacaagttggtaaatacgtatttggacataatgcttttcatttttcttcttattcctgtggcagacataggttaattacaggcccttacaccctgaggcctaagtaggctttagaattcatgtcaacatgatgttcccagcagccaccatcagtcagttgacatgaaaatcaaaactgatttgacctctcagctttagagctcacaagcttttaaaggaatgtttattcgcactttcagccacctcagactatcccatcacagtatcacccccactttgccaccaatttttcaatgttgataggacaccacaaatgtctgcatttgggataatctttgtgtattcatcataacactacacccttgtaagtagccacagctggagaagggatatggctggcacgagagtccactgtgagtacatgcttgaggtcagtatccaactatatcttgaccaaagaagctgactgacagggcatgctcagacttctttgcgcagatggaggtgaggaggtcagtgcctgtacagaccaaccagtgcttcttcccatgctatgctctaaggaagcttcctcctaataaatcttttgctctccacaacaaaaccctaataatgtgtctcctaggcatcttggcccaggccagccagcacagaagcctgggattgttttgtttagttttcaggttaggggacaagaataaccaagagaataagtaccaccgacagattctgatctttggtagatctcagaattcacctacagttatccatgaatatcctttccctattacataaagaagactctttctttattaaatctttaggcaataaatgaatttttaagaatactgataggattatgttatgttttaatatgcaaaatattctgtaagaagacacctaagaatcacttacaagtgcttatctttgatcagtcatcatctgttgctcccatttaaccatttaccttgtaacaaagcttttttaaatcagaatgccttggaatgattaaaatgtcatatggatgtgtttagattacaaatagttaaggatgagatataaactaaattttaaatatcaaaacaagatttctataattcttaagtatattaagttatttataaaatatcatgctaaattattgcataaacaacaagcaatcagttagctaaggaataacttaaaatagcctgggccaccatcatacccagtgtggggccagatagatgaaatatatggccagtgtagcatttattgtgttctttatcttttcttaagagtacagaacagtggctgtatagactttggagttagacctgtgactgaattcagactccgtcactttgctgtgtgtcttagttcgtttcctgctactatcacagagtaacactgactggatgatttataaaaaatgtaagttatttggctcacagttctagagactgagaagtccaaaatcaagaggcagtgtctagtgagggatttcttgttgcatcataatatggtggaaagcatcacatggtgaagaaacgcatgcacaaaacagagcgaaaaagcagatcaaatccacatctgcaataatgacataaatccattcatgagggtaaagtcctcatggcctaatcatctcttaaaggtctcactttttactaccatcacaatggcaattaaacttcaacgtgagttttagagaggacattcagataacagcactgtgtggctttaaacaaattactaggtttttctgaactttagttttcttatatactgttgtcaaaattccatgtgtgagagagcttggcagagtccctggcacatcgcaagctctgactcttgtgataattgttagactccctcgttgtttgcggaagtgtggtggggacagataggaatcagccacattgtttttttctacataaaatatttgcacccacattggtctttaaaactctttgaaatgcatatgaaaattcctttggagaaaaaaagtatgcagttaaaaaaaaagaagtcctgtattccctattaagagattaattcctaaagggtagacaaacaagatttcaaacatcactagatttggacactagctttggcctgtaaatcgactttagtggagaatgttaacacttctcaattcctactccttgctggcttgagtaaggcacacaggagccactttcagagataatcttctcttctttatttacttttatcctacagaacagattgaaagccagtggcatagatctaggcacaggttttctcagtcagtcaacatttggggagcatctgctatgtgttgggtgccatgccaggtacaggttaatgcaactgccagaacagatcttctgcccccttctgaactttgcttctacacatctaaggtcctgttagtgagcccaaataaatattcttcactccactcttttcttcttattcttcactatctctgggcgaacttattctctcttatgatttaatatactaattctgcattgataacatgactcctgaatctatttccagcccaaatgtctcacctgagctttgagcccacatttccatctgctgagtactgcatatcttctccaatatatcccaacctattccccaacctgaactctctatttctattaactggctatgaatgcaggaacaaggattcgaggactcagagattaaaaaaaaaaagtaataacaatgatggttaatatttattaaccatttatccactatttatttaagttatttagttatctaatgtgtgtagttatatatttatttctcacagtagctctttgagataggtctactattatttccattttgcaaatgaaataattgaggcacaaagagaagtcccttacttctccaaggccacacagccagaggtggtggagtcatgactggaattaggcaatctgattctagaacctgtacacttaagccctttggcacatccatcttaaatgtaggtcagggcttgggttgtcatagctaaaaagaacagatcagataatggtaagtagtatcactgcctggaaattttaactacaaaattctgtaaatataatgggtggatatttttataacatgctttggattcatgataaagctctagtctttcaaaagcttgtgaaattatttctgcaaaaacacacatatgccgaagcacaagagaaaaagcaggatgcgggaaagcaaaatgccaatgcacaggggaaaaagcaagatgccacccagacagtgagcaatttgctcagcttggctggagcgtggagtctgtagactgaagtcatagaagacaaaggctgagaaggtacactggaacctgattgtgaatgaacttttagttatattaatactataaatatagtaataaagttatattggattgtactctgtaggcaaaacatgggactagaagttggggagcaaggcagggaaggttcatctaacacaatcattactgagagcctccagtgaagtaggcatgattctaggtacttgaaatacagtttgtttgtacctccaaggagtgtgcagtcttagggggagcttggcaattacactggaaatttttaattcaccacggttaagtgttacagagtgctatgaaaatagttatgaagtaccactaacaaacccattgtgccttataagaaaatacttcctggaaacatgcagagatttgtaacgaggagaattacatgattatatttgtattttagaaatttaattctgttagtagatatggcaacaccaaagaaatactgaagaaggaaggtcattgaagagattaatggatcatataaaagttgatgatcacttgaactgtgaaaataagaattgagaggcaagtacagaatcaagaggacttttggcaacagcaacaacagaactagaaatgttgttggaaaggagttcatgagaatgattccagtctttctttttagtttggtcacctaagtggctgagttttccaagttagggaaaaacaaggaagagcaaaataagcgaggaagggccgggtgcgctggctcacgcctgtaatcccagcactttgggaggccgaggcaggcggatcacgaggtcaggagatcgagaccatcctggctaacacggtgaaaccccgtctctactaaaaatacaaaaaattaaccaggcgtggtggcaggcacctgtagtcccagctactcgggaggctgaggcaggagaatggcgtgaacccggaaggtggagtttgcagtgagccgagatcacgccactgcactccagcctgcctgggcaacagagcaagactctgtctcaaaaataaataaataaataaaataagggaggaagacagtaaatttagtttgagatatgttagcttagaggcatctacaattagagatatttcgtgggcagctatagccacctatcataaatagaatgatgccagagatgtaagttttggaatttccaacatctgaatccaggtgagctttctcaatagagcatagaagtataaagacagacaatctgacagtaccttgaggcacatgtaaacaaagcaaaacaaataaaatagatgacacatgaactttagagtcagaatgtctgaattcaaatcccagctcaaccacttatgagctttgtgattttggacaaggtacttcatatcttttggtctcagtttcctcatctataaaatgagaactacctcagattgtatcatgacgtttaaataaattagtgtttataaagaatgttgaataatacctggccttcagtaaatacaatttagtttttattaaataaaaagtattataattcatttagctccaaatattgaccttcattctgtgttctattttatttctccactatgtcttactcttctgaaggctgtcgtttgtttatcttattctactcctaattctagtgggtcctgaatgaagtattattaaattcactacctatttcacatgaaaagtaaatcttaggaaagataaaaaaaattcctttcttcatgaaacaattaccttgtaaaaaaatcttagaaaagttctctctaggcatatcacaatgtaatgatccgtttctacagattaaattgataaataattttctacaaaggaatattcctcctagcagtttccttcttttacttttttttcatttttcaggaccaacactactaaaatgatctattcatacatttcaagcagtttcagactttagaattaacctgtttctggtatggtcgtgaccatcaggatccactctgccaggaacagtgctagatgctctaaatagaaaatctcatattcttccccaaactccttgagttggctatgatgtttgctatataattgagaaaaatgaggttattcagagtccctgaatcataccaagcctagagaagctgcctcaatatagtgaacaacagctaagcagttggtttcaaagcagagcatcattcaacacgggccagttgtctctccactctacagtgtgtcatcatcattttgaggatgagacaaaaggtagagtggcctgatgggggcacccaccaagatttcctgccctattatttcaccacagaagacacttgggagtcctggtaccttggccttatcatctatggcttggaggaaccaatgaccaataatctttttttctttcagctcagttcatgaaccatcggcaacattctcccctctagacccatcatcagaagacttaacacaaaactgttggaagtctcttgtctaaacagagtacaggtttaatattcttaccagtcttaatgagactctaagttcagttttttttaattgaataacattgttcagaggatatgtcatagtgatggtgatgataagtattacctcagagatgggcttttccctgtaaaatgaaggcttcaagatcagctttaagaaggagttagattgagataaatgtaaatgataaatagatcatgcatgggaaaaaacagtattctggtatagatatataatgctaagtgtaccaaagcaaagccaaatcagatgtgtctggacaatacttagtttttctggaatgaagtgtttattgtttagttagagaagcagtaaagaatgacatggaaaactggtgagggcatgtttgtgaagatcttaaaagtttgggtaccatcttcttatgattaatgaaatcaagaaaggtggtaacacaaaaacatttcaggtgaatatgttagtaggatcagaggttgaaatggtgatgtagagaaggaattcaaattattctgaatttctaaatctaggaaaataaataacttgatatgtattaaaagtaaagaaagcctattttaggaggttgtttccaattccttccaacaaaataatatctcacacactggcatactttttctataaaggccacatagcaaatattttaggattttggacatgcagtctgctctgccacaactactcaacttgttgccgtagcacaaagcagccttaaacaatatgtaaatgaagtcacatggctctgtttcagtaagctttatttacggacactgaagtttgaatttcatgaattttcatgtgtcacaaaatattattactcttcttttgatattttccagctactttaaaatgtaaaaaccattcttagcttggggctatacacaatcagagggtgagcaggatttggccacagtttgcaaactcttggtttatagaacatcatcagaactttcaatccaacatcattttgaaaactttgaatttcttctgaagtcttctcttgagcatttggaaggagctggttgaagtgggcttgaagtggtaggagaaggggacaactattaataactagctagtcagacaaatcatactaaccacagggggcagtaggacaatatatgtccctgtatgctctaatccaacagttgcttgtctgaaaccttcaaaaaaaaagagagagagagagaaatcaatcaataaatactactgcaaacaaacacattctgaactcagtattttgataattgcagagggaaaatcaaaagtggtgggctttgcttttattcaagttgcttatgccaccctaaagtggtgcaatgcagtacttgcccaaaggaagtgagtggcagcattgatggaagcttagtgtgagagcagtgtgtaaagttgaagtgactttgaacaaagaatttcggagagactaactaggctggggtaactaatgaaaaccaggctgggaatggaatgcagagggggacatgagagtcccaaaggaaaaattgatgggacttgctaactaatgagacatggaggctgaaaaaagagagaggagaaagatataaaacctttcaaaagattctcattatattattcagtgccactaagaatcacataccagtgagaggcaagggggacgatgtagtgtatagaaaatggggaacataggaagctggagagtagcacttcaaacaagcaaatcacacacatacactaatgtctgataaatgtcaggctgaaattattggcaaatacagagagaagggatcccattaatgcccacatgctatctttatttcaagtattatcaggtggaaaataaagtagtaccattatcgtgttgatggtctaaatatgtgaacaatctcctgcatcatattatgtagaatccccctcatttcttcaaggcaatttccttttgatcacttggcactggtcatgtcttataaagcaaatatatccaaacatttttcgttgcttcagcttttccctccctagttctgtttgcttatgtagatcacaaatgtatgagaaaaacaaacacaataaggcaattaatgtacctacagttagagatgtgaataatattggaattcagaaaaggaaaggttacataaataaacctctccaaactcttagcaccaactattggttttatctgcttctaccctacctagagctgtccaaagggattgctaaggcacttgcttcctaaaaatcccttttctgccattatgattcacccaaagcagcatggtatatggcggagatgcatgtcagctctgcctataaatgcaccaaggcatatttctcataagcacatttttgcctacacagaatgaaatagagacaaaaaagtaattagtgccttcgttgtttggactcacatttataaaaataaatgtttagcctaattctaagatagtcatttcaactgtctttcttaaaaatcttaaacaccaggatttagttaaaaatatcttcagttcgcctacatttcacccttaattgtatcttaagaaacctataatgaaactagcgtggccaaaatacacttaccaacaggtttccttaattattatctaggaactatttagaagtggatgctttcctgatttacttacatgttgtaaaaaaaatggaaagttaatttatgaaattagaaaagtagctgaaagtaagcctagcccattttataatgagaaaaataaaacacagaatatgttttaaagtggctttctcaaatgaaccacaaccttcaggattagactttccctttgagatattgaggtacagaaaataccaagtttttagaagcacaaaggaggctgaaggacccaaatttgtgagctgacactaccccaccctaaggggtgttaagaccaataaataactatatatggtatgctgcttctctcttctgagtaaatcagttattcaactaacatgtaacaagcacattataaattatttcactattacaacaaccacaaatagatatatagaaacgtctacaaacaaattaccatgtataaagaaaatgagtagatacagagagtgcaatcagaattagattaatactatgatcatcttaatatatcagttaaatgttatgtcctcattccaagactctcattttatttagcttctgcattaatccagctgcaaattgaattagtccagattaggtcttagtatattatttatagctttttactggtgctacattatgcattttcatccaaacaagtataataattttgtcaggttcatgtaaaagcaatttttgaatatacagcaaatttttatattaaaagaaaattttcatattttttcatagacttgaatcaaaggaacctttcctgtctgttgggtaagtatatatttaaatactttaagtattaattatttaattcaaatttccaagaacttctgagatggtattttcagtcatttaacatcatattcaaaatcataacatatcagtgcatgcaacattgctatctatgttttataaagacttaactaaaatgctccctaggttgtattgtgacctcagaaatgcagctaatgaatgtatatgaaatcctgtatcttccataaaggctaaacaaggtacacagtgatcatccatattctcttcatgtaaaaatatactcagattggttttaaaaattcctctgagccatagctccaccattccaagcctgtctacccattgccattctccatttcttttcaatctactctattcactgtttcgtcacccacttccctaagtctgtcttcacaatcaatatctatcttttctccttatctctcatttcactttaatttctccagttcactcacattgactgcttctttgcacccaaagctgaggaaccctgaggcaaatttagataagacgaacgcttgcctgctctgatggtatccttcttagtcacaatacatatctttaagaataatatattgttggccaggcgcggtggttcatgcctgtaatcctagcatttttgggaggtgggcggatcacctgagggcaggagctcaagaccggcctggccaacatggtgaaactctgtctctattaaaaatacaaaaattagctgggcatggtggcacacacctgtaatcccagctacttgggaggctgaggcaggagaattgcctgaacctgggaggcagaagttgcagtgagccaagatcacaccactgcactccactccagcctgggtgacagagcaagactctgtcccaaaaagtaatagtaataaaataataacaataatatgtttttgacatgagtgcacatgttctatttttaggcatttcaaactaagaataagcaatgttgtttgtatctgatcaaatactcctttgactaacatattaaagtgtattatgaaaggacttttgcactttcaatattatagatgatattgtatgaaaaagttgtgaaaaatgcaatgtcttgcctagagaaatcatgctatatttgatgagggaaaaaaagctgtcatatataggcagccacaatactgatgcttaatgaccagaaacatggaatggggttagatttttaagtgaccagatcaattttcttttattactttgtacatggtcattgaatatttctatcaatcactcattcaacaacatggttcccaattcctttctactcttcataaaagcttttcagaaagccactcaaatcatggaaatcaaaataattattaggggatgtggaagacaaaaaatggaatatatgcatttatttgaagactacatggaaaatgaaaggtcgagttggtctggcccaaaaaaagtgataaagcatgcttttttccctacattgatcatcagctcctattgttaaaaatctctacacctgaagaaatcttttagtttgaatgcatgtgtatttgccctcaagtcaaaaggcctgaaatagcttctcttcacgcctcacttcatgtagtttctgtgcagcctttactgttctcctggctattatgagatggaattccttttttattgcatacttctgttttaaaaggcagaccctaagtaatctttgttttaaatttatcaacagtttagcactgattattagaaccctgagaaaatctctccaaaaaaaaaaaaaaatactgtatcgctcagccaatgctcaaagtgggaaaattagcatggcacacataagatactgcttatgtcttaaaagtaaagtggtgtgaaaggcaacccaaatgattctgctgaatggatattttaatttatagctaaatgtttctgttccctcaagaaaattattttaaataagattgtccaaaagtatgtatgctaaggtgggcgactcacttgagttcaggagttcgagaccaggctggacaacatggtgaaacatcatctctacaaaaaattacaaaaattagctggccgtggtgccgtgcctctagtcctagccacctggggggctgaggcgggaggatcatttgagcccagcaggtccgggctacaatgaaccgagatcgcaccacttcaccccagcgtaggcaacaaagtgagaccctgtctcaaaaaaataaaagcatgtatgtagctctctgctgcctttttcagtgagaagatgtaagttctttagtggtgattggtgagattttggtgcgcccatcacccaagcagtatacactgcatcatatttgtggtcttttagccctcacccccctcccaaccttcccacccaaccaagtccccaaagtccattgtatcattcttatgcttttccatcctcatagcttagctcccacttatcagtgaacacatacgatgtttggttttccattcctgagttacttcacttagaataatagtctccagtctcatccaggttactgcaaacgccgttaatttgtttctttttatggctgattagtattccatcatataaatatacaccacaatttctttatccactctttgattgttgggcatttgggttggttctatgattttgcaattgcgaattctgctgctataaacatgcatgtgcaagtatctttttcatataatgacttcttttcctctgggtggatacccagagtgggattgctggatcaaatggtagttctactattagttctttaaagaatctttacactgttttctatagtggttgtactagtttacattcccaccagcagtgtagaagtgttccctattcactgcatccactccaccatctactgttttttgattttttgattatggccatttttgcagaagtaagctagtattgcattatggttttgatttgcatttgcctgatcattagtgatgttaagcattttttcatatgtttcttggccatttgtatatcttcatttgagtactatctattcatgtaattaacccactttttgatgggatgtttgtgtttttcttactgatttgattgagttcattgtagattctggatattagtcctttgttagatgtatagattgtgaagattttctcccactctgtgggttgtctgttcactctcttctttttgccatgcaaaagctctttagtttaattaagtctcaactatttatctttgtttttattgaatttgcttgcgggttcttggtcatgaaatctaggccaatgtctagaagcatttttccaatgttatcttctagaatgtttatagtttcaggtctcagatttaagtctttaatccttcttgagttgatttatgtataagacgagagatgaggatccagtttcattctcctacatgtggcttgccaattatcccagtactatttgttgaatagggtgtccttttcccactttatgtttttgtttgctttgtcgaagatcatttggctgttaagtatttgggtttatttctgggttctcttctctgttccattggtctatgtgcctatttttataccagtaccacaccgttttggtgactatgtccttgtaatatagtgtgaaatcaggtagtgtgatgcctccagatttgttctttttgcttagtcttgttttggctatacgggctcttttttggttccatatgaattttagaattgttttttctaattctgtaaagaatgatagtggtattttgattgggattgcattgaatttgtagattgcttttggcagtgtggtcattttcacaatattgattctacccatccatgaacatggcaagtatttccatttgtttgtgtcatctgtgatttctttcagcagtgttttgtagttttccttgtagaggtcttttgactccttggttaggtatattcctaagtattttaaatttttttgcagccatcgtaaagtggattgcgttttttatttgattcttagcttggtcactgttggtgtgtagcagaactactgatttgtgtacattaatcttgtacccagaaactttgctgaattcttttatccattctaggagctttctggaggagtctctagggttttcaaggaaaacaatcatattgttagtaaacagtgacagttttacttcctctttatcaatttagatgccctttatttctttttcttgtctagttgctctggctaggacttccagtgctatgtgaagaggagtggtgagagtgggcatccttgttttgttccagttttcagagggaatgctttcaacttttccccattcagtattatgttggctgtgggtttttcatagatggcttttattacattgagggatgagagttttaaccataaaaggatgctggattttgtcagatgctttttctgcatctattgaggttatcatgtgatttttatttttaattctatttatgtggtatatcacatttattgacttgcatatgttaaaccatccctgcatccctggtatgaaacttacttgatcatggtgggttatctttttgatatgttgttggatttggttagctagtattttgttaaggattttagcatctatgtttatcaaggatattggtctgtagttttcttttttggttatgtcctttcctggttttggtattagggtgatgctggctgcatagaataaattagggagggtttcttctttctctatcttgtggaatagcatcaaaagataggtaccaattcttctttgaatgtctggtagaattctgctgtgaatccatctggtcctggacatttttttgttggtaatttttaaattaccatttcaatctccctgcttgttgttggtctgttcagggtatctaattcttcctgatttaagccaagaggattgtattttttcaggaatttatccatctgttctaggttttctagtttatgtgcataaaggtgttcacagtagccttaaatgatctttcgtatttcagtggtgtcagttataatacctcctgtttcgtttcttaatgaggttatttggattttctctcttcttttcttggttaattttgctaatggtctatcagttgtatttatcttttcaaagaaccagctttttgtttcatttatcttttgtattatttctttttgtttcaatttcatttagttctgctctgatcttggttatttcctttcttttactgggtttggttttggtttgttcttgtttctctagttccttgagatgtgaccttagaatgttagtttgtactttttcagtctttctgatgtaggcatttagggctatgaactttcctcttagcaccacctttactgtatcccagaggttttgataggttgtgtcattattgtcgttcagttcaaagaatttttaaatttccatcttaattttgtttttgactcaatgcccattccagagcagcctatttaatttcaatgtatttgcaaggttttgaagattcctttttgagttgatttccacttttattccactgtggtctgagaggtgcttgatataatttcaattttcctaaatttattgaggctcattttatggcctattgtatggcctatgttttagaaagtcccatgcactcttgaatagaatgtgtgtattctacagttgttggatgaaatgttctgtatatatctgttaagaccatttgttccaaggtaaactttaaatccattgtttctttgttgactttctgtcttgatgacctgtctagtgctgtcagtggagtattgaagttccccactattattgtgttgctgtctatcacatttcttaggtctattagtaattgttttataaatttggaagctccagtgttaggtgcatatatgtttaggattgtgatattttcctgttggacaaggtattttaccattatataatgtccctctttgtctcttttaactgctgttactttaaagtttttgttttgtctgatataagaatagttatccctgttcacttttggtgtccatttgcataaaatgcctttttccacccctttactttaagtttatgtgagtccttacgtattaggtgagtctcctgaaggcagcagagagttgattggtgagttcttatccattctgcagttctgtatcttttaagcaaagcatttaggccatttatattcaatgtttagtattgagatgtgaggtaccgttgcattcatcatgctatttgttgcctgcgtaccttggttttgttttttgtttttttttctttttaacttatacttttgttttctaggtcctgtgtgatttatgctttaaagaggttctgttttgatgcgtttccaggatttgtttcaagatttagagctccttttagcaattcttatagtggtggtttggtactggcaaactctctcagcatttgtttgtctgagaaagatggtatgtttcctttatatatgatgcttagtttcgctggatacaaaattcttgaatgataattgttttgtttaaagaggctgaagataggaccccaatcccttctagtttgtagggtttctgctgagaaatctgctgttaatctgataggttttcctttgtaggttacctggtgcttctgtctcacatctcttaagattctttccttcatcttaactttagataacttgatgacagtgtgcctaggtgatgatattgttgtgatgaacttcccaggtgttctttgtgcttcttgtatttagatgtctagttctctagcaaggccagggaagttttcctcgatttttcccccaaatatgttttccatacttttagatttctcttcttcctcaggaataccgattattcttaggtttggtcatttaatataaccccagacttcttagaggctttgttcatattttcttattctttattatttgtcatggttggattggtttaatttgaaggccttgtctttgaacttcaaatttctttcttctacttgttcatttctattgctgagactttccagagcattttgcatttctgtgtgtccagtgtttcctgaattttttattatttgtttctttatgtatttccttgaatatttctcccttcactttttttggacttccttgcattgggctttgcctttctctggtgcctccctgattagcttaataactaacctcctgaaccctttttcaggtaaatcggggatttcttcttggtttggatccattgctggtgaactagtgtgatttttgggggtgtttaagagcctgttttgtcatattaccagagttggttttctggttccctttcatttgggtaggcgctgtcagagggaaggtctagggctgaaggctgttgtccagattcttttgtcccacagggagttctcttgatgtagtactctccacatttccctgttgatgtggattcctgtgagccgaactacactgattgttgtccctcttctgggtctagccacccagcaagtccacccagctccagtctggtactgggggttgtctgcagagtcctgtgatgaaatggactctgtcagggttctcagctttggtggtttaatgctctatttttgtgcgggttggccttctgctgggaggtggcactttccagggagcatcagctgtggtagtatggagaggaaccaatggtgggtggggccctagaactcccaagattatatgccctttgtcttcagctaccagggtgagtagggcaggaccatcaggtgggggcagggctaggcatgtccgagctcaggctctccttcgatgggtcttgctgtggctgctgtgggggacggagatgaggttcccaggtcaagaaggattgtggctgcctcttctgcatcatgaaggttgtcagagaagtgggagaaaactggcagtcacagggcttaaccagctcccatgcaaaccaaagggcaggtctcactcccaccatgcccccgctaacagccccaagttggtttgcaggcagtgggtgagccaggcttgagaacttgccccaggctacctgtctcccagctgcgaaagaaaaaggtttggttcttccccagcctgtggagtctgcacactggattcccgctctcccttgaattttggctaggaggcttcttgcccctttcaagttgttacaaaattcagctggagatttccttctgcctgtggtatttttcccccgctcctctggccaccctcctgatggatccctgtggtgccaggcaggaatggcctgcttgaagacccagcgagctcccggggcttttcccactgcttcctctatccctgtatttcactcagctcttgaaattgactcagctccagataaggtcggaaacttttctgccacaaacagaccttcagtttctccagtcgggggtgtgtgtttgggagaggaggatctccctttcccacttctgcagttggggcactcagtatttgggatgtctcctgggtcctgcaggagcactctgcctccttcagagggtctgtgggtcctcttgggattgctggttcattcttgcagttgatctggagctaaaattcaccatgcgagcctctgcacgctgctctgtctgtccaagtgggaactgcagtctagtcctgcctcccattcctctgtgatgatcaaatttatgacttttaatccatagtcacatgtcagaataagtgcatggtatatggtttattacatcagttgacatgtgagtatgtaacattgaatttgtccacagcacacctcactcacattaattttaattctatgttcaataaaaatgtgtgaattatattaatgaataaatcactgctaaatattgcatacttcagtccactgcctgtcagtgtcttaaagtatttgttaatatgcactggtgaaagttgctttcaccctcataggcttggacacttacaagctagatgtgttagtttaggcaattactttttttttaatactttaagttctagggtacatgtgcacaacgtgcaggtttgttacatatgtatacatgtgccatgttggtgtgctgcacctattaacttgtcatttacaggaggtgtatctcctaatgctacccctccccccaccccacgacaggccccagtgtgtgatgttccccttcctgtgcctaagtgttctcattgttcaattcccacctatgagtgagaacatgcagtgcttggttttttatccttgcgatagtttgctgagaatgatggtttccagcttcatccatctccccacttaaactcccaagcttcaggttcttgtttgtgaaatggagattaaaagatttagataataatttatatcaaacatttagcacactttttgacacataagaattgctcataaatgttagctatcattacaattctggaaggtatatttatgtatcatgttctaaagagtcaatcagaaagctttaaaataataaatctccatttttataggcagtgctttgagttacattataaaaagcaaaagaagtttcattataaaaaccaacagaagttattataatggggaaagataaaaattgtcatgaaatgagttatcaagcaatatgagtacagatgtttcagattttaatgatgaatactagtaattgtcatttagattttaatgatgaatactagtaattgtcatttaaattttttaagtagaaatattgatacatttttaatatgcatctcatcttaatataaattggtgaaccaaattcttccctggataaatgtgctgtactaattttgaaataaaattgtttggtcacaacatagacccaatctgaatattgcagtggaaaaaaaaactgtcaaagaaagttacaagaagttatttccttactgagaaagagcatggagttgtgaaaagaagttgagtgaaatctcaggtctctgatctgcaactatatatatgatataaaaagaactttcttcatatgcaccaggaaatgacttctaaaataatgtcattgaggggggaaaaaagacctgttacttctttgttcatttaatgtagtttccctctaatacacctagagtgaggcatgaaagctcatcccaagtgtgattctgtttgcacaggtagatcaacagatgcagtgttttccaacgctacctaggtgattctgataccagtggggcctgggagccatcatctacaaggtgctttcatccacctccattgttttccatacacacatgcacaggttgtcattgtaaacacttaccatctctggagtcccttcagaaaatcttcgaaatgtaatgtccacaatccctccctgttttaaatgcatgtggtggaggcagccacattgaactagaactatcttggagttcactccacagagaccaggatagatgcaaagagcccagaatatatgccatggaagcctccacactgcctatgcagaagtacatataaattcattctgatgtcatcttagacctaaggctgggatcataataaattttaaacttcaaaatattaaataatataatttcaatatttaataaatgtctattttttaaatattaatattttctattttaaactattataagtatttatatatttactatttatatatttattaaatatatttaaatttattataaatacataatactgaatgtttatattattataaataaaatatatttataaaatacatttgaacattaaaattcttgcccatcttaacattttttaagatgttaagcaaccttgttttttaatggagggcttaagtttgggggctcatattccaatcatccttgaaacattatatttttttagagcaattaacataataaaattctgctaggagaatgcttcctttcaatgctgcatcagatatactctgatcttggaaataagctgagagaaaacaggcatcaagtttgcatttagaaaggtgaataaggccaggcgcggtggctcatgcctggaatcccagcactttgggaggccgagcaggcagatcacgaggtcaggagatccagaccatcctggccaacatggtgaaaccccagctctactaaaaatacaaaaattagctggacgtggtggtgtacacctgtaatcctagctactcgggaggttgaggcagcagaatcatctgaaccggggagtcagaggttgcagtgagccgggatcatgccactgcactccagcctggcaacagagagagactctgtctcaaaaaaaaaaaaaaaaaaaagaaaaaaagaaaagaaaggtgaataagcacagagtgatcatcaagattctaatatataaatcttagtttaaaaccagtcttgccttgaaaaagttattacaactttttaatgaaaacacaaatgagaaggaatcaaagatccttcatttgaagactgagatttccattttaaggttacatgtcaaaaaatgcatgaagtttcttcaagcactgactgttgataccttgcagacactgagccactttgagcatacactcacagcaccaaaggaaactttccacatgaattatttcttcttcttcagcatgaagttgaacttttaaagaagactttaatatgaattagttgtattttgaaattaaatatcgatttataccaatttttcatttgatgaattttttcataagtagctttatatgaggatgcttattacattggttaaaaaaaacttcagattttgttcactgtatcagaataatttaactaagtcagaacaatttaaaagttatattgacttatctcacaatatattatttcccaggtttggttggaagatcttcaagaatacatcactggggcaggggcgggggtatggttaatggatacaaaaaaaattagaaagaatgaataagacctatttgattgcacaacagggtgactatagtcaataataacataattgtacatcttaagtaactataagagtgtaattggattgtttgtttgtaacacaaagcgtaaatgcttgggagaatggataccgcattctccctgatgtgattattacacattgcgtacctgtgtgaaaatatctcatgtaccccacaaatatatatgcctactatgcacccactaaagttaacattagaaaattttaaaattataaaaagaaataaaaagaatacatcaatgataaaaatatcagaattattttattatatttatctctattgaagcactatgtgtgagctaagcatggaccagccaagcctggatcgcctaagtcctttgagatgcacgggatctattctactaaatccaaacaagagagagtaaatactttcagggcaacaaggcttgccctgcatccaaaaatgaccttataattgctaacagctgtagttcacgaacccattttccttgaggtttattttctcccttttctttccagtcttgaagtagaatttagatcttcaatatacttctgctgttatgaaaactttattaaaccttgatgttcttattaggttaaagactcacactattttacatttatccaggttttgtaggaaacctcatatttagtaacagatgctatatattattatagtattagccacttgctttaagagcccaagttctgtgatttgatttccttcctctgaatcctattctgtcacttcctagacagatggctttagcaatttgtttaactttcctgagtctccatttgctcacttaaggtagtaactaatcttttattattattattattattattattattattaatttcttttgagacagggtcttactccatctcccaggttggagtgcagtggtgcaatcacagtcactgcagcctcaacctcccaggcccaagtgatcctccctcctcagcttcccaagtagctggaactataggcatgagccaccacacctggctaattcttatcttttctagaaacggggggtctcactgtgttggacaggctggtcttaaactcctgatttctagcaatcttcccacctcatcctccaaaagtgctgggattacaagcatgagccatcatactgggtcataactaactcttaacagctgttatgaatgtgataatacttagtgtctgacacatcgtaaacaggaaataaatatcaattattaaaaacattctttgcagcaattaagttgtaaatcttttctaaagtttcactgaatcgcagaaatgttaaccaattgaatccaaaggactgaatattttagaagtgttaagagaatccaattctcagttcagaagagagtgaaatcagcacaggagtgacagactgccttactagggaagatcactgaggaagagagacaagaaaaaaagcaaaacagcagcctgaagacaggaagacaattccaggctgtacttagagtgatataaaatatggagtacaatattgaaaactttaataataggaacatgaaagagggaaagcaatactgatttaaggatggttggtagcagaacacataaaagcaaaagcagatttatattaatgccatcaaatgatagctgtctatcaagcatttaggaattgagaagttaaagaaactggtcagattattaggaaaatttccaagacaaaagtaggacctgagtttttcttcaaggtgaggtaagaattcaataaggagctattaaaatggcattcctgggagacaaagttggatgagtagcagcagagaaggcaccataccccacgtatcagacattccagtctagtgagctaggaagattcaggaaaagacaaaagataagattggcaaattcagggagaatctgtattgagaaattatcctaatacaaggagctttctgctcattctgtgggtgaagtggagccattcaatgatgtatacctgcttggctgttttgctttcaactgaagagtgatattatccaaagtgagccacttataaagcagttgcagaagttcaggcatgacttgaaaagatgcaggacttgaatagaatgaaataagaatgtaaagaaaatgcctgatgaaatagcattttctttaagaatgtcgaaatcagtgagtgagtggtgtcttaaagttttctcagttagacttgatgggatcatggtgacagcatgacaagctaaaatccatgcgtagtgttgaaactaagggaaggttaacaagaaattgtccccaagctttaaatatgcccatctaacatcacggaattactaatggccaattcaatgcctgtcttttgatgatgtggtttcaattttctctatgtctgcagggaaaaagggataaggagacaaagccaattttcttctaaaaatctacttttttgcgttttttttaagactcagacagtgctaccacaaaattaatgatttctttaccaactgcatttgcttcatttttttccccaaagccctccaggctacttctctggagagtacacaaagtttccacagcgctatttttgtaatctaaagcagttgtgctttcaggcctgatgctacaactgtaattttaatttatcaacctgccagtcagtgaaatgctgtaaaaacatgtgaaagcttaaacccatcatttatttctgcacctgtcaatgacacttttctgtacttgtcaaaatcatttaaactgcactatgatggcatatacaatatcaccagtaaattgggtaatcaatcatgtatgtgcatattttgacagtggcgtgttgaatgcatgggctcctgtatgcatttttaagaagtaggcactcattactgttcaatagtaaaatacagtagagtcatcaaaaagagtctccctcagtcttttacaattaaaaaaatgtcttaagaaacagaggggctgattgtgcctgaaatggcttttatttcttcagcaaaatgttctccttggggaaaaggaagcaattgcaggttatagcaggcagcaatatagtgttacatggagggaagaaaatgtataggatcattaaatagatttatttaagttctgcttataaagaaagcagtggtgcagtactttatagttgatgatatttcaaaagagtgttatcagcacttctaccactatctaatttgttcatataataaagtgtcacattaaacccaatatcacaattcatatcagttttacttcaaaaattggtatcatcatatatcatagggaaccctgccccaaaaaaattttgatgagatctttcatcacaataaattatagaatttaaaaaatcaatctattagagagtgagagagagagaacctgttcaatcattaaatccactcaacccagtaacaatttgatgtcatttaggctgtgtttctaagataaaatgttgttaaaattgtaacttaaatattctctaaataatctaactgtaccctctgaactcttggttgtagcaatcctcaccatttatttatttttaaaaagcaagtcttatgagaaaccctttaaaatctatgaaggatttatgaccacttcataacatgcaagtctaaattagccaaactaatttgtagacatcaaatatttctacataagaaaatgaatcagtaaacttgacatgcataagctctcactcatgggaaagaactaaccttaagtgatgtttcagaatcacatataaaacaaacaaagctttgggaggtgcattaatgtacacagccagcactgtttccttattgttaccagtactgttttcaaggaacatgaatttagttttgttttgtcttgtttttttaattttactctaagttctgggacacgtgtgctgaacatgcaggtgtgttgcataggtatacatgtgcgatgatagtttgcttcacctatcaacctgtcatctaggttttaagtcctgcatgcattaggtatttgtcctaatgctctccctcccctttccccttgccccctgacaggccctggtgtgtgatgttcccctccctgtgtccgtgtgttctcattggaacatgagttttttaaggtgtcaagccacattggaaagggtaatcatatagtcagactgttgaaagatatatttactgaatgtgtatatgaataaaatagaaatggtggctaagattagatgtcatatgtagaatcaatactgcacgaagagagttgttattgtttcaatttaaaaataagatcttagtctcatatacttttaatatcagtcctgaaaataatcactaaaaataatgcaaaataagtgctttgatttcactcggctaccttcaactcatctcaaagaaagctaattaagcttacttgaagagaactcatttctctttgttttagctccattaaatatactgaagactgaattttcaattaaataatacttgattatctaaataattttttggcagtttaaacagcatttatttcagacagttcaaagtattgactatcctttattttgtgttcttcaatgaatctttactgattctcataaagacaaaatagatatcatcattcatttaatgctgaataagtgagatacagagacatgatgatatctccataaataaacacagaatattggtagccattttggaatggagtccagtctgggacttttgcttacaaagctggcaacttcatgtatcttaacacctcatgttttcttctgagtttcatctgcacttgaatgtctaaataatagctttaattattcaggaaaataatcatgtatgtaaaaagttatttattgcttttagagctattgtgaatcccagatttgcactataaaagtgctagcaacagttttaaagcctcacttcccaatcacattctgttcatccagccaggagtgactgatctttattttatcaatctcaaaatgtgaccttttcaatgcttttaatgacattttcaaagtacagaaatgctttttgattcaaaaggattttctactttattctgcagaacaagtcagctatcatagtataatcaatagctgccaactattagcaaaagccacacatcacttatactttaagagcttatcaggaagaaaaaatgcattgagtggctatattttggcatgctaactaaggtagatattaaaatgaaaagtcaatcctcaaatgtttcatgtttttagaaatgttattatttccttagtaaaaatttcactagatcacattcaaaatataccattagaagctgctggccacattcaacttcaaaatgaaataatgtgcttgtagttttattcagtgttaggcaaccaactacagtttccccctagcttcaattaaaagcatataaaagatgaaacacttgttgagacatttcttccagatactggctaaattatcatatcatgcaagtggtatttcagttaagtgtatattatagcccaattggatactaaaagtcttgaaagcctttttaaaagtgaggttctctagagaagttattttaaagatgtgttctgtaaatcatgggcctttgattatccagcccatggcaggctaagcactccaaattcccatgtaaagccaccaagtcacaaattaagggattgcccaataaatcaaagcattcattcctaattaattttcttaagttgccaggttttcgtttgaagctcttgtgaaaggatttgatagcattgctgccctttctgtgaagaatagctgtctaatttcattaagtgcatcaattcaacatttgaagggcactgtgtatgtgcaaaatattatatgataataatgtcagttgctgttctaaactagcctgctagacagggatagtttcctactattgtgattaaaaattgagctttccttccatattacaaagataacaacaccaaatcatcattgatagggaatttagtaaaatatttagacatttattttggcaatgtaagatgaagagtagtatcaaaatcatttagacttaactaacaatatgtcttcaaaaattatgcaatgcacattgtttttaaaagcatcgttaattgcctaacagtacccgccaaactacaaatcaggggttaaaaacaggaagtagatcttatgatgccatttcattctaatcaagactttatttccagtatctttattgttatttttgaatatcaattcagttatatttagataaaatttattcagtgcaaaattccatttacgttatattggtagatgcaaagcaagatgcgaggtgcactgaactgctgcttcatctcatagtggattcagtaaagcagtgccaatcaatgaattgtttttaccatttcatttcagaaagtaggagtaagcattttaaaacgtgtagcatgtttatatgctatcgttatagcatgttatatgatatcaaaatgtatgattttgtacaaaagtatcagactgtgatagattggaaatattttaaataaaaaataaaaatttggttctttactgcaataagccaggaagccctagacaagactacatctttgcctttggggaggtagtaatctaatgaacaggacaaaacaaataatttggtgtctataatataaggcattgcttgggaattctaatctgctgaagaagataaaataaaaatgaacagacatctgtaacataagtcattccttgaagactcttgaaagagaggaaataaaaggctgcaggactagtggtacctaatggcacacaaagccaggtgggtttagtttctttttggagataggtagtagcaccatttttcttaaaagagacactggatgacgtgcctggaaaattaaacaatgactatatcaagggagactagaaagccctgaatatgttttaacttttcttcaacttccctctccctttctcacccctcccacctctgccttcttctcttactttctctctctcctccttgacacctctttattttcctctcactctccttcttttcttctctctttcctcttctcttcctttctcctcattctctccttgtcctacttcttccctctacttctttatctctctctattcctccttctttcagcttctctatattttttcttcatttaaaaaatgcatgccttctatcagaagagaatacctcaaaatattaagaggcatctgtgacaaacccactgccaacatcatattgaacagacaaaaactggaagcattccccctaacacctggaacaagacaagtatgcccactctgacactcccattcaacaaggtactagaaatgctagccagagcaatcagtcaagagaaaaaaatacaagtcatacatatgggaaaataaactatctctcttcacagatgacaagattttatacctagaatgccctaaagactccaccaaaaggctcctgcaactgatatgccacttcagtaaagtttcagcctacaaaatcagtgtacaaaaatcagtagcatttctatataccaataatgttcaatttgagaaccaaatcaagaatgtaatcccatttacaatagctgcaaaaaaaaaaataagtcagtaaacaaaggaatacatctaaccaagaaggtgagagatctctacaagaactacaaaacactgttcaaagaaatcatacatgacacaaacaaatggaaaaacattctatggctcatgaattggaaaaaatcaatatctttaaaatggccagactgcccaaagcaacctatagatccagcactattcctgtcaaactaccaacattatttttctcagaactagaaaaagctattttaaaattcaaaggaaaccaaaaaaagagcctgaatatccaaaacaatcctaagtaaaaagaacaaagccagaggcattacattacccaacttctaactacactataaggctacaataaccaaaacagcgtggtactggtacaaaaacagacaatagacccatggaacagaatggagaacctggaagtaaagccacacacctacagctatctgatctttgacaaagccaacaaaaataagcgatggggaatggacttcctattcaataaatggtgttgggatagctggctaaccatatgcagaagaatgaatctggacccctacctttcaccagatacaaaaattaactcaaattggattaaatatttaaatataagacctcaaactataagaatcttagaaaataccattctggacatcagccttcggaaagaattcatggctaagttctcaaaagcaatcacaatgaaaacaaaaattgagaagtggggcctaatgaaactcaagagcttctgcatgcaagagaaactatcaaggaagtaaacagacaacgtacagaatgggagcaaaatattcacaaactatatatctgacaaaatgctaatatccagaatctttaaggaacttaaatcatcaagcaaaaaaacaaccccattaaaaagaaggcaaaggacatgaacagacatttctcaaaagaagacatacaggctgccaacaaacatatgagtaaatggtcatcatcactaatcttcagagaaatgcagatcaaaaccacaatgaaataccatctcacagcagtcagaatggctattattaaaaaaaattaaaaaccacagatgttggcagggctgtggagaaaagggaacattcatacactgttggtgggaatgtaaattagttcaaccactgtggaaagcagtccggagatttttcaaagaacttaaaatataacgactattcaacccagcaatcccattacggggtatatatccaaaagtaaacaaaatgttctaccaaaaagacacatgcactcacatgtttatcacagcactatttacaatagcaaagacacaaccaggtgcagtggctcacacccataatcccagcaatttggaaggccgaggcaggcagatcacctgaggtcaggagttcaagcccagcctggctaacatggtgaaaccccatctctactaaaaatacaaaaattagctgggcatggtggtgcatgactgtaatcccagcttcttgggaggccgaggcaggagaaccgcttgaacccaggaagcagaggttgcagtgagtcaagattgtgccactgcactcagcctgggaaataaagcaagatccatctcaaaaaccaaaaatatagcaaagacatagcatcaacctaaatgtccatcaatagtgggctggaaaaagaaaacgtggtacacatacaccatggaatactacacagacatgaaaaataataaaattatgtcctttgcagcaacatggatgtagctggaggtcattatccaaagtgaattaatgcaggaacaaaaaaaatatattgaatgttcttactcataacaaggagctaaacattggctactcatgaacataaagatggcagcagcagaatctaggaactactagagggggaaagggagggagggcagaagtttgaaaaactgttgggtaccatgctcactaggtgatgggatcaatcatactccaaacctcatcatcatacaatgcacccaagtaacaaaactacacatgtatcccctgaatctgaaaaaaaaaaaaaaaaaaaaaaatgcatgccttcaacgaggagctttctttgctttgcaatagagctcactattggaaggaaaattaatgtatgtgaaatgtttgctgggtatcagaaataacataagttcctaatactccagcctgttctcctgctcttgctttgcagttgagaaaaaaattttaccagtagcttaatgaaaaatttaaaatactagggtataccaaaaatgtcatcattttttaatattaggccagtatgagactgctctctatttgggaattagcagtttatcatctctgaggaaattagtcatcccaaaagacaatcaaatgttgacatttgacatgcccagtaaactactaggacccttcatcatcacgctccaatgaggcccaccagtcgataagccctgcccacatgtacatctacacactcattcacacacccacccacacacatacgcccaaacacacccccacgcccccgccacacacactcacaaagctgacagccaggtttttgatgccttgccccgaaatataacctaatcaacaaggaaagaatcaccagacatttgaggaaatactctaacatggaagaaaatcccagagaaaatcagatttccacagaaataggggaaatatagagagtacaaaactaaacaaaaatactaaaaaactcataattaatgcccctagcaataggaaaatgtatctacatttaaaagtattacttaaaagaatatatgaagaacaagaaaaatcttcttagaaattaaaaaccttatagcagaaatgaaaaatttaataaaagtttgaaatatgaacttaaaagatcaaaaagataaacagatggaaaatagtaaagaaaaggtttttaaacaatcagacccttgctccaggggttcaatatcaagctaacagtgttttcacaaagagaaaacttagaggacaacattattcaatcagaatacaagaaaatatcctaaaactgaaagatacgagttttctaataaaatatgctcaccacaataaatgaaagatgacccaaactaaaacagtttactgtatataagaccttaaatgtctaaatagaggaataaaagccacatacaaagaatgagaataacatcaaatttttcaagattagaacgtgcagacaatagaagaatgcctttaaatgtcttttgatcacatgaatagacttattgtaacatggaatgctcaagattagtgccagtaaagtatctaattctgacttcaacttttaaaataattaaaatcaataaaatcaaaacaggatagttaccagaataacagtgccattataaccacattaaaaagaaaagcttccatcaaaattttatggtatgacaaatccagtacaatatattttattaaatatcgcattccactcaattttgtaatattccattttctgatgaaaatgttattcagaagagaggcttcagataaaaagaaaaattgaagtagaagtacatacgttgagatttcccaattttaccgttaaaaagtacgttagatgtcctgcaataatttgttcataagtatctttaacaaatgaataattattaatatatttcacagataagccacttggtaatttttactgacatagaactatataaacttttagtaaaacatttaaattgttttactttgaatctcctcacattttataagttagttttcatttattctgcttctttaaaaggcgtggccaggttgtttgtccataataggatcaacaaatattgaactgcactagatttgtataataactaatttatacaatttaatatgtgggaaattatacctctctgtgtatttagatatgtttatttgaaacaaaaataattaattttatgcatatgataagaaacagcctattaaatgtatatatttttaaaaataagcagcacagatagcagatacagaactctttactgtcagtactcttgactaccaagaaatgaagccacactctagaaaaatgcaatgcaagaaaagattcaagttatccctttgggtaaaaatcatccccttaataatattcttttgtaatctaaattcacagcatatcccatcagcccaaggtaatcttctaaaatgtcattatatttgcagtattataattttttttcaagccagtatttatggaggtcactgggctacggcaacaaaacattttaactccagggagagtatagctttgtaggattagctcctttgacaattgtctttctaaaaagatttttactttagaaacctctgacatatgtagttttcttcagatccaatgtatccaaatgttttgtaaaaaccaacattttgtggtagacattcaagagtaatcttataacagttcagtttcttgcttagcaaactacaagttgataacaatttgccaagctgtcttcctctgcattcactgctaacaacatctactctttctctcttagcacaggaaaggatgaatttatgtactattatcagagttgtcatggcaacactgtcaccgagtcacatcttccacaactgtaacataatgaaccacagatttctttgtatgctcaaaatgctttatacattatcaaggttgacaactccagtggcagttcgctgacccactaccttaaaaaaaaaaaaccctaggttagttatattagtccattttcatactgctatgaagaaacacccgagactgggtaatttataaagagaaagagttttaatggactcgcagttccatgtggctggggaggcctcacaatcatggcagaaggtgaaggaggaacaaggcacatcttatgtgatggcaggcaagagagcatgtgcaggagaactgtcctttataaagccatcagatctcctgggacttattcactatcatgggaatagtacaggaaaaacccactcccatgattcagttacctcccactggctccctaccatgacatgcagggattatgggagctacaactcaagatgagatttaggtggagacacagccaaaccatatcatcagtagacaaagaggccttaaaccaagccttctgggagatgtgttggtgaaataactggagcatatatagctgtattctgattccagtccacttctttaagtagacttgggtcaaacaggagtttcatgaggtttcatctttccagtaagtctgtttgataaacctgaggcaggcccactatgccccccaggacaccaggtcccactctcacttcccaacccccagcccctcctcagtgcctttaaaattttgaaggaagattatttccagccagaaggcccagaaaatcaatcaaaccaaacacactgtcaatcaagcacaaagacttttaaaagatacaggtgactcttgttatttgtggaagttatattctgtaaagtcacagcgaacactgagttagcaaatactgaaccattgctcctagcggaaatagagggctagatccctatgagcctctgatcacaacatttttgccaaccaatcaatacataaacttgctgtttgtttctgtttaaagactccatgtctttagtgtatgttatatcaatatatgatgttgattcattaacatcgaactcacagccagcagcacaactcatgcctgaaggaagctcatctaaagaagctcacatattttctctataagacacatcacagcatttcagcactatactgggggggggggggcattttaagctgcaaaatcaccaagaaaaagcacaaaagtatgaaaaatgaggcactaaatagatcataacatagatgcttatttgcagtatgaactgaaacaaagaggcagtgtcacctcattggacctcatctaggaacatgtaactcaaaatgtttaccctctatgcatgtttctgaatgatcataaaaaccctgcgagtattaattaggaggtcacaaacaaattttgcaaagttgcaaatatagaatccatgaataatgagaatcaactgtattttcagaaatataattattcacaagctatttctaagaaatctaaaggttgtttcaccaaaattatcgaactaacagaaaaaatggggggtgggggtctaacacaaaagggaaggaagtccccaaggtggctggtgaagagaagtaccaagatgacagctttgtaacagacccaaagagaaccagtctgggttgcagcaggacaatggaatgctccaggaagaatgaaaaaagtagaccattataagtgccaagtaaacaatgattgtacaagaaggaaatataatcattgcacagtatgttcctcagctgtaaataatatttatatggttatatcaatataaacattgaatattgacctaaccaaacaaaaaagaattaatgaggaaaaaaaatggaagttcacaaattcttcagtacaagtaaacagagcaatattttgagggctcaaagaggactcacttttgagtataaggtttttttctagaaactaaagaatattagataaaatgttttcttaataatattcagaaggaaagtacctctaagaaacatttatagattataataagaagagattaatatggaaaatatcagttaactctttaagacaccagatgcaatacaatgccccatttgaagcagtaaattaaagatttgatattgcagaggaaaagaaggtcaataaatgatattaaggaaaattaacaaatattccatgagaaaaatagaggaaaagtaaaatggcaaaaatgagaacaaaagaaaaaaatgggatgaaacaccattgagtttaatctgtaaataatagccattaccaaagatgacaattttatagaacatgagtcaataataaaaagtaaaatatataattcattgatttttctaaatgaggcatttagaatttgaaatgtaaagaaatctataggaatccataaatttaaaaagagactaactttaagacaaaaggtaaaatcgaactcagttttctctgtgatgtactactgtgaagataatcgtggagaatttttgtgggaaaggattgtaacacaagaactctgtgttcagctatgtcattttgtatgtgtgaagatgccggaaagacatcaacagaaaattatgatgtatcatgtaccaatcccagataaaattctagaagggtagtcactcacctggttttgtctatcctgaacaccagcatcttaaggatcaacctgttttacaaacgtatgtttaacaaatatttagtcatgttctttaactgggaactttatggaagggttaaagtgattcactgaaaatgactatgtagaaaaataatcagggaaggggaaaatttgacatttaaaaaattcagctggtaaaatagtgatgagattttttaaaaattttgaataatagtaataggagggagactatctcttctacaaattcatgatttagggataaaaattgacagtaatcagtggggaaaaaaatagaaaccataacaataagtcatgttcacacaaaaaggtcataattgacaaaaggtgcaaatcagttcttttttgcttctataatatttgtatgaaatactcattttagatagtatgtgtccagtgcagtatgagcttgtaacaaaaagacaatagaggacatgtataaatagctaggtattttgggaaaatgggcaatgcagaaaatcaagtgcatgtgcctagaggaatgacaatgtttagtataaaaagatttgctaaaatcttcaatattttaaaataataatggtgataaaaagctgtcctctcattttaatttgaatacgtttactgttttatgctgaattaatattccccacttgtttttgctacagtctattgtgtttaagtagttttcttattactattttactttgaatataagaaatgcctcttaaattttatcaaatgcctctttagtatttacagataaaatctgtaatctcttttaatttgtttttgttccagattacgttgatagatttccagacctgaaactgatactaatgacctctttctggtttactttggcttataggttgctctttttctaatgagattaggtctgagttcttttctttttcatcttttttctttaagaatgaaggcatctaaagctgtagatttttctgaggcaagtattcactgtgtctcacaggttttggaaaaagtattgtttttatttctttctagagaatatgtagtgcaatttttctttttttgacttcgcatcagtttggttggggagagtcaaagaaactgaactagtactaagggaaagtgagccagatttagggtatcagcttttgaaaatctgtaggtggatatctaaatgttacattttaacaatgtaacttaattttaatgaaattatgaaactttaacttgaaaaatatcccagaactatataatgctataatgcattaatcctcttctctaaaaagaatccccaacaaatagttttcagactcttgtggcatatgtatctgtgtgttatattacaacatacaatgttgtgtcatggtattttccattttacgattctattcttttttaaaacatactagaagctcaaggtattggtattcattatcttatttctttgttaaatttagcagtaacattcttccttataattactaccctttaatacttagtctgccttctggagccacaatgaagaaattcaattcctcttccacttgacaggctttcaaatatttaaagttaggcacccttcttctctagctgtcttctcaaaggctcttctctagcccaacatccttctctagcccaaacaaccttatttaattcaattattttttatatagggtcattgtcttgagactttttgccatcctaattttcttcatctatacggatcctagttggtcaaaattattctaaaagtgcactgacacatactaaactaaatatttccaatgatggctcaaagtgaaagtccaatggaattattaccctttttttatagacactaaaaatcatttaatgccaattaagatttcattatctggccgggtgcagtggctcatgcctgtaatcccagcactttgagaggccaaggcggctagatcatttgaggtcaggagtttgagaccagcctggccaacatgaagaaaccctgtctctactaaaaatacaaaaattagccaggtgtagtggcacacacctgtagtcccagctactcgggaggctgaggcaggagaattgcttgaacccaggaggcggaggttgcagtgagctgagattgcgccattgcactcactccagcctgggtgacagagcatgacttcgtctcaaaaaaaaaaaaaaaaagaaagaaagatttcattatctttgtggcttaatattgagattgcaattgacaaaaacactcaagtatttcttacagcaatatctgggaagccatagacaaggtagtctatgctatgaactttgattatattgatgccttggttctctcatatataaagtcaagataatattaatactaactcatagaattttgaagacaatgaaattatttgatatatgtaaagcatttagaatagtggctgataaatgctaagccttcagtaaatgataactgttaacattattataattattatcatctgttttgacatcattctccaacatttttaaaagctagtctccaccataaagagcttgtgtagttgatacattttcccttgaaggaaaactttgaaaaaatcattttaattcagtatgttaaatcataaaaatatcaactgcatgaactatgaaaaacatttacctgtaaatggacaagtgtactcttcgactacgtgtcacatatggttattctcaacaaacatggaatataaaaacacaaaacatgcaaaatacaacacagcctaaactgggttgtgtcagtcaggatctgcaaaagaatattggaatagaaagtgcttggaacagctactacctctgtggctgagggagagtactcaagggaaaaatgaagttgaagagagcctctctccccagggttgagatgcaaatctcactggaggagatgtgtttgcagctgacttgaggtcagagaagtctatgaggatgttagtggactggaggtgatgagtaggaaacctctgctgagatgcccatggttatcactgggcctctgataagctgctggtagctgtgccagagaataagaagaaaagcacctggaaaaagaagctccttcttcttctatgccttgcagttttcctccagcaccctgtactgccaaactttaacactgtgtcagcaggcaaaggaggaagtccagctccactattacaaagcaagctcaaaaaaagggtagatttagagctgaccagcaataaattgatagatggaagaaagatctaacccaatatcgcaattgtaatgctctaaacattctaatatcaatatacaggtgtttgaaaatttgaatgaaaacactttacttttctacagaaagtaaatactatagcagaaagttccacagatgtgtaacattcgatttaaaaaaatatctttgggtgactaaaacacctgccttttcagagcttatgatctagtgagatagactcataaacagccaaatacaatataatatatttagatagaagtgtgcttaagaagctgtaagaatgagacctgaacattaatgactacattgaacagttaaaacaaagagatggatcatagtctacaggattttgacatgagccatcctggaatattttaccctgaaaacttcagtgtcaagaaattctgataaattagattaagttcaaagaagagagacggtgataattaatggaagggaaagactggcttgtgaggggaaaggctaacaaaaataaatctatacaaattagctaagtgacaagagaagcagagagctgacaagcatgagttggatgtaaattcaaaaaagctataatcaaagaatagcacagaaagtggaatttagtctaattcaacaaactttataatgggggaagatgtggagcttgatttaggcctttaagaatgaacatattggctgggcacgggggctcacgcctgtaatgccagcactttggcaggccgaggtgagcggatcatctgagttcagcagttcgagaccagcctcaacatggagaaaccctgtctctactaaaaaaaaaaaaaaaaaaaaaaaatacaaaattagctgggcatggtggtgcatgcctgtaatcccagctactcgggaggctgagacaggagaattgcttgaacctgggaggcagaggttgcgatgagccaagatcgtgccattgcactccagcctgggcaacaaaagcaaaactccgtctcaaaaaaaaaaaaaaaaaaaaaatggacatacttccagcagaaagaatataccacatatgttgatggatggagagtataacaggaaaccttttgttgagccatcagttgagctaatgcaaaagattgtgtcaagatacaagaatgtctctgcctgagagcaaggagattttttttttttgcaccagagtagagccagacagagcgtaggtgctgagaaatgctgacggattaaaagagtaattgaatgaatagtgaaagaatgtcagagaaaggagctacattttggagagtgctgaatgttgaagagatctgtatgttaccttgtaagccatggggactaattgaagggttttatgctgttgctgttatttttatttaagtatgcttcctaacagacacagtagagagaaaagtaacaacataccccattcaaagtgataattccaaaatcagaaaccctgtgttactagccaaaagaaagaaaaataataggatttttcttcctccttttctcatttccaaaatttactcttcctacattctgtcactggtctatcaattaaagtaatcatcctttaaatgtgtgagacagtaaacttgactcacagcaagcaaagaatgagagctttcttaagttaggtggattattttaatctttagaacttcttagccattttctcttcctcaggtgacaggtcctgattcaccagtagcgaggaactctgtgaagatatcataattatttaggtcccattaggtttctcctcactttctcccccattacaaaggtccttgaaaataaattgaatatttcatcaatgaaacttagactaagtagcttatttcactgtttttgaattttgtatatatgtgtgcatacgtattggtgacatacaccaaagtaaaagtaaaaatttatatgtattccctaaagtgaaatgaacagatttttgttcacaatattagattggcaaagtttgtaaatttgtttaactttagatactctgacagctagaaacctacaccaacattttatgatgaattagaagaaggatcctgtagatacacctaaggatacctctgatttcaccttatccacggggaagtatgctctggaaattcagccagttagttgaattatatcctgcattatttttacattatatcttctgcattcataatttctagaactaaccatgggtattctgaagaatagctgtgccaaagagagagaataatctccataaaacatattgtccatacctgttccacatttttctaccaccagatttcttgatcatctagaaatacctaccctttgaacattcacttgtcaaatccctactctttgcaaggtccagttcaaatgccagctctttcatgaagccgtgtttgatccctgtgtctcactcaccacctcctatttcccctccttataagctctcatagaagttcttatttcagattcagttatcaaattctgcctcaacttacggtcaactgtgtatttgtctaatctcttatacttagattgaaattccttgaggttagaagtcatgttttactgataatgttattcacaactcctagtattgcacctgacttacaattaagaactcaataattgattattcaatttaatatagaaagccagttatcgcaattgagaaggctctagtagtagttattattggcaagatgtttgctaagaacacattaaaatgtttcctacttgtgctaggaaatttattagtattcttaagattatattttaatgaagttcggtgagggaaaataagaagaaatactttgggtattagcctactcatatgaaactggctttatgaattcaaagggattagataaaattgattacgtatattgtaaaacccaatgagttgtgattcttctataaatgaaaaagtttaaatgaaatttcaggaaagttacttggtcctcatttaatcttcagtaataaaagaaacagtgtggatatatggctctaagcaattactttagcaattctgattccccattacatcttgagagaatgtgaatgattaaggacacactgagaagtaggataaaattagtaaaggtgtactggatttttaaataaacaatatgaaatatttgtttgcactaaacattcaaaaccatcatttcatttttctagaaggtcaaatacctgccataagccaatggttatgcttccaagcaatagaaacctcagcatttccttggttgagtttcatcctagacagtgccctaaacttctattttattatcatttttgttttgagttacctaagaaccaaatagtcatactaaactattaaagtgagagcgacaaaagttcttctcttaaaagccaaaatagatcatcccataaggatcacagtaccactctcagtttatgagggagaaaaggggtgtggggcagggatttttcttaactgaaaaaccaactcttcttagcaatacagttctaggatatataaaattctttaaaaaactgaatatgactcctcacaatgccatcttttggtgggtgatttcaaatagaggttcactcagaaagaaaaaggggatttttatgaaagagatagaatctggaaagagagaaaaggatcccctcccccacaaaaaaggactgaggagggtggcaggaacattggggaaacaatagctagtgtgaatcagacttgccctggtgtgatctttggatctctttgaatctctttctctttcttggaaatccaccttgattttatagcttatgacctgagccaactactgccatgacatttctgctaaaagcccaaaccattaagacaaaagcagtcttgacatgattaccaagacaggtctgtttgtgcatttcattttatttttaactttgacagataaaattgagtttatgatggcaggcagtggaacctgagaatcaaacaattcagaatacttagctataactggttcttgtaaatacatcttagcagtcaggattgaacaaaaaaaagcaggttggacaagataatttaagcagcaactgagaaaaataaaaatgaattttcttttcctgtgtacttttaaattcccagaaggcttttaaattatcgaagtatttactgaaggtataagacacataagtggaaatcattactgtcatctatattaataatgcctttataattgatgagtgtgtcgtattttcttcttgcaattaaactctgctgtctgagattacagcataaaaaagagtctctgaaaaaaattataaaaacaatttgggggcggcaggtggggccaagatggccaaataggaacagctccagtctacagctcccagcatgagcaacgcagaacatgggtgatttctgcatttccaactgaggtaccaggttcatctcactggagagtgtcagaaagtgggtgcaggacagtgagtgcagcgcactgagtgtgagccaaagcagggcgaggcatcacctcccccgggaagtgcaagaggtcagggaattccctttcctagtcaaagaaaggggtgacagacggcacctggaaaatcgggtcactcccaccctaatactgcgcttttccaatggtcttagcaaacggcacatcaggagattatatcccgcacctggctcggaaggacctacgctcatggagcctcgctcattgctagcacagcagtctgagatcaaactgaaagggggcagcgaagctgggggagggatgcccgccattgcccaggcttcagtaggtaaacaaaatggccaggaagctcgaactgggtggagcccaccacagctcaaggaggcctgcctgcctctgtagactccacctctgagggcagggcacagccaaacaaaaggcagcagaatcctctgcagacttaaatgtccctgtctgacagctttgaagagagtagtggttctcccagcacgcagctggacatcggagaatggacagactgcctccttaagtgggtccctgacccccaagtagcctaactgggaggcactccccagtaggggcagactgacacctcacacggccaggtactcctctgagacaaaacttccagaggaacgatcaggcagcaacatttgctgctcaccaatatctgctgttctgcagccacgactgctgatgcccaggcaaacagggtctggagtggacctccagcaaactccaacagacctgcagctgagggtcctgactgttagaaggaaaactaacaaacagaaaggacatccacaccaaaaccccatctgtacgtcaccatcatcaaagaccaaaggtagataaaaccacaaagatggggaaaaaacagagcagaaaaactggaaactctaaaaatcagagtgcctctcctcctccaaaggaacgcagctcctcaccagcaacggaacaaagctggacagggaatgactttgacgagttgagagaataaggcttcagacgatcaaactactccgagctaaaggaggaagtttgaacccatggcaaagaagtaaaaaaccttgaaaaaaaaatgagacaaatggctaactagaataaccaatgcagagaagtccttaaaggacctgatggagctgaaaaccaaggcaccagaactacgtgatgaatggacaagcctcagtagccgatttgatcaactggaagaaagggtatcagtgatggaagatcaaatgaatgaaatgaagtgagaagagaagtttagagaaaaaagaaaaaagaaatgaacaaagcctccaagtaatatgggactatgtgaaaagaccaaatctacgcctgactggtgtacctgaaagtgactgggagaatggaaccaagttggaaaacactctgcaggatattatccaggagaacttccccaatctagcaaggcaggccaacattcaaattcaggaaatacagagaacgccacaaagatgctacttgagaagagcaactccaagacacataattgtcagattcaccaaatttgaaatgaaggaaaaaatgttaagggcagccagagaaaaaggtagggttacccacaaagggaagcccatcagactaacaactgatctctcggcagaaactctacaagccagaagagagtgggggccaatattcaacattcttaaagaaaagaattttcaactcagaatttcatatccagccaaactaagcttcataagtgaaggagaaataaaatcctttacagacaagcaaatgctgagagattttgtcaccaccaggcctgccctaaaagagctcctgaaggaagcactaaacatggaaaggaacaaccagtaccagccactgcaaaaacatgtcaaattgtaaagaccatcgagtctaggaagaaactgcatcaactaatgagcaaaataaccagctaacatcataatgacaggatcaaattcacacataacaatactaaccttaaatgtaaatgggctaaatgctccaattaaaagacacagactggcaaattggataaagagtcaagacccatcagtgtgctgtattcaggaaacccatctcacatgcagaggcacacataggctcaaaataaaagggtggaggaagatctaccaagcaaatggaaaacaaaaaaaggcaggggttgcaatcctagtctctgataaaacagactttaaaccaacaaagatcaaaagagacaaagaaggccattacataatggtaaagggatcaattcaacaagaagagctaactatcctaaatatatatgcacccaatacaggagcacccagattcatacagcaagtccttagagacctacaaagagacttagactccaacacaataataatgggagactttaacacaccactgtcaacattagacagatcaacgagacagaaagttaacaaggatatccaggacctgaactcagctctgcaccaagaggacctaatagacatctacagaactgtctaccccaaatcaacagaatatacattcttctcatcaccacaccacccttattccaaaattcaccacatagttggaagtaaagcactcctctgcaaatgtaaaagaacagaaattacaacaaactatctctcagaccacagtgcaatcaaactagaactcaggattaagaaactcactcaaaaccactcaactacatggaaactgaacaacctgctcctgaatgactactgggtacataatgaaatgaaagcagaaataaagacgttctttgaaaccaatgagaacaaagtcacaacataccagacctctgggacacattcaaagcagtgtgtagagggaaattcatagcactaaatgcccacaagagaaagcaggaaagatctaaaattgacaccctaacatcacaattaaaagaactagagaagcaagagcaaacacattcaaaagctagcaaaaggcaagaaataactaagatcagagcagaactgaaggaaatagagacacaaaaaacccttcaaaaaattaatgaatccaggagctggttttttgaaaagatcaacaaaattgatagactgctagcaagactaataaagaagaaaagagagaagaatcaaatagacgcaataaaaaatgataaaggggatatcaccagtgatcccacagaaatacaaactaccatcagggaatactataaacacctctacgcaaataaactagaaaatctagaagaaacggataaattcctcgacacatacaccctcccaagactaaaccaggaagaagttgaatctctgaatagaccaataacaggctctgaaattgaggcaataattaatagcttaccaaccaaaaaaagtccaggaccagacagattcacagccgaattctaccagaggtacaaggaggagctagtaccattccttctgaaactattccaatcaatagaaaaagaaggaatcctccctaactaattttatgaggcctgcatcatactgatatcaaagcctggcagagacacaacagaaaaagagaattttagaccaatatccttgatgaacatcaatgcaaaaatcctcagtaaaatactgacaaaccgaatccagcggcacatcaaaatgcttatccaccatgatcaagtgggcttcatccctgggatgcaaggctggttcaacataagcaaatcaataaacgttatccagcatataaacagaaccgatggcaaaaacctcatgattatctcaatagacacagaaaggcctttgacaaaattcaacaacccttcatgctaaaaattctcaataaattaggtattgataggatgtatctcaaaataataagagctatctataacaaacccacagccaatatcatactgaatgggcaaaaactggaagcattcccttgaaaactggcacaagacagggatgccctctctcaccactcctattcaacgtagtgttggaagttctggccagggcaatcaggcaagagaaggaaataaagggtattcaattaggaaaagaggaagtcatattgtccctgtttgcagatgacatgattgtatatctagaaaaccccactgtctcagcccaaaatctccttaagctgataggcaacttcagcaaagtctcaggatacaaaatcaatgtacaaaaatcacaagcactcttatacaccaataacagacaaacagagggccaaatcatgagtgaccgccgattcacaattgcttcaaggagaataaaatacctaggaatccaacttacaagggatatgaaggacctcttcaaggagaactacaaaccactgctcaatgaaataaaagaggatacaaagaaatggaagaacattccatgctcatgggtaggaagaatcaatatcgtgaaaatggccatactgcccaaggtaatttacagattcaatgccatcctcatcaagctaccaatgactttcttcacagaattggaaaacactactttaaagttcatatggaaccaaaaaagagcccacattgccaagtcaatcctaagccaaaagaacaaagctggaggcatcacactacctgacttcaaactatactacaagactacagtaaccaaaacagcctggtactggtaccaaaacagtgatatagaccaatggaacagaacagagccctcagaaataatgccgcatagctacaaccatctgatctttcacaaacctgacaaaaacaagcaatggggaaaggattccctatttaataaatggtgctgggaaaactggctagccatatgtagaaagctgaaactgtatcccttctttacaccttatacaaaaattaattcaagatggattaaagacttaaatgttaaacctagaaccgtaaaaaccctaggagaaaacctaggcaataccattcaggacataggcatgggcaaggacttcatgtctaaaacaccaaaagcaatggcaacagaagccaaaattgacaaatgggatctaattaaactaaagagcttctgcacagcaaaagaaactaccatcagagtgaacaggcaacctacagaatgggagaaaatttttgcaacctactcatctgataaagggttaatatccagaatctacaatgaactcaaacaaatttacaagaaaaaaacaaacaacctcatcaaaaagtgggcaaaggacctgaacagacacttctcaaaagaagacatttatgcatccaaaaaacacatgaaaaaatgctcaccatcactggccatcagagaaatgcaaatcaaaaccacaatgagataccatctcacaccagttagaatggcaatcattaaaaagtcaggaaacaacaggtgctggagaggatgtggagaaataggaacacttttacactgtcagtgggactgtaaactagttcgaccattgtggaagtcagtgtggcaattcctcagggatccagaactagaaataccatttgacccagccatcccattactgggtatatacccaaaggactataaatcatgctgctataaagacacatgcacatgtatgtttattgcagcactattcacaatggcaaagacttggaaccaacccaaatgtccaacaatgatagagtggattaagaaaatgtggcacatatacagcatggaatactatgcagccataaaaataatgagttcgtgtcctttgtagggacatggatgaagctggaaaccatcattcccagcaaactatggcaaggacaaaaaaccaaacgccacatgttctcactcataggtgggaattgaacgatgagaacacatggacacaggaaggggaacatcacacaccagggcctgttgtggggtgggggaaggggggagggataccattaggagatatacctaatgttaaatgacgagttaatgggtgcagcacacccacacggcacatgtatatgtatgtaactaacctgcacgttgtgcacaagtaccctaaaacttaaagcataataaaaaaattaaaaaaaataaaaaatttagtcacgtatttcctttgtgagcttatttggttacatctgaaaatactgagaacttttattccatgaaaatgattgtcccctcaatcaatagcaattgaatgcatcaaatatgtctagcaccatttctgctacacagtaaatactcaaatatatttattggaattagcaaccattcccttttctttgcatcctctacatctgttgtttttttattttttaacaaaagccattctgaggggtgtgagattgtggttttgatttgcatttatctaatgattagtgacgatgaccatttattcatatgtttgttgtcagcttgtcttcttttaagaagtgtctgttcatgtcttttgccttctttttaatagggtgggttttttgcttgaaaatttatttaagtttcttacagattctggatattagacctttgtcagatgcacagtttatgaatatttcccccattctgcaggctgtctgtttacttccttcatagttttgctgtgcagaagttcttgagtttaattatgtcctacttgtcaatttttgattttgttgcaatagcttttgaaaacgtagccaatatcaaaaaggggatttcctaggttttcttctaagattttcatattttgaggtcttacatttaaatattcaatctatcttgagtcagtttttgtatatggtgaaaggttgtggtctagctttattcttctgcatatcagccagctatgatggcactattgactagggagtcctttccttattgcttagttttgttgaatttttcagagattagatggctgtaggtgtatgtccttatttctaggttctctatcctgttccattggtctattgtctatttttgtaccaggaccatgctttttggttaccgtagccttgtagtatagtttgaagtaggataatgtgatgcctcttgctttgttctttttgcttaggattgctttggctattcaggctcttttgttgttgttgttccctatgaattttcaatagtttcttccagttctttaaaaaatgatgttggtagttttatagggatagcattgcatctgtaaattgcatgggatagtatggccattttaatgatgctgattcttccaatccatgaacaaggagtgtttttctatattttatgttgtgatttctttgagcagtgttttgtagttctccttgtagagatctttcacctccttggttaaatcaattcctgggtattttatttttgtttgtggctattgtgaatgggattgcattcttgatttggctctcactttaaatgttattggtatatagaaatgctacctatttttgtgtattatttttctttgccagattttggtgttaggatgatgctgacttcatagagtgagttagagagaagtctctcctccttgacttttttggaatagtttcagttggattggtaacaactcttttttatttgtctggtagaattcagctgtgaatacatctgatcatgagcttttattgattggtaggttttgtattatggatcccatttcagaacttgttactggtctgttcaggttttcagtttcttcctggttcaattatgagaggttgtgtttcaaggaatttatccattttctctagatgtcctattttgtgtacatagcagtgttcataatagtttctgaggatcttttgtatttctgtgggattgattgtaatgttatctgtgtcactgatcttgtttatttatttagagagccaacttttggttttattgatcttttgtgtagattttcacatcttggtttcattcagttctgctccacttttggctatttttttcttctgctaacttcggggttaatttgctcttgtttttctaattcccccatatactgtattagactgttaatttgggagttttctaatttcttcgtctaccagtttagtggaaagtcttgggagatgggcacctgtggccatgtcttgctgccgctgccccctacacaaaatcccttgggctctgcccagacaggagctccacctctgcctattttctgagcagattcccctgccaattcaaatgtctgtggggatcatggcatctcttatagctaggatcccagaggtctgtggcgaaagtggtttgccccacagtcacttcactcagccttccttaatagccattcagggctgggaattagtcctggcacttggcatccccatgcagggtccccagcttcctccatcttcagcctcagttactgtgtcacctctctgttgactctcagtgttttctctcaaaagatctgctttaagtatgtaggtttagtccacattttggtgtctcttggtgagacaggcactttctggctgcatctagttagccctcttgttctgatctcctgaggtgacatttacaccttagggtttgatggtagccaataggtgggctttagcatccctcaactcaatgtcacagttgtatctatactattagaataaactaaagcaaaaaccattattattttaataatccatgactgccagacaaaagtggctatttccttcttacactttaggcagtggtctcattgtccccttggtttgcatagatggatacagcattgctctagccatacaatgctcagtcttccattcagatgctcaaatggagtaagttcttactttatatttcagcacctgaacccaaacaccatgtgttccatttgacagaactggaggcagactttaccttcatggattaggtctgctcttagatcaggatttttcaccctctatgtaagagcatgaggagctataaataaatctatccttaaagccaaaataacaagcccatcttaataaggttatttcagttaacataagaatagttacaaagtaaaggtctgttaaatttatttggaaatataaaattattcctccattatatagtagtttctcaaaacgttaaacatagaattaccatatgaccgagcaattccacttctaggtatatacctaaaagagatgaaatcagggaatcagacacttttgcaccagtgctcatagaaacactattcataatggccaagatgtggaaacagccaagtgtctatcaacagatgaatgggtaaagaaaaagtgatatgtatgtcagtatacatatatatctataggggtgatatagataatatttacatatattttaataatattctattggagtaatacttttaaatattttgtgtgtgtgtgtgcatatatatatgtgtgtgtatatatatatgtgtgtgtgtgtatatatatatatatgtatatatctcatcccaatggaatattgttcatcctcaaaaaggaatgaaattctgatacatactacatggataaactttgaaaatattatgctaagtaaaataagccaaacacaaaagaacaaatattgtatgactatatgattgtatgatttgtatttgtattaatgacagaggctggagaggcaggaatgggaagttattgtttaatgagtataaagtttctgtttaggttgatgataaggttattgaaatgggtagtggcaatgtttgtacaattttgtgaatgtacttaacgccattgaatcataaactttaaaaagattagaatagtaaatatggagttatgtatgttttgccacaataaaaagaaaacgagtaagtaaacttttttttttaaattactcccctgtggtacagttactccattcatcatcacattaagacttcttccaggttggggagtgttgcgagatgttgtcaaaatgaccccacttgtgaaatcagaaaactttcccttaaatctcagctctgtcacctagtaggaatgcaaatttgagcaagtcacttaggtctgttgcaccttaatttcttcaggttatgctgtccaacagagttgttttgatgactgtaattgaaatgcatataaagtgcttcgtaaattcaaacaacaaggcaagtggatggaggtgactttttaaaatatattcttttagggagcttagtcgtaatactgttatctctgaaatgcatttactaattcatatttaaatatactaaaatattaaggtattgttggtaagacagccacagttatttttctaatttttctctatttaaagtattgaatccatagttttagaattaaaaaatcctgaatttccaaggaaccacatttctattcaccatttctataatgaatgggttattaaacctttccatttatcttatttcaataccttttgttcattatgtagcctcattgtacataccttaggaagaagggataattatattacctcagagagaagggacaactatatgattatcttgtctgagatgaaaaactatggtcttcattcatacctaattaaaagttttttgtttttgtttttttttttttgagacggagtctcgctctgtgtcgcccaggctggagtgcagtggcgcgatcttggctcactgcaagctccgcctcccgggttcatgccattctcctgcctcagcctcccgtgtagctgggactacaggcgcccgaaaagttttaacttatttattttgctacctgttctgattttcattccaaaccacaccattatcagtccctacattgtcaaacatgtaataataatttggcatgacattatatcaaattggacattatcttggaaggtcctttggatgcataattatattgaaaaataaatattttaaaagtaacaaattttatgctataacatcataagttaataataaaattaatgtcattgaaacaaatgccaactaatttttttgtttccctctttagcggttatgtctttgactatgattactacagagatgatttctacaatcggtatgtgaatttttcatccttgttttcctatgacttaaattatcttttaaccattttgtacattttattcatgggtgctcttaattatggtatttaaaacaatattattatagttaaaaataaaatactaaatcccaacaaaatatacagatttttatattttcattatacttacttgagtacagtggatcttggaattttaggactttggaggtgctcaaacctaagatttggtgtctaatatttagataaaatcctaaagatttaattaactaatattatctgccaagtcatttgttgatttagaatccttcaagatcaagagtttgaaaactcagaaaaataactccaaccttctgaagtccataataaaacattgaaaatgctatattgggtagagtctgtaaaatttacagatcgttcctgctttgcaggacagtaggaggccacaaaggtgatgatgcaagatgagaccatccaatgaggaaaaaacaggattgtctcatgatcttaaacatgtttgtcaaaacattaacaacttttattctcttctctataaactaatgggaaactatagtaaagctaattgttatttagtatactataatttaaaacaataaaatattaagaattaaggtgttttagttctttgtaaagaacacttatcaaaagtagttgaaacagtgcatgccttctcatttcctaactcaggacaggatacggagtaggcatctgttttatcccttgttggatactcctctctaaggttgaattagctttgacattctatcaatgttgtgaactatctctgagagttctttcaatgtgtgattctcttgccagggtcacttcccctccatagcgttatacgtttcatcacatcacatccactttcctcacttatgtcgataagtttgcctttactaagttcctctgactccatacctagagtctcttgagtagaggagtatcaatatccctataatgagctatttcttctgtaatttcatttacatttaatttgagtttcacatctagtattatcactcttcgattctttgctgcattttcatctttgatcaattctttcttttgattattcaattttgcaaaatgccacgttttgtcactgagagataaggaagcattacaattaatgatctgaaacaagtgagtgaagtgaataatcaatgaacagcaaaaaaaatcattgacagactttgaaagatggaatgtgattagtgatcattgttattatcatgcacatttattatttatgcatttatttgtggaaaagctagaagcaaagtttggactttattaaattacttaccgtttatatgttgtagtaactaaaatttgtgttgtcggagaactggtgttatttaactaatatcagtaactgaaatttatgcatatcagagatgaggatcaactatatatagatagattacgggattaaaaaatgaggtaaatatattttaagcctttaattatgagtattatgcaaacaacaaaaaaaaccttaggtactgtataaaaatgcaaacttagaaaaaatttttcaatagatgttttaaagaggaagtaactgtgatccttgaaagggtcttattctctctgctccagcctctagggccttttgtaagttccacaagaattccatgtttcttcctgcctcaggtcctttctctgtgttgttccatctcctcatacctccctacactacctggttcacttgactcctcatctttcagatctcagcacgaacatccctcacagattaaattaggttcctctgttcctctcgctcagcgcccagcactgttacttcacagcacctctcctaatttctattgctatatttctttctgcagtgtttgattcatgtctgtcttccttcccccacctgaacaatgttcagttttgcttatctttgtatccttggggactatcagtaaacctcacacatagtggatactctgtattattaattcatctccttagatttagagacacagtcattttccgaaggtcaccaagctaattagtgacagaactatgatcataatctaggcatccaatttagattcaataaccaactatgtgaatatgcacaatggggagggcaatatcagcctatggagctatgcgattcctacttgagaatcagacccacaactgtaacttcattgctgcaatggtcaaactactgaattaagcaacttatttcactagttatccttttctgacaaaaaaatataatctttaagaatgattttctcaaagcattttataatttctataaaatatattttaaatattaagaaacttatcataacttattctaaaagtgatgcaaacatctggcagcattaaaataatcccatttactattaaggaaggatatctagactgtttttatactatttgaaaatgttactttttgacaagtttaaagacattttctactatagctattttttcacttgctacgaataaagttttcaattaatatacattgtcttatactctgtctatataaaaccattttagcatcttttattttctatcatatgacttccttatacatttaaagaatttccacctaacatggagttttactctacaccgtaggagacccaagttctggttgttaccggaaaggggtcccaattcagaccccaagagagggttcttgggtcttgcaagaagtaagtcagggcaagtccacagcacaaaagcaagtttattaagaaagaaaggtggtgaaactatagctactccatagacagagcagagtattcccagtattcccaaaagtaagaggaaggacgtgcctgccctaggtacaatgcttgtttatacataggacaacaacaacaacaacaaaaaccatggggagttgtgctctactacaagggtttgtgataaaggatacatttttctaattactgcattttgcaagaatcaatatgactatctttaaagcaaaattaggaatgcttttgttctgaagatatggagatatcaagacattcctgggcctgagtctgtttagtaaacattattaatctgttctcttaaccataaacatctaggagctaggaataaatacctaacctcctgggaatgcagcccagcaagtcccagcctcattcttcctagccctcactcaagatggagtcgctctggtttgaatgcctctgacatggtaactagccttgtaactttaggcaagtcaggttttcagttttctcatctttaaaaggaagccaggatttgcattttactatttagaaatgttagctcaataaaatcattagattagataggtgatagatggatggatggagatagatcgacagatagatagatagataatcaatagatccatcttacttgccaaagaacaagagctttaaatagtcaaattattagagaggctgtagctttcaggtgactctctactatacaagaacttagctacagtatgaacaattttcaaaatcatttatttgttttgtgtacaatctgtttggcatggaagtatgaaatagatcagtatggttgtattgttaacagactgagcagtctgtgctctcgttagtttattttccatttttggcacttggctaagaaagacataagcatctgccactagtggatatactcaagagttccctataaacatagaataccatgaaataaaaacagaatggagaggctggacaagatacatagcttacagagtcactactaatccacagtcatttctcataagttacggtcttcttgcatttgtgttttctttttctctctctcttttagcagaggtgcaaacttgggcaagttagttaatatcacaaaatctgttatgtcctctgggaggtgagcatgaaattaattcctaactcatgaaatcattctaagaattaaatgaggtaacataatgatcagcattatgcctggtattttttagtgcttaatcaatattagctagtattaacagttaacagtaaccattaacaataatggggccaggcgcggtggctcacgcctgatcccagcactttgggaggccgaggcagacggatcacctgcagtggggagtttgagaccagcctggccaacatggtaaaaccccatctctactaaaaatacaaaaattagccaggtctggtggtgggcgcctgtaataccagctactcaggaggctgaggcaggagaattgcttgaacccaggaggcagaggttgcagtgagccgagatcgtgccactgcactccagcctggggacagagcgaaactccgtctaaaaaaaagaaaaagaaaaaggaagaaaaagaaaaaaaaataatggtagatgtatttctcatattgacattcatacagcagtgtccatataactgagaaacaaactggttggtcagtttttcttccattatagctgatttgggacatctctggattattctgttttcccagttttccctctcctactcccccaaagcattccggctgcagctgatcacacttgcctgcagagagcgctcagctgtttctgttaaccccatgctgcttgtttagatcatgaaaacagaaattacactacttacgtataacagggctaattgcatatagaaactcgttaagtcggtattaaagaactgaaaacgcaaaaagacaacactgtgatatactggagttagtgactgcaggaagctgctaccacttctagggctggagaaacaaaggaagatttggggtctcagaaattgctgtagaaaaagagcctaccagagctgaaactatgcataggagattctgttcagatggtgctgctgtgtctgagtccacaaggagaacctgtggtgctgacacccaaatctctgagatggggatatgggctgacaggtgctggggtctttgagggagcgtggagtggctgttctccaagtgttgcaaaattactcagactggattctgctgatgctactggaatgaattgttgttgccaggatgaagaaactagattggggtaatgctgaaaagagcaggaagccaaaacacaaataaaaagcaaaacaagaaggagcaggtcccttttccttgctccaaccttgcagtctctttcttaggtcctttattggctgagcccagcagggagctagctgcccaaccccaaccctaaccctcacctccggaagtgtggttttcagagttccaaacccatcatctgtggctaagggtaggtctgaaaccaagaaacaatagcttaataactaacatatgtccacattatattgtcatactctttctgccaggtttggagactctaatgtgattgagggtttccaacccttagatagttttagcttagaaaacttctttacacaatgttccaccttactgtgattcattgacctgtctattcgtggtttcagggatcatgaagagtatcattaaacagtagatgagtggttattctaaattcttatcttttctcttttacacaaagcattgcccaataatttacagcattgaatggcattttcttttaaaggtccatatatgactctaaatgtaggacattgtatgttaatacattaaacgtaagtatttatactctagcaaagtaaaaggagatgtatacctaaaattatatttaatctccctagggaaagtttttaacttctgcaatgttagctgtctaaatccaacctcttttttcaataatattaggaaaagcactgatcagtttataatttccagtgataaggagacttttattaacagagaaaaacaaatgccacaggtgttttacttctatgtaaaacacgtatacattttaaatgatccaaaataggcattgttcaattctggaaccattttgactttgtgttaattgatccaagaaactactagatttgcagttaacgcaagaacactaagttacagttgtttcagatagttgattagagagcacaatatatattcatgaatattggaaaacatattaacaagaaacaatgttttgttatgcaaatttgaactatcctctggtagtatggtattccatttgaaatgtttgaaaataacagcatggtacacttgacaaatggtattatttggagtcagaagacatgaatttcaggactagatgcacatgtgttgactggttaagcttggataagtcatctcttttttgtgccagtttccttcctgggcaaaatggcttcacactactgaccttacagaattacaagaattaaatgagaaaatcgttttagtggcttataaccccacaacaacatttgaatttattaactttttaattacacaaagctgtatacaaaatgtacagttagcaatgttagataaaatacagactgtattagaatcaaaatattgcaaaaaagatcattcaagattgcaatcaacttgcctttaaaagcatgttcaagaagtatttccgtgtgatccaaggagaaaacttcacagaaaaccttggaaaatttaataacaaaaaagatcaatggaatttactcatttactggtctcaggtagagtgtgccttttaaaattattttctgattcaactgtaaccaaagatttatttgaagtcagagtagaaattataggcagagtttatgagttttgagtagtttaaacagtacagggaacagatacactaccagcctataagaattatttgtgggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcaggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcagaaaaaaaaaaaaaaaaaaaaaaagaattatttgtgtagatttcaaatctatcccttcttagaaatgaataggcaccttactttggttttatatactgtacatctgtcaaagttaagcataatgaaaaggaaggctggaggttgaatcaagacatggagcaagatcttctctggtcctctggttattgatctttgtagagctactgaaaggtgctggtgagaatatggccctgaatttgttatcaggttttgcctctgggtagcccagaaattttagccccctagggaagaccaaatatttttgttagcatcaactacttagtaactataagttttgattcatgaacaaggaaaaagaagaattgttttcatgagggcaatttagaaagaaacaggtaaataccagaaaatgtttgaagttactactaatctaaaatgaaaatttaatattcagtaataaaatacaacacacatattacatttttcagtttcttttcttgtgttttaaaccacgtttgttgacagtaaaatataagcatcaagtcagaagtttagccatcaggtaatgatttattagaatgtggtgtatctacctgagaaaatgccccacagccattaaaataaacattacgaagaccatttaacaggcctgagaaatgtttgtttttaatataaaccaaagagaatgagctagaatacatgactgtacatatattatgttttcaattatgtgaaaaatatggatgcttataaaaacagattaaagaattatagtagttgttctggggtctgagacttagaattgtagtttttttatgtacttttttttcccaaaatgttactttattattgctaaagcttaataataacaagttcttttttaaaaaagacacttaaaataatgtttgctttgttaatatgcctttgtccaaaaggcacttagtttttaaattaaattacctttgtccaaaaacaattattgtttaagaacagtagatgaaatcaaatgtccttattcttcctagagaaaagttgtctattttatcaaataaactactattaaaattaatattaccagtttttagcttttgctagctaataaagttacatatgtcagatattatttaaagcattaaaaggcaaaataagaaaagggtacatagaaaatagaaatgtttattaaataaagaaattaaattctcaaattttctccatgagttggttttattaaaattggactgaattttttaaatttattacttgacagcaggtgttttagagttttcactgtaaaatggaccttgaggaaagaattattattatatgtttggcttcattataaaccattatctatttgatgagtaagtatttgggagaaaattatcctgaccaagaaatattagggaaaattaagggctattaaaggaaaggagtggaaatataaatccaaagggtaaggaacaagaaaaacaagaggaaggaaaaaaattaaagcttttcactagcctggagatttagattccatttaattctgctggattgccatttctgctgtcagtctacaatcttaaatgaactagttccttagtctcaatactatttgccaatctaatatttgataaaggtaaaatttctttgatttactgtaggccgaattctgatgagaaggccaatacctgtctttcttgggctgcctttcacctacttccctctatattttgaagaacccctatatcccatcttgcaatcgcagaaagccttccccgctttctatccttgtcttgttatgtttttgtacattaggacaacatccagtcttccctccttttatttctaattgactcaagagtgcccaatgaaaattaagaaagtcttcaggtccattaaaagttgtaaaattaaaaattatgccctcgtgttagcccatgttactggtggaggatgtccaggttcttgaacaaataattgggcaaaacgcacaaacaaaggaaggaaagaatgaagtaacaaaagcagaggtttgtggaaaatgaaagtatactccacagggtgggagccaaccgagcataagggctcaagagcctggtgacagaattttctggggtttaaatactctctacaggtttcccattggttgcttggcatacaccctatgtatattaagtagtggcccacaatcagtccgattggttgcgggaggggaccaatcagaggtactttcaatttttcatcggccatgcagaaaaaggtggcaggatgaggaggggcgcaaagggagtagcctctggtccttttgttacttgggcgtagaaaggtggggttttcctttttatttagttctaggaagtcagcatgaaacagccttaggttccctgcctccagaccctattctcctgcctcacgcattcccaattttgttttgtgaatgacctatcacattaaaatatttaagtcctgatgctgcccaacgtcccatcaaagtggaagaaagaattggtaaaacgttacccaataccttggtgaaagtcatccagccaggcttggtggctcatgcgtataatcccattattttaggagcccaagttgggcagatcacttcagtccaagagttcgagaccaggctgggcaatatggcaaaatgctatctctacaaaaaatacaaaaaaatttatccaggcacggtggcatgcagtagtcccagctacttgggaggctgaggtgggagaattgcttgagcccaggaggcagaggttgcagtgaggtcacaccactggtctccagcctgggtgacagagtgacactctgtctcaaaaaaacaagagagagagaaagaaaattagtcattttcctttgaagtaactcaccaaaatattcagagaacaggccactcaccataggaatttataccaaaggaaagttgtttagtaaagtactaagtatattactaaaatgtatgccccatactaaaagcatatcataaatacagtgagcaagtatggctctttctcagcataagatcaggccatgccactgttggaggtttggtaatccttggctgggggaagcaatagaaatattgataaacatttttgtttcctataaaagtagtattaaattacattgcaattaaagtagcagtgaatatagtgaactttacttggcctgtatttttactatagcactcttacatcattgtatattttgattgtgttttagagattttcttaacccaatttatagattggcttgtttagtgaacctgtaaaactacacattggtgtcctagggaaatggtcctgctaaaagagcttgcctttcatttcaagcagcaacttctactctagaagagatcagtcaattgccatattttcttttcactcaatagttttgggtgttatagctcatgcaaagtgcctttgtattttggttcactgacttaaggtgctctgtgaattcaacttataaataactaatgtagatcttgttttgtgattgaaatgaggggcaggtctagctgacccttttgattctcaagcccctagtggtatggatgatattcataacccttttcagcctcatcctgcctgtgctctttgaagtaaactattatgtgttgacatccatgacctgttctttgctagctgttcttcagctctaatggactttgcttagtcacagaagatggcacctctcttgaactctgtctcatttcatttcttttcctttccagatatctcttagttttttccccagcatgttctaaatcattttcgaataccctaagtctctaatgtaggagatattcttaatactaaggaattttgctttaaatttggtttaatagtgctttttgcgcttccctcacctcacagtataatagttttaaatgtctctaaatgaatatttggaaaccagtctatcttaacttttattatatttcatatattatttcctaaaaatagatgatcacattttcatctgtatgtataaacaagatgtaattttatgaattaacctattatagaacttgttttttttattttcttcccattctagtttctcatttctgactttcatattagattgtttttattgactgttttaaagtaattataagaatgtaatccaatattttattctgtcacaataaaatatgtaacaatcataattctaagtcaataatgctattttctttatagtgaataacgtaattacatgtctagttcactggaaaatagtcatgaaaatgaggaaatgtatcccagtattttttcattgaccttttaggttactcaaatgtgctgtcatataaaaatctgttgtatatgtggatgcagtacaaataatatgaagcttctgaatctatgaattatatatttttataaatgagttaacccttataccttgattcctttcattgtttaatggaaattaattgattgtggtgaatatcatttttcacttttccgcaaaggttttaagttttattgatttttttgttaaatatgcttgtaatatctaactataaaatatctctagtctcaatttgcaaatctaacaaatggtcagaataattaaaagatatcttgataaatatttcccaccgtaagtagtcaacagttttatcctcacgctagcttcatgtcattcaaactgtctccttttgtctgcaatcagaggagactttgttactgaaaagattcttaaagtgagctgaagcaccatattgatttgtctgtcatagctgttttcttgaagctggttttactttttatcttgctgggctgtttactgtttgaacagtaattttatttctttgttcctgttctgcaagatcttttcctcttttaaactaatgtgctaataagtgtttgatgtgtaagaggaatatttctgttcataagaagtgtaaatctgttttaccaagcaaagaaatatatttaggaatgaaggtcagcataatttcaacaaattgcatggtactgttggagcaaagctccttgtcctttcataccttacaaatgagttcctcttggaggtcacactctaaagtccagaaagcatagactatattagcatctattttcttagtgaaaattaaatctgccaataaatacctgcatctgaatattagagaacagcagcagaaagaaaacatttattgaaattttctaccaggacattctgttcaacatttcacatatttgatagaactctcgggcatcaaaccaactctcagtcccatttgtgttttgtaaaggttatttgattaccacgggcgtgtgcctccacctccccgtgcagtaattccgctgaagcgtcccagagtggcagtcacaacgactcgcagggggaaaggagtcttttccatgaaaggtggatcgagatctactgccagtgggtcaacaggttctaaatgtaagtaatgtccttcattttatttctctttaaagaagggagtgattaactatcattgcacgaatgcctatattcaataaattaaccagatagttatgaaggacctgctatgtataaagtgttagaaaatcataagatggataaaaaatggtctctgctttccaccatactgtgttgcagtaggggagacaaacacaaaaatgtctaacaaaaatccaggaccaatttgaaaagtattttatcagagcaaataacactgtgctcttggcttagcttgtgatatattaaagtactgaaatataatatgttgcttttaatgaagaaataattttacttccaaagggagtgcataaactgtcttttcagagaaacatacaaaattagttcatggtttgaatatttgagcaattaagagaggcaaactatagagatgttaaaagcataatttaccatacagtgataaattatgataagatatatgtatctgaagatatatttaatgtcataaaaagtaaaataatatttgcatagtttcacattaattagtaaaaagcagcgatacaaactttccaactaaacacattgctaaatttttatatggagtgatacagaaaaaaattttatttgttagaatattattcataaagaaaggataacaaaatttcccatattccttgagattgccttttatcagaaaacaaacagataataagctgacctataggtaaaagaataaacacatagagaaagttgagaacactatatttcattgactgaggtgacatttgagtggaaacctaaaggaagtgaggaaaagagaaagtgaccttgaaactgtcagagacagagcattctgtggagagaaaatggtcagtgcagagaccttaaattgaatagtcaaggaacaataaggaagccagtgtggctgcaacagagccgagccagagagagaaagtctggctggggatcaggtcagagagttagacacagggcaagttccaatgcagcttggtaagccgccgtagagacttggatttactctgcatcccaaccatttaagacaagtaaggcaaatactattatcccagttttattgatgagtaaacacagaaagtcatatagctaatagacatagtagagtctcttagttcttatgcctatgtgctatctgctgtagaacactgccttttatttcagcactatactgagatagaatcactattgaaacactttgtttttacaaaatgcagttcaaaatgcaggaaggtactgatgcttctgaaaaggctaaagtttgttgtactcaacaaactttgtggacctaactaagataacttcaatagcacactaaatagatttatggatttctatgtaattatgtattcatgtatctattctgtagatagataaatatgaattccattttgagtcttagtaataaaagaaaaggagtttctgcaactcgttggaggttaggtcaccccaatgtggagtatacacaagtttctatctctcaaaaagtctccaagtgttgaaaatttcaatgacttatttcttacattggaaaaaataaaccatgaagggacttttatagaaagacaaattaccaaagtcagctacttggagaaataatgtgaagagactttacagtttgtaaccattacaacatgtaacataagaatctatccttaagtccaatggtaaatcacacatgaggtttaatttcatcttttctttgtgtgtgtgtttgtgtgtgtgtgtgtgtgtaagatgcgacagtcttgaaaaaaggctaaatctgaaaattggactactaaatacaaactagagatattttgaaagaaatgtggtgtgttttattttttagcagcaatcattctttggaactgtgtatcctagagtatctctgttatgctggaaagatatagataagcaataggtagaaatataaattatgggataaaaagattttgtaaggacaatcaagacaaatgatcatttaaaatctattcagcatgttataattgtgttaattttacttacttttgtgaagtggtgtatctttattatattgaggttaaatcaaaaggaaatgtttcatataaagcactggggaaaatcactttaaaagatttatcctaaggattaaatctaagcttggaggtagaatagtcatgtggtttccagcatcaataagatagctccaagggattactgcagagagacaggcaagccataggctataggtgcaaccccagtaagatacttgagtcagggagcttggcaggcctggtttacatggtagaaaacaggggcccctgggcctgctccaagccagccctgcagcagagcttctgtgtagtagtcaatgtcatggtcagtcacatcccagagagtacccagaaacaaggggcagccagccatgatgtacttgagcatgatgccagccccctgttattatagaaagacaacagactgatctattctattcatttcatatagttctataaatttagagctcaagtcacaaaagctaactgttgattagtgttactttagtgaaacattaataaaaatttataattcactggcaagcataactagaatcatgatttaatattctttttaggagcatattggcagattacattatgtatacatatatgtaaataaaatatatatgtgcatgtataaatattcattaatttatagtactttttataattaggttggtttctggaaataacaaaagtttctaactcaaatcacaaatgaaaagtatcagtgaaatttaaaatatactatgttaatattgaaataatttgaataaagatttactaaggtatatagcttgctctttaattaatagctctttccagcatttaatggtttggcaagttcagaagaggaaattaatgttatagcttggataatttgtcatttcttatttcagaatttgtaatatgactgaattctgctaaggagaaaactatataaagaaaatatattaatgtcataatttaccaaaaatgaatactgataagcatttaaaatgaactgctttaaatagattgccactaggcatttctgtcccttttaaaatcaaattgaactaaaactataatcagcttgtcctttcctgacatcatagagtcataaaataaagaaaatgtgacattgcagattagcattttacaaaagagaaaacatgaatatcagtgagctttagctgtagtttcttagtggaaaaattgatgccctctggaaaaaaaaattcgatcaagtcaatttctttaaagaattaatttaaattctaatgtctaacaagaaagactctagtaagtttgaatgcctttggggacctgtcaatgcactttcagtgacagaataggtgacaaactaatataaatgccctgaagcatctaacaggaaattaaagacaattcaattaaagttaaaattgagaatttatccccaatgctaagaaggctttcttatgttgggttcctcccctcaaaagtatgattgaaatacagcgataaagcatcaaccagagaaataatattaatactcagcaacatatcattaaacattcccatccatccattatcctaggcaaagtatattctgctttagagatttttaaagagagaatgtactattggccggaaaggttagagaaggcttaacagaggattttgaactgagtttagatgagccagtagattctgaaagatagaatgagagatacttgctttctgggagacaagatctgggtggagaagaacagaggctttcctgtcagattgcctggagtggagtctgttccatagtatactaccatcgtggccttggggaaatcctttaacccctatatacctctaatttctacctggaaattgaaaataatatactgtgtatccaatagttattgtaagaattgaattacttatgtatataaaatgcttaggcacatagtaatgttcaatgaggttaattattgctactactataattattatagcagttaagagtattaaatatgaaattgctgaacctagaatccaatagtgcctcagccatttattatgtgtgttttgcagcaaggtacttgcttgctgtgccttagtttcctcatctataaaatgggaatgataatcttactgccttctctgtagagttctgaggattgaatgagccagcacatgtagagctcttagaacagtgtcggctaatataaaagccttaatagataatactgtgacagtaaaaataataactattattatctgaagtgaagatttactgctaggaatgtcagttaataaactgaggacattattattaaacaagatataaaaatgggtaaaaggataatgaaaaactgtgcagagtattgaagggttcagatttcatgcagggccaagataaaaaaattctcagcaaagtgctacctgctcaaaatgatattttaggacatctatatgatgggtggcattagttggcgagggctgccataacaaagtaccacagttcgggtggcttaaacaacagaaatttattttatcacaatgatggaggctgaaagttggagatcaaagtgtcagaaggcttggttccttctgatggctgtgaggtaaggatctgtgtcagtcctctctccttgactggtagatgaccatcttctccccatgtcttcacactgttttctctctttgtgtgtcttgtctaataaatttcctcttgttataaggacaagtttagacccctctatgttacaagggcatcacctgtcctctaacttcaggccagttgttcgtttttttattatgggacttacacttttctgcttcatgttatagttatttgtatgcacatctaatctttctattttcaattacaaattcattcaagttaattatgctttgcacagattatactcttaaacatttgtgaaatgtgacatcactactatttttgctttttgcattttactttttgtcatacattttatatttgactttgaaccaaatctttagaaatgctacagttcagagaaaattagttacagaatatgttgcatcagtcggtgaaacaaggggacaaattctggcctacactccagggtctaaaagaaatcagtatgacgtgtattttcaagctatgtgatttgagatctgctacttctgttacttagaagactgtttttgcttgctgaaatctaaagtatcttttcagtcataactcaaaaactcattcttttgtgactattttcacaatcagttatcatcaaaactaatttatcttttttctttgcccacatagctgatacaagttcaattaatcagcacctaacacagacaggtactaattttccattgacgaaatagacatgagccctgaggaactatttcatagacaaaatagacatgatctttcattttcaggcacttatatctggtcgggggcaggggggaccagaaaatttaaaaatgtgagataatttcaatatcaggtgacagaacatttttactatttctcttttttttgtattttatatgcataataataaattagttacatgtttcttgtctgtcactagttatagagtccatgagaccagggaggcagttcaccatgatgggcagtggggggtaggagggtgggacctatatacccatggctttggagtcaggcagcccactctaaacttgaattgttgcctattggctaaagcaatctttttaaagaacacttaaaaaatttttttagaaatagagtatcactctgtcacccaggctggaatgcagtggcatgtaacctcaaactcctgcactcaagctatcctcccacctcagcctcctgaagaaccaggaatacaggtgcataccaccatgcctggctaatttccttattttttgtggagttagggatctcagcatgttgcccaggctgatcgtaaactcctggctcaagcaactctcctgcctcagcctcctaaagcactgggattagaggctgaacaactatgcccagcctgctaagcaatcttaattaaacacattacttaacttctctaatattcactattcaaatccaaaagtaagtttaacaattctgatttgcatattgggaataaattaaatgatacacttgcagcttctaatgaaatgcaagatgaacagatgcatatagtaggcatttaatgaatacttactgaataaaatccactcattctccatttcattttctttctaaaaaatatagaaagaatgggtatagatgtatgtaggcataagtattatgaatacatatatatgcatatatatgtaattccctgttctaggaaatttcatctatggggtgggtgataaccagttgctgcaatttattttagcaaaatactttaaagtttgacttttgaaaactattttctagactagcaaattagccttttcatattaaattagcttcaaaaattgtattatgtattatgttacaagggtatcacctgtcctataacttcaggccagttgttcattttcttattataggatatttatatatatatataaagaaagggacagatgggagcagagcggaggcgttgaagtgatcatgataaagagttccaggaaccttccttttctttttctgaatattattgaattaagcacagtgattccttgatcatatttttcacatcaactgaagctgcatggcacaataaaaaatatagaattgaaagtaagaaaatctaggtttgagcctaaactcttacctgtgcatatcacatgactttgggaaaatcatgtacatcatcagattctcagattctttattgttgaaatactgtatttaaaactgatttataaattaagtgatatgcaaattttatttatttctttgttttggacattcaaataatgtataatggctggggaaaataaataacaaattaatgtgatttactgtcaaagtccacatgattataaacatttttcagttttctaaatagttgataggaagcatggtattggtaagggaggttatatctagagcagggtttcaatagtttggcatgatcggcatttggggtcagataattctgtgatgcggtgtgggctatcttgtgcactgtaggatgttgagcagactaaatcctcactagaagccagtaggaccaccccctccaagtcataacaaggaaaaatgtctccagacacagcagaatctctcctgcagagcaaaatcaccatgttaagaaccacggatctagacagttagctgaaacttctttatttaccctgaatagacttgacccaaagatgattaaaataaattgaaatatttttggccacataagtcagaaatgcacagatttttatatagacagatgatatcatcccgtgtgcctaatattctttttggattatatcttatgtcacagcagaaggcacaatcattttgtcaactgtatcagaatgtaataacatttatcaccaaatcaatgaactctatagagagagcagatctgaaatgacttaatgtgacttatttttaaaaacaaagatactacagtgatagtgatgcaacctgacttctatttctctagtgttcttcttgcctaaaaataagctaaagtaatttgtcctaggaactttgtaatttttttaatttatcattttgctgatttttgtttggtaattctaaattcaagccctataatcactcatagaaaaataagttgtcctcaacaagacaaccagagatttttattatgacagtatgtttgcttttgtgtataatttttttttttttttgagtcagagtctcactttgtcacccaggctggtgtgcagtggtgcgatcttggctcggtgcaatctctgtctcctgggttcaagcaattctctgcctcagcctcccaagtagctgggattacaggtgcgtgccaccatgcccagctaatttttgtatttttagtagagacggggttttaccatgtttgtgtataatttttgacaagttttttttgtggtaaaatttatctagagaaaaagagcaaaagatatttttcctgtgaagatagtattaccaatgtcttctaaaatatctgtaatgtatatatatatatatatatatatgctcaactactagagaatagtaagcaaaaatagggatttaatataattcactgtgcaggagagaagttgttaacaggaggggaaaaagtagaaaacaaaagcagaagagagctagaaagagcagtacatgagagatagaggaggttcatcccaggcattccatctagaaaccacatgtaatagcacaaaaccgtaccccatatatagatagtgactctgcatgaagaaaagtagaaagtggactaaggccaattggactaggtaaggggcaagccttttcccaaggacagcactgagatattgaagtgtgatgaggaaacgacttctacaactgctcaagaggcagccaagactatttgtagagcctgctttgcaggacctagatgagcatttgctgcccccccattctaagagggaactgagcagcctgcatagggttagaggctcactttaacatttcctggtagggtccaggaaagaactgacaggatttccgtgttacatttcaacattgtttcttgagtaacattaacttattagacccaaattccataataatccagctgagatctgaaagatgttctttcagtgctagacctgagtctagacttaaatgaaaccttggctccctggagacttctaagttccagccagatgagtctatattgttttctaatgtagtttcaataaagtggagtagtagtggtttattggcttgttttttaaggcaatacataaattaaaattagtcaactgcattcctgggctaaggagtagctctagttgctaagaaatatattctgttagttttcagctatagtcctatttatttctcctgcattgaaatctaatgttataagataaaatattttctattaaatttgatacgtttaagtaaaactacatatgccttcatcaaaggaatgagtaccactcttcaaagcaaaatcaatttgcaattgtgacagatgatgtttttcaaatttagctgcaattccacaatggtactttgatgtctttgaagtaattgacatgaggagtgattctctattttaccctgttctactttcagtttagtcattcctcagagggatactctagagggcccatgcttcttgcagtttttattttgcaaactactttgcattgtaaataaaagtctgctttaaaaaaaatctgatttgacaatgggaaaagttttctcatttttatacaaaaatctgttcttcccttaagatttagtgtttatgatccataacatatcatgtatattatatcatttatcttaatcgacaaatagttctattttaagcaaacataaattgcattttgtttttgtttttttattttttcaaaaaagtctgaagactaaagaatcaagttaaacactctaatttcctcagaaatttctggggaatatctagtctgagattattagaaaccagaaggaaaagagacagaagataaatagactggaaacaaataagtatccaagatcttgaaacttggctcttgaatgaggtgtgaatactgccagtccacctaataaaagctcggaggcagatatagctgttccattgtaatggctttaaaatctttcatctctgattgttgtggattcaaaatatttctaaattccattatccatttgcatacccttcagtcaaaagatttaggattaaatgctcgtgtcactgagaatccccatttgtaactggcataatcattcagtattccaggatcactagaagtaatgagaagttgataaaattgaaatggttttcagaaaaataaggacagtgcagtaaattttttacaaatataaacatatttcatttaaagaattgtcttcgaaatatgagattgttctttccttaagcctttttcccttataaaataattactgtagtcaatagtaggctatttattgttgtttttaacatccatacttggcaaaatgaaaaattgtcatcttatgttagtccccagttgttttctttgaaactgtactaaactctaaaaatctagaatgggaactactactattgaaattatcagtgagaacttctgtgattttcctttccatcaagcccagggcttagagggaggcatgtacaactcactgccttagttttatttaggaaaactgaagcttcatagcagctttgagtgagctggaaagagttttctcacatctaagacattttctttaaaggataaattgtatatcctggtttccatcaatcttcaaggagctggattaaaatatcattgactgctgaaatacatattacaacatagttcctcaaagtagtatctggcatgatttaattattgcttcatctgaatccctctcacattgaagatttactctattttgtaaaatttagcatcattgggttattttaaaaaatatttcttaattccgttatccatttccataaccttcagtcaaaagatttaggattaaacgctcatgtcactgagaatccgtatttgtaattggcaaaatcatccagtattccaggatcactagaagtaatgtgaagttgataaaattgaaaaatgtcctatgtgatttgacacagacttgagaaaatacggggtccctgtgagttcggtcctaggtgagttatggtgcatttgatgctctgttgttttcttccttctttctactttccagtgaaatcagatgagttacagaccatcaagaaagaattaacccagatcaaaactaaaattgactccttgctagggcgcctggagaagattgagaaacagcagaaggcggaggcaggtaagtgatctctgatcacagacaggtcagaattgaaccagtgaaacgttgtcaatcacagaagcagtacagggccaggaagacactggctgagtttaacagtgtttaatacagatgtgccaacaatgtctttaagcccagagttgcaataataaaatgtgattttttttcttttagagaacatgaactaatttttctaaggttcatactaaaaataaaaggcaaggacaagtgttttggtggaataatcagtagtagttgagtcacagttgaaactttatctcaatatcaagtaacctttcagaaaataaaatcaattaacagaataatgctatcaggctaacataatattcatatataattaaattaactgcagcaaaatttgacaggtttcaacaattattataatgcccaactcctgcctttgctgccaccctgaaagacttcagtacccaagttcaggaacatcaagactaagaccatgcacctggctacccacaggccaagttatttgatcatatattttacaatttaatagcctctgtcttttgaattatcagccctgacccagctcctttctagtaccagtctaatgctcttttcatatggctacagatattttttgagtcacaagtatatgagacctggtataaacttagaagtaggccacagtttgaaaagtgtgctctatgaggctttagacgcctcagaagcctccttggagttaagatggggattaggaagagacccggtaggtagacagacttatgcctcttcgaatcccagcccttcctctgaccagtgtaacttccctgtatctgttctagatactggcattcaacataagacttaatttgctggaagagttccatttcttataaaataaataaataaataaagtgtgaaagcccttgataaatccaacctcttcattttgcagatgagaaaacaaaggctcaggaaagtaaatcgattttcctagacctgtatatctaattagtgatagacctcggtctcaaactcagggcttgtaactgaatttagtgccctttcccatttacagccccaatctcaggttctcctcagagctttgtcccaggatttcactaaagtaaggctatctgggtgacacctaaatgatgagaactcatggggacctagggcccctgagctaccacacacaggagcctgtcagtttgttgactcatatcactggggtgagggttggagcgtacccttggcagtgagccatacagggctcaagaatgaaaagaagcacatgtgaggtggtagtgtagcataatggatgagagaaataaactctggttcaaatcgctgtataccacattcacagttttctcatttataaaatgatactgatggctgcctcacatggtgagtaatgaacaaagtggcatatgtaaactatatagcacagagttaaaaatataataattggagttatcaaggactagtagcaacacacccatgtacaggcaaatggacatttcctccgactttcatacggctcatttttaaaaaacataagccatgtacctagcacatggtcaactcacactaacccttgttaaggtagatgaggaatgatagactaaatggaatctttcttaattaaagatttctattacaaatgtattatttccaattcagaaaggcatacttgcctatactttttaataaaaaaaatagattttagaaagtttttaacatgctgtctatggcactgaaatgttactgtaactgaaatattctgtcatgttgcctaaatcaatatttccctttgaggaactctgtaaaattcattattatgtaaaacaacccttacagcaaaggactttgataaccaatttgcacttcagtttaaaggattatggagaactcatttaaatatggagaactcatttaaatataaatcacctcaaagagaaaaatgtggtccttattccatcataatatacctttcagtttgctgcaatgactaataccttccatatatctttttggaagatcatttagaaatgtaacactaaaattcaaagcttgcatctttttttcatgagatgtcacttacttttgaacatgtttaaacttttacagtcatgagacagttgcttttaaaataataagacttagtcctttgatatttatgtctctttaactttttatgaagaaaatgaatttgtaactccattcttttagtaattgtttcctgaatagtgtatttatagaaataaaagataaatgttttatatattttactatattttcttcacgaaaaaaatcaggtttgcttggaaagaattaacactaccttatggaaagtagagtgaaatgcactaaaactcattttaaaatgctcagtggctccttattcaaggggacagtcattacaatgcttaattagttgaaagctaattacttacttggtagctagcatttactcttcattattactctttcataaatttctcactcctaatttactattagttatttatttaatagtgaaattttccagcagagaaataatggcaggaaggagatggagaatctgaaagtgtggggaaggacacacaacatgggctgtgcctgaggtcaagttccatagtatcttttttttggaagcgaactcctaagctctcagtacattactttggattttctataccttaaattgctcaaatagatgtgtgtgtggtgtcctgtcatttgagattgttaagttcctcagaacaagatcatgtcttctcttccctaactctacccaacaccaggtattatgtactgggcacaacttagcaagtcatttaactctcttaggtctcaagtctttcaaatgtaaactagaggaatgggttatggcctcaaatgtatattctggcttctaaaactatgattactgtgaatccaccatgcatgtattattttttccattacatcacacaacttctttggggatatagtgactatgtagattatagaaaaccacaagtaacacttaaaatcagttcggccagcaattttgcctcattgttagatgattcttttaaaagagccgcatataagttgccacatatgcatagcacaaattacatgctttacgcaaagatgttaagtgaacaaaaacagtgaaaagcacaagaaggaaaagtaaaaagactggatagcatgcaatgggaacagttactccatgggtaactacattttttaaaaaattacatttcaagtgcagactttctgaagtgaaaaggcaattattagacattatttagttcaattttattctcactgttattcctgatacatgagcagccaagtctgactgggacaattccagtgataacattgggatgttagacttacgtcttagagaggttacaagcaggagtcccacaagataaattcatcctacccatatgtttggtataagagatgaagttttcaaaaataaattaatgtccaaaaattggagtattgtaaacaaatctcaaaatatgagctcttttgaaaatattgaacttttcaatactgctactcaatcactctacacatggcatgcacttttcagtttgctaatatctttatccagccagttcatgtatttatattatctatttggtccctgttcacattcatgtctgagactcccattgcaggttttccttacactgagctaaaatgtattttgctttcacttggttcagttatcactcttatgttctctgaaaagaaacttaatgtctaattctttgtgatacaacagtcaattaagaatttaaagggagtggccggccgcggtggctcacacctgtaatcctagcactttgggaggctgaggcaagtggatcacttgaggttaggagttcgagaccagcctggccaacatggtgaaaccctgtctctacgaaaaatacaaaaattagccggatgtggtggcacatgcctgtaatcccagctactcaggagtctgaggcaggagaattgcttgaacccaggaggtggaagttgcagtgaactgagatcacgccactgcacttcaacctgggcgacagcgagattccatctcaaaacaaataaatatatatatatatatatacacatatacgcacacacatatatatttaaagggagctatagtattctcacccctccaaaacctttgaacagagagttgatatcattggcctatgggtattcatcttaactgcattcaaattttgatcacagcatcgtagaggcctttttggtctagagaaatatcaacagttcctttagttgcttctcatttaacttggttttgcaccttaaactattgccatctctcttctctagtcattatgtagtttgtcaacacagattacgttgctcagaatggaaagtgttgctccagatatgatctgactgctgtagcctataacatgactaccatttctgttctgaataccttactgctctcattgacacttcagattgaattggtgatgcttccggttaaagatgatgaattaaacacatgaattgagcagtgttttctcttgaagctgcattaaaaacaaggaaagggtttagcagctggacaggaggtatacctaatttagcacatcctagaaatccaagtccaattttaatcacaaactcccaaaaagctcagaattcaaggcatcatattcccctggaaaataaatggttgaaagtctgtttaggaaacagattcctatgtcccagctatcccaactgcactttgaaagaaggctggagaagtttcctctagtgaaggtaaaacagtgggtctcagggctggtagacaataaggaaacttgagagcacttaaaagcagagagggagaaagtttccgtaattactgtagaaatgcccaccttctccctgactcagctaccacagcactggcaggacactagaagagtcttcagttgagaacatgagcagcccaagaggaaagacttaaagatgctgatagagggtcaactaaggaatcactcagccagaccacctacagagacagtatctctctatacttacaaagttgccagtcaatattttaatgccctactgttaatgtgaacaaacaagaatcaccagatcaaagaacatagttaataagcaaatgccaaaaaaaaaagaagtcagaggaaacaaacatatacaggaagaataaaacttcaaaaagaaaaaaaaaacactaataccctcagagaaatgagaagatactgtaataaaaacataaaattatagaactgagtattcaaagcgctgataaaagagcttttataaattaacatatgatagcacaaataaataactcaatacaatgattggaagacaaaattggaaaaactctcccagaaaatatggaaaaaaaaacagaaatggaaaataggggaaggatatgagaattacacgatgaatatctgaataagctttagtttcagttttcctaggtcatctgtattcattctgagttgggtttcagtttacctatgtgggaacccaaggcacgggaaccatctcagcctaatggccttccaattaactgttttaatatgccctttctctgaaaagtactaaaaagagtacttcaccaaaaacacagcgataaaccaagaaagaggaaaaacagagccttcctaaagcatggactctaaaagcaaaaaacaaaaggaattctcaagatagaggtaacagagatcctaggagatgagctgtgcaagagatctggaaagaaatgagtccagatcagaactgctcaaaagctctgggatagactttttaagacatcaaaattgatgaaatagctactgggtgggaaagaggattggttgagaaggaggggtaagtttgcataagtacgtaaagagaagcacatagagaacgaatttttaaaacttgaggcaatttttaattctagagaaaataaaatattcttcaggaaagaaaaagtattcatcctgtactaacaacttagctgcacaaagtactttcaccataaaaattgtgtaaaaactgaaaatttattaaatccaatttacaatatgattctctagagagatgggaagtgaatggggattataggaccaagaactgaatcctcagcttcctagggataatgtcaacagatagtgcataaaactgatcgagaagtagcaatataaacaatatttagagataggagtgcatgtatttaaaagattcagccaagtgagtggaaagcctttaaggagctggaaatggtgaacaggtaggaacaaaacgctgctgttttccatagcaagcttgtagaaatatttgagtacaaaaattaaatattttaaagaagttaaatataagggggtgaaaagacattgagttgtccttagcaactagatcaaacctttcaactgcttactggagtgcttcctgtagtgcttcctcagttaactgtaaaggcaagattgccctggacacttactaaaagcagcaaggaaggctttgttcaagactattgcaataggagataaaattgaactcaactctgcaaaaataaaaggcagaataattttttgaattctagaatgagctaaaggcaggcagattcttgaatgctggagcaagctaatggaaaagtattgggggatgttggaggaggatatttggccaccatctgtgtttgctaattagctcttattaaagttaggctgctactctcccaaggagactggaagacaatggctctatcttattcaatgataacatgtcaaagagatagctcctgaatcttaagaaaaatattcctgggttacagaaaatttgcctctcaaatgggcagagaaagaatttacaattgcaagtttgctaaagcaaacactctaaggaaaggatgctccagggcctatggtcaggaagaaacctacctgtagtttagtcaagccaaggggaatattgaagccatcttgtgaataactcaatcacagtctttcaaaattgaattctttctcctcactttcctacctagatatactcctctgtaccctatctctgtcatcactattacataaatcctgtccatcaaattgccagtctcaacattatcctctattcctaccatagcagtgttgccaaatcttaccttgggtatatttttcaccccttccctctattttcctaaagatacgccaatacccaaaccctcatcatctctcacatgttctgttgcattcatcttattttttacaccaatttattgaggtacagtttacatagaataaaatttactcatttcaagagtacaattcaatgacttagtgattttaccaagtgatacaaccatcaccacaaatcagttaggacattttcatccccctaaaaatcaccttttagttggtctccacttctggtttgcttcctcccgaattcaccttccttgtggaaaacagatttacattatctaaggtcccagacaggaataaaacaaaactaggttcacatcccactagagacctagtttaacttactagctgaatgaaatttggaaaagtccttataaaacctattaaatggttttataaggattatataatatctctactaaaaccattattagatttaaataaacacaattatataccagtaatttttaaatgatttatgttgcatttgtgtcatctcaacaatctagggtatttcatgtgaacaactttgaagccatttcctccaaaaatgtactcacataactaatatattcatctaaaacattctatgtaattttcctgatgttcatttatgtggctgatagtaataccatccaaaataagttgtatttttctaaatggaatttattggaaccattgagttaaattaatactatatacaggtgttgtaatataaaatttttcttaaaatacagtttatgcttgtatgcaaaaacaatgattcaaggatactaacttggctctagtgaataatgtgactgtttttgtatcaacattctttccaaccatctgctaagtacaattcagctagcaattatctagcaattaagccagcatgtcaaaaaacttaattgccaactcaaccaattttcatagttatattaatgataatagctatgcagcaaactcaatttaataaaaacactttgaacataaatcccaacaattctaacttgttttctgaatcgtagatagctttttgaagtagagatgagatgtgcagaaaaaatatttgaatatgaggattggaatttaatattaaattcttttctttcatggttttttaaagctttaggcattttcccttaaacagaaatacttacctgtaatttgtacttcttttcctttgatagtcattgtttagctaactagaacatgtgcccctaactaaacagacttcttcattcttgaacttaaaattggttattgaagagatttgaagtattcccttggtatgtcaaattaggccttctttttttagagatatattagaaaacagccaaggttataagatcagaaatttaaacttggaattccagctcttgcacttattactgtgtgaccatgagcacttatttgtgcctcagtttccccatgtgtaaaatgataaataagcctacattgcagtatatttcaaggactaaagttaatgaatcttacatggtcagcacttcataagcacacactaacttgtagccattataaaccgtttctttttgtaatccataatgtaggtgtcttagaggtgtctttttacataagctgttggctttttggcttctaatcgacctttaaaaaaaatctaatactcatttctcttttcacaaaagaaatgctatggtcatccatcactctgacttaaagaagccaacagacactccaaaagatgccagtgttcgaaggcagccctcctccaataagcactggaagacttcacatttcatttttctcttgaagacttgtcaatataaacacaaacaattttcttcccagaaaatttcagacctcacattttactttgactttgtggtttgggattgtcatgtagaatgtggcaacgaggtttttcagttttgtttctttttaagttatcttggatttatatttttgttaccatggtgtgcaaaattcaactgtcactttaactgaaaagaatttgacacatttgatatttattttaattagttgattccacaattcattaatatattcagcaaacacttaacttgtgattaagggtctgagttagccaccaggtaaacaaagatgaataataaaaatgtttctgacccaaagaagctttagcagcagagagagaaatgcacatacacacaaacacacatacacactcacacaatcacattgacagtaaaaagagtgatgactagaagaataactatgcaaataaagagaattgtataaagaacgaactaaacgttactcatctccaagaaaagtaaaattagataattattcataaaaaaagaacaagttgctttatctctacttcagcaatgtaattactgaatcaaaactgcctattaaactgtgaaccaacagtttaataaagaagatgtgctttcatgtgtgattttattcatggaacctatcattgtttagtgattataatatttcccattgagatgatgacaaaagctatgttgactacctattactaacacacaggctgattgtatttgttaaactcctgtgactcaataccattataattaaagcttttttttccctcaactcagataatgacttccaagcatttagctttcaagttaatgattggatgatgagaataatatataggattttttgcaatgaactgtattaatataccactgcctttgaaatacatcgtcagaatcacatgtatattgtatgttaatacaaaaaatagagtaactatgtctatgtactatatactgtattagtttgttctcatgctgctaataaagacatacccaagactgggtaacttaaaaagaaaaagaggtttaatgaactcacagttccatgtggctggggaggcctcacagtcatagcagaaagtgaaaggcacatcttatatggcagcaggcaagagagaatgagagccaggagaaacgggaaaccccttataaaaccatcagatcttgtgagacttatttactataatgggggaaaccacccccatcattcaattatctcccactgggttcttccaacaacacatgggtattatgggagctacaattcaagatgagatttgggtggggacacagacaaaccatatcagtactggactatgcctgtctaaacatagaactaaaaaggctgtgttgaaaccaaaacccaagataatctttataatgcctgattcttaatgatcagtaggggcgaataattttgacatgggaaatttgtctatagcaatcaagaaataaatatagattcaactcaagaactgttttgagcctgttataacatgtttgtgtggtctttgcagtttaaaaaacacagtcacatctttttcttcgttagagcacacagcaactctgaaatagatgttattttcatgcttaccttttagagaagaaaattacaattaataggactagtaattagcagaagtatggatctcaaaccctatatccttcctgataccttatctcttcatgtgcaaggcattcagtgaggggtacggagcacatcaaaatgttttgataactgacttgaattgtgcctttcagtttactaaagatcgacctctgtatcatcctttttgagtgtgacaacgatcttctgaggcaatagctcaactttccaggaagcttaaacactaatgagaagaagatgagaaaacagtagaactaactataagacagcatttgatcagggccttggttgatcaaagagggaaagattacattcagctgggaagatcaggaaagtcagctttcctgatacaagctgaaacaaattgatacatgaagccagatgaggactatgcatgtttaaagtgtggtcctacaggggtcctttgaaaatctgctatgcttccttggccagagatcttctagagaaaaaattatatatacatatacacacaaacacacacacacatatacacacacatatatgtatatatattacacacacacacatatgtatatgttactttcaacatcaaaaagtaagagttctcaaagagcaaatatttctggaatcattagagaagaaatggatatactaggccaattgaattcctaatatatgtcaatcttaagcaaaagtccatttatgtgttgtaacaaaaagataaacacaatgacctgacattgagaatgtttgggtttaaaaaatttataagattcaaagcatttttcactgtacagaattataagaatcccaaatttctatttctctctctttcttcaggtaccaacactaggtcttgaaagctagggcattttgaacaagcggcagggtgacatagagtggcaagaagtgagcggtttagatgatgtgtacaaaaacttcttttaggaggaagagtggggggccaaaaccagagtagccacctccattgtgcagtcaaaggatcagtgataggagaggcaacagaatagaacaagagatgtgattaatggtaaaggattcaaaactgtccaatgctcgagctagtcaacttatcacatcattttctcagtggagcctactaatagatgtgtatgtgggttaacctaggttacagatctagaactgtagagcacaatgaatgatatgtggaaggaaaatgagaataaaacctagaaatcttcagtaagagtaaaattgagagtgttttggtctttcttgccttatttaacttcctttgaattcaaacaactgagtcttctctagattaaacagatttttttctttaactcagttttaccttcttaaattggataataattttctatatttagaaaaaatcttggttacattttacaataaccactttatagtcttcataggactttctgtgctaaatgttatatagacattaggaaaaatgggaagaatttatgtactatacttccttccatcagtacatctgtatatgcatatcaagataaaaagtatagttttaaaagcagaattcacatccttactgcacaaataatgttgttaaatggagaaatttgaacctaataagttgattttaaaaacatcaaggcgtgtatagcttgtgtctatttatatgaagtaaatgtctttctcttaatgaaaaagagcctatgttttggtcatttatgatacccgtagtaattatttccagccttggtttgatctaccagctctttttctcctctgaaacacagcctcagccccatgagtgttgttctgtgatctcaacaggcctcttgatctaagtttactgttgttgttattcagtgaagagcataccgtctaccttttgtatataatagaacacatttatgtagtcctttataatttgcaaaacatttcccaaatataagctctgctaattctcacagtaaaacccagaggtaggtatagatgaggaaagaatgacttaatgtgcttaaaggacctgccccgaacaaatggccaaaacttagactcaaactcagtgtctataattctgtgggtaagtaacaaagctagagctagaatcttgtcaactagagctcagagtaactaaactctgacaacagaggcaaggcacggcaaccctttactactgtcttattttcaataaactttatcatttggagaattaaaatgcaagaaagtatagatacacatttatttataaaagtaattattattttaattataagcaatttcttggaaagaatatctgcttatttgcttatttgtacattatatttatatcagtttgttgatttatatattagttatgtttggaaagtttggtgctgagacaaaatgtttatatcaatgctcattttccttttatctcacgttatgaaaaagaccagaaatgaataccctaaagttatttagctctataaactacctttattgtcataaattatcaataaataagataaaaaattaggctatttaaaaactcagatcaaaggatagattaatcatctgataaaaaataacccagcaaaattagtgaaaacaaccaacttttgaatagtcatgaacacatgggaataagttagagaaggaggaacatacaatgatctaatttatcggatacccaacatttctttgtattatcataggggatgaataccacccactagaggaaataattacgatgctgtcagcacaatttccatttgagcaggtttctgtatatggaatgcacagatcctgacaactagaggaaattctagtaatgtggagtgtagcttcatttgttgagcacttattatttgcaagtctctatactaacactttgattcactataccaaaccctgaaagtttaggaaatagttgtccttattgcatggatgagaaaactgagacacatggagggttaatcatttccactttgcacagcatcacaaagctattaggtgatgaagctcaactttgaacccaggttgtctgaccccagaatttatgttcttaaccattgaagttaaccacatctgtcaacataatttagactttaaaatttccggcaattattcacacagacatgttgtctgaaaaacaacatatttgcttttgtacttttttcctcagtgagtttttgtctttttcacttaggtttgaacttgtcaatgaattttctcaatcctgcttccttgagtgaaaaagttctatgttgtatctgatttttgccatttgtttttgctctatttttcctctcagaaagaccatccttattagaaagcactatatataaaataaagtagccagaaagatcaatctgtttatgtaaatcttactaatttatgtactactaccatctggattccctaatttttgctaattctgttaaataaatatgcttacatgtaagtgcacatagaaatctgtacatgatttacatgattgaaaaaattcaacttaaagcataatattaccttaccttctgtacacctttaatagcatatagcgtttaccctttcatggactgttttttcatggtttatccaaatggctcatgagcaacccaaggtagtagtcatttgctttctcccccccccagaagctcagaagaagcaattggaagagagtctagtgctgatccaagaggaatgtgtgtcagagattgcagatcactctacagaggagcctgctgaaggagggccagatgccgatggagaagagatgacagatgggatagaggaggacttcgatgaagatgggggtcatgagctggtaggaaagaaacatttggtattcacaccctttgggtaacaacactagcatgttagcaactcattcattctaaaataaggattaaatcatttggggcttatttctcttatatgcatatatttaagggaacatgagtatagtgctttgcacataataagtgctcaatactttattgctaacttaaaataggaaagtctaaatgaaggagcaaaataaatatcatgtaagagattaggtatatttaaagtccaaagtgaaagattctctccaaaatgctccattgcaaaaggaaccttgcatttatgcaattacaagtgaactatatgtggatataatatcctggtaacaaactacaatatactggaagatacctggtttactaactgatgataattatttatactatttgtatggccaacagtcttgtctacagtgtgctccctaagatgacactttggtagatggccagttcatcattttcaatgcctgtactgcctgataatcagttattatgagttgggaatttggctaagacctgcttctttacaagttgtattttcctaatattgtaatcattatactgctcatttccagatgtcctttcctgcataaccacatcacggacttggtaaatgtatgctgatgaggatgttatttctcatattttatcaagcatgaaattaaatatactatctcaaaggacttaactaataaaaatgatatgcgggcaaatgtgggtatatatgtcgccaacttccaaatatctatggactgatcatgttaaatttggcttatcccaggtaaaaatcaggttccagtttaatactgtacctttagttacttaactcattttgtcatggtgcttgttttatcaatagtttccaagacagctgaattgcatagattctatattaacttttaacatgccagctctgttaaaatttatggcacctttattattttttgtttatttattgaattaattatttttgagacagagtctcactctgtcccccaggctggagtgcagtagcatgatctcagctcactgcaacctccgcccccctggttcaagcgattctcctgcctcagcctcccgagtagctgggattgcaggcacctgccaccacatccagctaatttttgtaattttaatatagatgcggtttcaccatgttggccaggctggtctcaaactcctgacctcaagtgatctgcccacctcggcctcccaaagagctgggattacatgtgtgaaccactgtgcccagccagcaccttcatttaaacttttcaaatatgaacttttaacaaccacccctatttccatgaaagtctgtatcagtttgcagaacacaagcacctgttcttagactgacattgatttcaggaatctattgattaaggattaaagaacaaacaaatgtcccagcttctccttaggcaggactacatgattcagcaggactaattcgacaacatgatttcttcaactcattctaatcagatctctgctgtcaggattccattgtgactacactccttgagctctctggaggcctccatgctgccatttacaatggttacttctctgttcttattttaatttacttctcagcagaatttttcataagctgaccacttccttcttctgagaaattctcctaatttaccacttgctcattatcagtttcctgtactagaaattttccctccatgctcccactttaaatattgggtagctcagggttttgtcttaggccatcttctctttctacaccctgtcccaagatgtcttcatcaaatactagagcgttaaatattatctataggccaagattcctaaattcacatttctatccctgatctcttcatgggactctagagtcaaatgtttagttgcctatcaccacatagctctccaataaacaattgaaacttaacatggccagaaacagtcttgatttttttctagtcattttgcactttcccaggcttcctcattctggtaaacagcatcgccattcacatagttattaaaaccaaagactaagatcatccttggcccccacctttatccttgttaatgctacttccaactcacacccccaaagttagttacaactccacaacaagtaccatgacccaagccacgatccctgctcttcagattttccataatatctaaactggttttcttgcttcaactcttgcctcatgcaacccattctccacagaagaagggtaaatatctttataaactatctgtcagataatgccatttccttgcttaaaaccctacaatgtttttcatcacacacagagtcaaaatcccaaagagtgtgaatgttaagttgtgatgagattaggtgaaggatgccagtagagagagagaacttggtgaagagaaagagaaaagatccccaatgctgaaaggaaagggatctagaccacaagtatacatacctgaagactcatccactgcaagtgactgtgattagtctaaggatgttgtggcaggagtttgagggagttcaagcacaaactaagataagtcagagagtgataacctctggggaatgaggagagatgggcactatcacagatttgaggggaatgaaaaagatttgaaaaggctcctatggaaaacactaaagattactaatttaaaaaacatataaagattggcagtgttagtagccagttaaggttaaagatcaagaattaatagagtagtattttgcaaactttaagatgtatcagaactacttagagaactttgtaaaaacgcagattcttgtgtcccattctgagagattctgattcagtatgctgaagggggctctaggaatttgtatttgtaacatgttcctaaattatactgatgctgctggtctgggatcacactttgagaactactgttatcacgttatcaatctgccttttctccattggcttttatcagcccttatggaagcatgaagaaagcaaacatgttcaaagttgcatttttgtcagatagtgcaaaaaaaaaacaataaataaaaggagttaggatattagtaaaaaaataaataaataagagtggctgactagatgggtcatggaatctaaccaacagggaaggaaaggaacacggttgtggggggcagtttaaaaatgagaaaataaaggcacaaagggaacaaaaagcccctacatataccattaaggactagagaaagaggaactaaatgaataaaagaaaaacaaagtctgtacttagggaccgagatatttcagaggtggacagtttaagagatgatgagatgttctatgggagggagtgatagaagtgggatcagtgcgaaagtcacagcagatgaagaatctaaggaatgaggggctcagatgcaagatgagtcatctacatgggcatgaagtcactccaaatattggatgagagggtgaaagagtaagacagttatggaaaggctgacaagaaagggagggcatggccaatttcagtcccagatctgtcattatcagtccaattgaactacctaaccaaataacttctctgagtctctcttgactttctttttttacaaaataggcaagatcagaaatttcaaaaaccattctgtttcagttttactctggatgcatgtttcctaggagcaatatgtctgaaagagcaaggcttaaccatacagtcatggcaataaatccaaaccatggtatctggactatactctaaacacacagaaaatagctgattagaactgagcacctgcctggaggtactcatcaggttttctccctcaaccctggtattatcattggaggcttagggaactagagataaatcctatctctattatatcattttgtttctaagacttggaaaataataaatgaggaagggtttaacactcagtccttgcaatccggattgaaactaaggagtctctcctagtgattggccaagagaaaattccctagtctggtgttcactgttatctcctttccaggctactgaaccaaaccatccttggttcccaaaaagtgaaataaaagcacaaatattttctttttaggtaataaagggcatcatagatttgaacagcaaagatacaatataattagagtttttctcacaaagaagagctggtatccacatgcccatttggctgctcaaggcaaatccagaatgctcttgaaaaagaatgaacaggaaataagaattggatctgaagtgaaggaaattcaacaaaatgagctagtagggtagctgtaggtggtggtgccccttgtgaggtggtgagaagccaaagatatgagcacagactatctacataatgtctagttctaaatatacacttagtgaaaatgatttccatgaagcaattctttcaactaacatttgggaatctatcatgtgtgcaccaggtgctaccaaaaatgcagggataactaaagtccttgctttatgtatgaaaggaaatgtttaagagtatggctccttgtctcaagtagcttagtgtcttgtagagagaggactgatttcctggctgggcatggtggctcacgcctgtaatcctagcactttgggaggctgaggtgggtgaattacctgagatcaagaatttgaaaccagcctggccaacatggtgaaacttcatctctactaaaaatacaaaaattagccgggcatggtagcaggtacctgtaattacagctactcagaaggctgaggcaggagaatcgcttgaacccaagagacgggggttgttgtgagttgagattgagccattgcactccagcctgggcaacagagcaaaaactctgtcttaaaaaaaaaaaaaaaaaccaacatggcacatgtatacatatgtaacaaacctgcacgttgtgcacatgtaccctaaaacttaaagtataataaaaaaaaaaccagacagatgactgatttcctcatgcacaaaaacagaaaaactaaacaaaaaacaagctcggactttataatttataagcagccagccaagactaaaaatctgtgattctacaataatctatacctatatatttcagtagtgcatagaagtcaaaatttggatttatctacagttaaattctgtattgatgcactatacatacactatgaaaccactactatagtcgtgtttctgaataaatccactagcaagtattcactgattgactgctggggataaagaaggaaaataagaaagatatgaactaactgaggataaaggccacagacaaaaaatacaatgcagcatgtcatggtaagaaccatacaaaaaacatagtttatagttggggaaccagacatagccactatggtcaataaagactcctggcagaaatggggttggaactttaccttgaaggatgacaaattagagaaacgacatgtgctaaaattgaataaacaatattcaaatcatccttcattgtccccagatcattttatggaaaatatatttaaaatcccaaaagcattagataattcacattatacataggtaggtaaaggtgaattttaaaaaataaaaactactggaaacttcacaaatacaacatttcaatctcttttattctctatatttatatccaccaaatctgtattcccctttatataaaataacatcatccaaaattaaagtggcctttgccataatggaaatactataggaaagctagtgcttaacacagtgctaattcaaaaaagcaaatgagctctcctcaggtgtatgagaaaaggcttctgtgaacactctaggacattataaagctttcagatgtgttatggagccttaggctaatccagtgttttccaaaggagagtttttggtcaacttacactcaatacctggggtgctaaaatgccaacatagattatctcaagaagcagccctggaatctgtgctttatcaaaccaaggtttgaaactacagagctaaaccatcaattcccaaaggaaactatagacaagcaaaacatttaaatggattaaggagaatttgagttcttttgaattctacttataattacttttccttttgctgactacacacaatcaaatcaggcaaatctagcaagaatccacagtagatttacctagctgaactgtgtaatacttagacatgaaagctgagtactacgttgtaatacatctttcaggatttaacaaaacattcaactaagcagtaagtcacctgggcttaccaggtattgaatttctgtgcacactggggaaggtctggacctcaaatccaatcctgcagttgaagacaactgaaagtaaacattctggtacaccattgaaaaactggaatgcataaagcattctgatcagtattcttggtctttctttataagaaaggctgaaaatgtctccttctttttgagactttttgtttctttcctaatgaagtccttcacctggatgatcccccttatcaactgcgcttctctttctttttcttatcattttgaatgaatgctggctagaggacaaacaagaactgtgagacatgttccacaaaggtagtgccaactgaattagttggaattgtaaattacaaggaagaaagtagtactcaatctgttggattttggcatgtatcttagcacagcattcaaagaccttcatcttgaactctgtcaatccatcatatgctatcttccctgtcctactgagaatagatattgagggcataaagacagcagtacccttatttggatggagttagggataggatgaacagccatggtgaatgtgtcctgcaactgacctggcctaggtgacctgcatgggtcatgcatgtccactggccatctgttctcaacagaaatgggatatgactcagcctttgatgtgagagaaagtgtaataagcaggtatctctgcttccagctttccacctggaatccctcctcttcaagagttctgatccctttgtaataagtgtcccctcttatttcagacttgctactcttgccatctcacttgatttcaatcatttttattgtagttaacgaactctgccattaaggcaaaatctctcctggaggttggatggcttaactgttagaaacaagagctctgcctgcagtctgacagaagcatattcaaagtcccatgactttgagcaagccacttacctgtgccttcactggctttagtttttccatctataaaagagggttgacaataatatgtgtctggctcacaattgccatgaggagtgaatgaactaatgtctaaaaggcacatgcttggcacagagtaggcattttgtgctactctgtagttacttaatctgtttgattttgaattttgtttgattttcgtattttagcacagcattcaaagaccttcgtcttgaactctatcaatccatcataagctatcttccctgtcctactgagaacagatattgaaggcataaagaaatcagtaccattatttggatggagttagggataagataaacaaccatggtgcatgtgtcctgcaattgacctagtctaggtgacctactgcactatgacaaaaaaaaaaaaaagacttagaaagtcagaaagactttgttaagtcttttatgatgtagagcatttgtatcctcttatatatttttttccaaagtcagaaaaactttgccaagtctttccgtttttattgtagggcatttttatccttgtgtatattttctggtttgtgtgtttgtttgtttctttgttttgagacagagtctctctctgttgcccaagctggagtgcagtggcgtgatcttggctcaccacaacctccatctcccaagttcaagcaattctcctgcctcagcctcccgagtagctgggattacaggcacccaccaccacgcctggctaatttttgtattttagtagagatgaggtttcaccatgttggccagagtggtctctaactcctgacatcaggtgatccgcccacctcggcctcccaaagtgctgggattacaggtgtgagccactgtgccaggcctgtattttctgttttattgtcctacttaacttcatgcatttaattttggtgacccaaatgtttccatgcatttccagacatgggataaattaagtcacagttatattaataataaaagtctactggctttatatcagcctctgcatagctgcaataccttgccactccctcacaatctctcccagctgcttctgggagtcccaaaaagtatctcacctgtgctcaggagcatatctgatgatgtgcttcttctacctgcccactacctgccctcccccttgaggatgcagccttgccacagactttgctgctgccttttgtgagaaccagtatgactctctcacactcagaggtgcaggacccacaaggtgcacttggtgtaagatcccttcaggtctcattgtgccagagaagccacatcaggttccacattaaagttgcaaggacaatgccctgtccccagctctaaactgcaagttgtcaccaagaccccaagtaacacagcctaaagcctgaaccatgagttctactatagagcaaagcagctacatgagctaatgactgaatattttgcaataactccctgcttctggccttagtcttctgcagattgttctccaaagagctgccaatttggctgtgttaaagctttagccaggctatttcattgtacttaaaactctctaataactgcctaccttgcttggaatagataccgaagtccttacgttgatctacaaagtcttgcgtgatctggcccctgctacctctctgatctggctcctagttctctcccattcacaccacatcagctctgtagtttccaggcacacactgctcagctcctgtttcaaggccttggcatttgctgcacccctgaatgtggggacaaggagaacagagggcaaattataaaagaccttgatgctttactaaatgtttgaagtttattccacaaatttcatataagtaaacctgtacttacctgtacataagagagaattggaatgcaatacaacctagtggtctgatgcaaattttttggagtcagatagagatagggtctccagatttagcaaataaaatacaggacactcagttaaagttgcatttcagataaatagtaaatgattttctaatataatcatgtcccaaatactacatgaaatgtaccaaaaagtgttatttaatttgaaattcaaattcaactgggtttcctgtattttatctggcacccctacatagaaatggaattgaatactggccttgaacaaactatttaacttctttcagccttggtatgaaaatagagtaataatacccacctcatggggcttttgtaacgattaaaaaatataatgcatggactgcacttagcaaagtcactggcacaaagtaaacaagtaaattgccgctgttatcattattgctattgttatgatcatctcattttgccagtgaagctttcaataaaacattacattcctagcaacataatcttcatatgaaactttgtatttttaaaaaccctggattatccaaatttgttaaaaaagcacttcttatttgataagaaagacttcaggaaacaaatgtaatattctgagaagaattatgatttgatttcagtttgttaaatttttatttgattgtatagctctcagcacattcaattcaaaacaatttatttttaaattccattcttatggctttcttttttttaataaagataacactaacagtatcctgtgatgatatagggcttttgcttcagtttttgctatagatttgttctctgactcatgtgatctggccatgaatttagtaacagatggtaacttgtggttttatgaaaaccgagtatgtgagaagccttacatatcacattttctttagtcacccagacacttattcattaaaataacaaccgaaagaatttttaattaaataatggaaactcagtaatgtgccagatattgttggttgcttaagattcaaagaataagacctactggtttctggtttcacagagctctcactgggtagaagagaagatgttgcaaccagaacaaataagtaaaacagtatgataggtaaaaatgtcacataagtcatacaatcgggtgtaggaagtgagatgatagagcagacttcacaaagtctgtgtaacattgtagttggttcttgaagaatgaaaaaatgtatgcaaagtaaaaaagaattagatggcattccgcatggaaagaacagtatatacaaggaagaaaggtatgaaagaattggggaagttgccagtttagtttggctaaagcagtggaactcagaggatggcccagaaccagcagcatcatatcatgtggagtatttgttagaaatgcagattctcaggctctaacccaggcttactggatcagaaactctggggcggaccccagtcctctatgttttaacacgcattctaggtgattgtggtgcctactgaagttcgagaaccctgaagtacaacagtagagttttcaaaactgagtgcacatgacatcactgagggtgcatctttcataaacaccaatgacaggggccacaagccataaaaattaaatcagagtttcagaaggtggagcccagaccaaaagtctaaagatgttttactgtgcagccaaggctgagaaccactgggatagagcacatggtacatgaagaagaaagggcaaatagacacttcacaaaagaggtaaacacatgaaaactcactcaaaatcatcagtcttcaagaaagtacaaattaaaaccacaataaggtaacactgcacaccctcactcagactgaccaaaattggctgctataactaaatgctggcaaggaagtggagcactagtgtatcattgcaattaaacagacagaggttgcctgaagggtaagggtgagggtcagggattgactttcctgaaatgtcattccgtacctgatcctggtgaacacccacttttatttcactactcggttttatctggaaaccttcctgaaatttcaagttactcaggcacatcctccacaactcctgcaaacctctgttaggacacttccttcagtgctgctaccactttttaaaatgcctttctcttcaactagatttaaaaccgtttgagccagggtgttcttttttctttgtggatccctcacgcatagcacagtatctagcatttgtatggggatggatgagtgagtagactgagggatgttgggttacctgatgattttgacacaccgtgtcatgactccatgcatttacatatgctgttccctctgcctggaataacccattctaccttttattttgtctgtctggcaaaaacatctcctctcttaaagatcatcattctgtgtcacccattccataaatctgtcccccaacaaggacacatccatttggatttgcttctttctttaggccatgctttgtacatagctcctcacacttaacttactatattgtaattaatgattttccttctttctggatcactgatttgtacatttctcgggggttatttcactttgtatttttcctcagtgtagtgcttagcatatgttaatgttcataaatatctgttaaagaaagagagaggaaaatgtcctcagactacctcaaacatattatgagcattttaagtgcatttttattgtctgtcataatcagattgtgttctaagtattacttttgtgtgcatcccctctgtgattttgaggattattatacaaagaatggaagcaaacagttttcattatagcttaatcactaggtcattcaggcagcagcctgagtcttgaaggcactgaggaggaacaacagaaggaggcttaaaaccaacacatcaaagtcaacacagcagtattgactctatcgtgttggttttcagtggttctgaaatattgtctcccacgagtgatagaaatgcaaatttgaagtaacctgaatttagttagcaaagctagaatgctgacttataaaacaaaccagaaaataagacttcctctcactcctgatctacaatttttaaagccaaaagaaaagagtcacaagttcataagaaagtaaatttcagaggattccaaactaaagtatgcccagataagtaagatagatgctgtgatttcaactgcagctatcagtgcagctatcaaacaacgtgatcattaaaaaacaagctttagttctaaggatttttgagatgttaagagtattgtggtagatacacaattttcaaacagcctctcatgatgttaaaagccaaataacaaatctagagtataaatattttcaccatttctgagtttctatacagaggataacacagggggaagagaacagaaagattctggagtcctttggaaatgagaagcagcttaaaaataagctttaaatatacaaaaataggaaaaaatagttacttttctaaaaatgctataatgtgttagaggaaaatggagaaatctaaagtcttaattctgtgagatttcaaaaagctaattatgaaagtagttagaaaaacaaaacaattctgccaacaaaaagacctctcccggctgggtgcggtggctcacgtctgtaattccaacactttggaaggccgaggcaggcagatcacctgaggttgggagttcaagaccagcctgaccaacatggagaaaccctgtctctatgaaaaatagaaaaaaattagccaatcatggtggcacatgcctgtaattccagctacctgggaggttgaggcaggagaatggcttgaacccgggaggcagaggttgtggtgagccaagattgcaccactgtactccagcctgggcaacaagagcgaaagtttgtcttaaaaaaaaaaaaattctccctatcaatatagtaggaaaacaaaattttttaattgcataagcagtaacaaatttacaagcatgtaaggtagcaccaaagtgaccacaatgttagtgtcatagcaaaaatagcaatggatgaagttaaaaaagcaaggaagatttaagactgtttcaacagaaatcaagactattgtagtaagagagagattgaactcagctctgctgaaacaggcaggagagattttaagcactggggtaactagtggaaaagtactggaggatggtagaggaaggtgggtcagtgtaattaggccatctgtgtttgctaattgctgcttatctaagttaggtttacacctcccacagagactgagagatagaggttgcttcttacttaatgattacagttcaaaggaatgattccaggtccttaagaaatatattcctgggtttatacaactggcaagaagctgggggaagatttatatctccaaggggcagaggaaaaatttacaaatacaatttttctaaagtaaatgctctaagaaaagggaggtcaggagcctatagtcaggaaaaactccgtctaaagttttgtcaagccctcttggtcatcaggacaaaatctcacacattttatttggccaaacagaagaaaggacaattatttcctcaaaagacaaaaaatcgtacctcatgacagttttctgaacaactcttaagagatctcagaggtaattccagagctacatttttacatttgtcaagtaaaaaacaaatcaagacttagtaatgagagacttatttgaaagggctattgcaaggcgggagagggactactgcaatagggagaatgctttggccatgagatccgcaagcatctcaagtactaggcaagaagggtttttcttttatgagaggagtaaacaagattagaaagaacccagggtggagaagtgggatgaaagactggcatactaagtaaatatatcagaggatgttttaccctgaagccagcatattttccaggagggcccttaaagaggggatggatcctggctcaggctgaggatggactgaagtttggggtcctgggagaaggagagactcttatttgattaataagcattttgttctcattgaccaatggagacaaaatagttcagttagtcatgaatgagggcaagagtgggaatttggaggatctatgtctggccttagcataggtaaataagcaggtgtgagtcttatctaaatcaactggagaagggtggttctttgcaataagccatttcccagaacaaagggtttcttaactatcttaatgaggctcacataaaattcaacatcatcacatatccagaggttatttgactcacaatcttggagatgtgttaggccatcctcacattgctataaagaaatacctaagactcggtaacttacaaagaaaagaggtgtaactggctcacagttctgcaggctgtacagggagcatgatgctggcatctcctcagcttccgaggaggccccggaagtataatcatggcagaagatgcagcaggagtaggcaggtcacatgaccagagcaggagcaagagagaaagctaggtgccacacactttcaaacagacagatctcacaagaagtcactcaccattgtgagaacagcaccaagaggatggtgctaaaccattcatgagaaatcctccctcatgatccaatcatctcccaccagatcccacctccattactggggattacaattcaacatgagatttggacggggaacacatattcaagctatatcatatgtctacactgtaatcattggagaatgggcttaatccctaataaaatttattttgatgtcaaaggtaggaggaaggacacagattcaccaggcctccaaatagacactctaaaaatggggaaacgggaagtcagtgtctttgccttttataatggagaaaatcgtttccatttgcccttacaaagtgcagatatacatttatcgattcagttatttgggtttcaggttcagatggacaagccaaatcactgagtctctgaggctcacttccatatctgttaaaggaagtttttttgggttattgaaaagattaaataggatcatgtttatgaaaatccctgctatgggattttgtatgtcaaacttaatattttcctcaagtaacaaaatttagtggacatgccaattataggaagttttagtaacattgaaagaaaaaaattaaaatgatttggtggctcatgcctgtaatccaatactttgggagtccaaagtaggaggatcacttgggcctaggagtttgagaccagcctgggcaacacagtgagactcttattttttttaacgacttggttatggtgtttatgcataccccttgtaacttttatgtcttaaaagtctagaatattttattagtaatcttgtatctcacatcaagacactcttttgaggaattctctgttgagctggggtatagtgtaacaccaaatcatttgaaattgctgagaaaagttgcagtgatctcaaatttgaaagaagttattttcatttatatgggaatactaagaagaaaggaactaatcaagataaaacagttgatacataattatcttatttaaagagaagggtttgtcattatttagccatacaaaatctgaccacaaattctagatctttgtattttggtcttttgaatcccaccccatccccaaccctaaccttcaccctttggtaccttagtctcctcacattgccctaaacacagagagacagactagaccactcacaggcaggtgactgaacacacacacatatgagggagttctatgggggagaagtggcatcttctgcctgcccaggaggtaactcccattgttctataaggatgagtaagatgctacatactaatatcagtaacatagggttcttaaatagccttgcacgtagtttgcccagaatgcctatttttgtgtagggtgggccaaacccgtattatagttctatgatgccaagccaaatttattaaatcaataaactcttctaagattctgagaggcaaacaagtctttcccgtcttgtaaattattcccaaattccaaagggcaaaagctattggaaaaatcatcttagtgacattaagagttttatgcaacagaataataattagtctagatatgtgttttgcccttaatgccatttttattcactcagccagcaaatacttattaaatgattactgtactcaggcaccattgtaagggctgagtaaaaggaagtgaataagaaagaaaaaaacctcttttggggagaaagggttgcaggcaggccgcttcattctcaaatcgcagattatattctaaaacatatccaagattcacattctaaaatatactattcaacctgaacacattctataaaactaatacagtggagtatgactggagtattaaattcatttttacttcagtgcccattgttacgcctcattgttatttaaattcagacttgtccattaaaaggtctatttgtaattcactgaaaaaaatagatgatatgatagatattgtaaatagaggacttatcaagataaggtagaaatatgagcacaaggtaaattttgttaaccatcgctaattgacctgtgctttctaaatttctaggtttaaggaaactagtattaaaacaatgtgatttttaatgccaatatttacacaatttttgtaagaggtaaaatgtaatttgagcaaataatgtaaatataagagaaccaaaagaattttatttctataagaaaataatttcaaaatatgtgaacacatgcttatgagtatgcttaaccaaacctattacatatattcaaaactatttccattttctgttagccactcatgagaaagaaatagttcacgggttgtctagtgattgtagagttgcttcatttgacttttaaagtatcattttaactagaattacctccagtttatgggaaaatgtaaagactctacaaattgcattggttaaaagtaatcctaaaaaatggcactgtaaccatggaaatatcatttagactcataaaattttaaccacactttttttttattccctttctggtttctatgttgcctctgttcactgtggcatgttaggtgcatattccacccaattttcttatgacttaactgtttagtttttaaatgggagaattgtctgccagtgaagagagactgaatggaagaacacttaacatgagatctaccatctttaaaacattttaagggtacgatacagtattgttgactatgcaatgttgtacagcagatctctagaatttattcatcttgcttaactgaaactttatgcccacttattagcaacaccttcatttctctctgccccctggtaactaccatttcactctttgattctacaaatttgactattttagatacctcatataagtgaaatcacacagtatttgtcttactgtcactcagcataatctcctcaaggttcatccatgttgttacacattacagattttccttcttttttaaggctaaataatatttccttgaatgtatataccacactttacaaaatccatccgtcagtggacatttaggttatttccacatcttggtgattttgaatagtgctgtaatgagtgtaagagtacacataactctttgagatcctaatttcaatttctttggataaacacacagtagtgggattgctgggtcatctgatagttccctttttatttggggagagggggacctccatactgttttccagagtggctgcattatattgcattcccaccaacagtgtgcaagcattccaatttctccacttatctttgtattctaagaatacacataaaagtaattctctttatcctattaaacaatgaatttttggattcctgacacaacaatgttctattccttgaattttctggcactaccattatatgaatactattttttttttttttgagacagagtcttgctctgtcgcccaggatggagtgcaatggtgcaatctcagctcactgcaacctctgcctcccgggttcaagcaattatgcatactattttttttaattatcctcatttctttcttccagagctacatgatagtaatactcctgtttcctacaatctataagaacactggaacctttagttgtgtgtttttttacattccaaacctaaaatgttttgaatacgtaaaatattctacacagaaataccagaagctatttatttcttagaaacatccagcaattcattgaagtaaagtgttaaagtgtatacatattacacaagccaattcccctacattgtatttattgaatagattaatagacttttctgggaaaaggtaattaactgtaaatgctgacctctcactgccttttccagaggttgttgaacttctgtggcctaagtattttatctgccaaatagctagaaattcttttcaagtttattttttaatgctccaaatacaaatataattgattcatttcccagtgtttcacaggcacaggactttaatgatttttttctagctattttttaaaatattgagtatgatgagctgtaaaaactctaaaaacagaataaaaataaatgaatagacaaaagacaatgttcatttgataaataccagggcaagaaatttgtacttgaacaagctaagaaagtcattaacagcagtatttctggaaactaatggtatacctgctcaagctacactgaatctaataatctgtgacaaaagaaatggcaacaggtatgaacacatttcatttaatctgaaattgaaagaaaagaaagtggggcacttttcttccccaacttttttcatacctcaacagacaaaatcacaatggaaaagagatttattgccaaaatgttgctgaccttttacaattcttgccccatattctggaagttaattgattaaaaaaaaaaaaagtacattttcatggactggcacaaagattttatccagatagcattcaagttgcaaagaggcatcctctagctcagtcccttgcatggtgcacctttgtcacccaccagccaggactgtgcccagctggttctcccctcattaagtctctcaccggcacaaccatgctgcactatcagccttgccctgcctaaggatcttcccttctaaaccttcgctgtctttagaatgtctctgaatatggaaaatcacaagctccggggttgcctgctccaggatagcctgagatgaaatgaaagttcaggcctttggaaagctggtaagaattcttttcacctggaatctgataagtatcccggaaaccttatgcatatttgatattttctgccttgccacagttttaggaatacattttaataatattaagtaacatttcctaaaagtaaaccttcctagcctgtagtctactggaaataatacctacccctgctatttaaagctgtgtgaattgaacaagttctggaatcactttgggccttagttgtttcaaaaatgtggaaaacagcttatctttaaaaaggcagaaatctgagaaaataagatatagcgtcacacacacacacacacacacacacacacacacacacacacagtgaaaaactgagaggatttttattttattccaagtcaggaagaaacggaaagaaaacaatactgtttccattttcactaccttccaggaacaatgctgagttttttatatatgtcttgtcattactgcctaaaataacttcgaggagtagctatttcacaaataactgattttagaaagattaagtaacttccccaagctcacactgctcataagaggcagaatcaacctgcagtcagggtccgtaagattctaacacccttagatattttcattgtattagggtttccacaaattttattaattttgatatgtatagtacccttttggtttgtgccaaatctatgcatcagtggtactattttttacttacttattaaattacctcattatttaaaataaatgtatcttttacactaaactttagttcactctaataaatgaaaaaccaagcatctcttttcataagttggagaaatatttaaaataaatataatgaaaggacaaaatttaaaaaaaaaccttgatatttgtgaccaaaaaaccctgtgttcctgctgtcctctcctgtttctctctcaatctctctttctcccattaaaaagaatagacagtactagagaaatgttaagactgacacaaacataaactttctcattaatgcaatccaaagaactggaagagcagtgttctcactacatgagtcaatgtttatattttattgtatattgataaattataattgcatatatttaaggggtacaaagtgatgttatagtgtatgtacacatatgtagaatgattaaataaagctaattaacatattcatcaccccaaatacttatcaatttttgtgatgagaacatttgaaatttactatcttagcaatttcgaaatatacattgcactgttattaactatagtcaccatactgtgcaatagatctcaaaaaacttactcctcctctctaactgaaatcttgtactctttgacagacatctccacatttccctcacctccctgtttctcgtaaccaccattctactctctgcttcctacctctgttttagattccacatagaagtgagaacatgcagtatttgtctttctgtgcctggcttatttcatttaacgtaatgtcctccaggcttatccatggtgttataaaagccagtccttccttcttttcttaaggctgaatagtattccattgtgtatatatgccacattttctttatccattcacccattgttagaaactcaggtagatgctacagcttgactattgtgaataatgccacaataaatatgagaatgcagatatcctttcactatgagtcaatatttttaatgaatcttcccatataacaatatattgggcagccctagcagtttgtgcatctccccaaaacccccgggaaatgcagagctcaatcctgctgatctgcatttcgtgcttgacaagttgatgtcactgaatgatattctgactggatgtcaccctccagcacttttttttttttttgcgcaactttctacttgaagttggaagaaactctgcatgcagatcgacttgttatatcacattggaaaagtaccccacattttacagagtttgatacctcacaattgttaaaagtgagacagcatttccatgccatgtattccaaatccctgaggatctcagcaggcagatggccctctaggtcactagccactgctgacaacatggatgccctcacctgggctctgtctgtgacatgtctaatgatttccatcaaaataggatattgccttctcaaatgtcctcatttttaacaaggaaagcttatgacacacacaatgaaaagaacacttaaagtcataaatactgtatacacatttgtttctatagagcaagttgattgtagagaagctgccaggctagtgcccaaatgttcctgagatagttcaataaatatctctttacaagcctgttattgcctttcaaaggatgtaaggtctcaacattcctaattaataccataggttttgtccaaagggaataggaagaaattaacacaaaaatactgaaatagatacaaataattttgaataaaccttctatttatataacacagaactggttgagcattagctgctaaatataatagtattactatttgggtaacaatgatgttgagagcttaggcatgatctaaattgctgtaaataggagagagtgtatgacacacaatggtaagaaataaaggctgtatgaacaaagcactgggttagttacagccaaatatgaagacttacgtgacttgagcaaatgacttacctctctgtgcctcagttttttaatctataatatgagtataaggatggcacttccctcatggtgctggtgtgaatattaaatggaaaaaaatatttaaagtacttaaaagggggcttgacatatagtaagccctcagtgcatgtaagtttttaactaaataagttaagcctcaaagtcttactgccaaggaaaaagcagtgacaaaactatttaaagaacccaggtatattaaggagaaaatttcagtttggtgttctctaacaattaactaacaggtcctcatctcccactttaacctaaagaatcagacactcatactttgtttcaaacaatagctaattagattttaataacaaatgaggttcagaaaaggatggacagaggaagaggctgtgtcacagtagagaggcatccagggtatgccagttataacatgcccccttagcacacctacacaatgctttggatcaagagaaaaacatttttcatgacacttgcaattacaatcaaacatgaagcaggatggtgtatgaatttccatatgtacattctaaacatggcatggttctatttgtactgccaccatggaaaaattagatatttttttcaaatgaaaactggaaatgaagaaaaagatgtcagagaaagatctacttcttctactctgttagtcatactatcaaagtcttgggctataagatgttaaatgcttaaaatacatgatctaatatcaacaggggtacctaaaatacagacagtcacataaacatttcataattaattacgctgataggtgtcatatgttattatgtctaaatgagacagctttcaaatctcaaaacaaaaaatctgttaccatcaatgatgatgttaagggctaaaaagtttataaagtaaaaatatatataagagataagtatgaattctacataaaaatcaattacatctaaaaagcacttgaaaatgctctttatataatcatgtgcatagcttctcacctcagtactgattgcacttcagtcctctgaaacttacctgtgtgccagagaatcaatctttgttcctgtaaaatataaaatatcatctgtttttttaaatcatttacctttgctataggaaaaataatattaataatataaatttaaatcacctgaaattgtatatttatatgaaaactaataactttgagataaggcccaattattctaaaactttacccagaattttaaatgatttcaaaatttaagatatatttcattttctgatattcatgggcatgtttgatctccattatttactgatactaagcaacaaatagatttttctttgagttgtttctatcaacttaaagagagtaactatatctggaagtattgatatattagattgaaaaatttagccaaaaagaatgacgtgagcaagatggcagaataggaaatctgaggcttaatttccttttctccccaccagaaagttcaactagcaactatccattgcagaataggaaatctgaggcttaatttccttctctccccacaagaaagttcaactagcaactatccattgactagaatatgcttttgaaagattcagccatatcactaattttttattcctatgcaagatatggtattttctatataagtaataaaactggttatatcttttcataacccaaacagatccaatccatgagtcaattacattgaaatattcaatggctatttgctattattaatactttataagtatgcagctattgatagagcatagagataagaagatttggtgaaaaatatactgatatcttctattgtattctcacaacacagaacacttctatgaccaaatgtggtggtagaggggtttccccacaaagcaagctattctccagtggataccaactgggtgtcctatagttgattcagttcacagtatctatctggagatagcatccgaacccacaggttaaggactcagtcccacaagaccacccttcccactcccccatttcatgtaccagtgcaagtcccagctttttacctgtgctctgccctactggctataaatcaaggttcccatgtaccccctccttgtgttcaatatttttctaggatggctcacagaactcagggaaacacttcacttatatttactggtttattatgtaacaaaattataaacaatacagatgaacagccagataaagagatacataaggtaaggtctggaagggttttgagcacaggagcttctgtcccagtcagttggtatgcaccctcctcctggcgtgtggctattttcaccaagtgagaacctcattaaatttcatgttcaagagttttatagcacttaagctccagcacctctcactttccttgaggtcagtgggtggggctgaaagttcaaaccctctagtcattcagtctttctggagaccaacactatcttgagactatctaggggccttgccctaagtcacctcatcatcataaactcaagtgagagcaaagggcttgttatgaataacaaaagacactgctatcacttaagaaattacaagaactccagaagctctgtacaaaaaccaaatattataatgaaagatgctcctatcacccttatcatttaggaaattaaaagggttttaggagctctgtgctaggaaccagagactaagaccaaaaatatatattccttattatgtagaagaaaaaaatacagaaatccagtttcaaaaaagcattgttcatcacccccttaaaaaggtcaataatgtttatttaaagtttattaaagttatgtgcacatatgcaagtaaatattcacaattcttctttgtgacccagaagctaattccctgtgctctttcacttgctgatattgttagcagaagaggatctccaaaacagtgcaaaagatgcttgccgccattggcttcctaacgctcatttgccaaaactctgctaatcaaaatagttcccagtgcccaaagtaaatctaaaagtaactcccaccaaggacccacgtttttagaggaaggtttgttgggaacatgtcattgccaaccttcacacaaggggaatcaatattctgtcatgttgatttcaaatcaagtatttatttaatgtgaccctcaggtaagtgcagaaatatgtgattgtgtgctggatttatttgatcaccttcagtaagaccctggtcaagtgactttctttctttgtgtctcaggattctcttcattaaaatgagcatttgtgaaatacagtataaatgatttagttttggatgtacagtgcagacccaggatggatggatggatggatggatggatggatggatggatggatggatggataggtaggtagatagatagatagatagatagatagatagatagatagatagatagatacacatatacactaagtaacaccacaccttgtttgctcagcaagtaatgccaggtgtagatgatacaacagaaagaaagccaggcaaacacagtgcccttcctctttatcaaagttcagtctagtcatcatgagtcttgtggattaccccagtcaaatcccaatgaacagatgatgttagaaccttttgttcaggtctataacatgtggcttattagaggaatctgattataaaggaaaaagcccttccaattaagtttgttttcttatttgggaacagatttgttcacaaaaatctaggagagaattcaacttttactgaattatttcaataatttattgaataaaaatgctctaatgttttatttatcttgatctataccaggataatcatataactgacgatttttctaaattctatattctcatataatgaataaaggaaaacataggtaagtgagttggtatctgaaatctatttcaaaaagtaacctgcagaggatatggcatgatcattcataaaacagattaaacccaatttccaattccttctacatctgttataattctggaaattcttttataaacatgaaatagaaggtactacaagactctgaaattctgagttatccagtattctattatatccagcataatttgagtgttaaaagtgttttggtaatattacaaagctttaagtggttttttttaaattacctatgtttcccaaatatactgatttaaaaaaaaggagggttatgtataggataatagtgtatttttttcaccatactatttcacttactgtcagattaattttatgcaattttaaaaatgaagtcattttattatattgtaatctttgaatgtgtatacagtaaatttaattaaatgaaaattgttaaacaaccgtgacaacctttcccccagctattcagaataattatgagttaactatatgttttcaaagggcttttaaaattattcctgtaaagcaattaattccaaataacatttttgttggctataaaatgatttttaaaatatttctacttgtagtacttgtagtgctaaaattaatcccataaggaactgtggaaagcagtcaaatgtgtaaaatttcaaagttcataatcttagcattagtcagcacttggcttttcgcactagcattaacttaggcaatttagagtactatcctaaaattatcattatcatttctagcattgggagtaaataacgatttttagacactacataattagtatgaaaaatcaaaaatcgatgcatgatcaaacataaattatgtgccaaataaaactactataatctatcaatgcaactagttaaatatgattgtcagtgatcccaaaacactcaaaatacaatcatcattatcttcagaaagtatcagagtacaattggaataaaataagagaaatgttaatgtatgtgtaagagaacatccaagcaatgtgactaaattttttgaataattaaatttttacacattttaaataaaattatgtaactcacgataattttactataaagttaattgttctttttacctaatcaaagtagttttacaacataaaaggtctttttcagagaaatgccaaaagcacgttcttaattaaaatgatttttaattagttcaaaacagaacttaaaaaaaatttagacagaactactacaaatcagggaaaagcaggtagaagtttatggaaaaatcctagtatgtttccactaattccatcccttatctcctactaattatgagggtatgtattttcacataaagattatctgtgctataattagtggtgttcccaggctgcctcactacaacgcttcttcccgcaattggtcagaacagaatatcagagaaagctctagtctgggcagacaggcaaatcattcattctctgatataagaactaataatcaatctgaggatgattcttgcccaagaacctacctcactgatttataatagaaaccaaatgaaaatatacatataaactgtttttataaacttccacccactataagaataagtgtcattatgatgattgtcacccatgcccacaagcttagcccagttccagatcctaaacacccatttccatactctaatgatagagactgcatagtctatctggagggaattaagggagccttagctaggtaactcagctgtctttaatgttgtttctaaaaccaacccacctcccactggagttgctttctgccttactctctcttgccatcttagaagatctcacctgaatttatagctcaaaaccccctgacacttcaatacctctcacattctgcctggctatcttactgatcgtcatactctctagatttttggcttaatattaataaatagttcagtcatttagctgatttagactcaatgtaacaaattcttttctaaccacgattatctacaaatagagcaagctgccttaagagttctgtatcatttgagatagacaagacacagctacatattcattggccatgattactgtaaaagacactgctgctctgtttgcaagattagacaagatcactgtacgatactaatcaccagcttcaccactgaaccactctgattctctgatgcttctggagttacagttctgaagacatcattatggttcctgacatcattacatcttatcaaactaaaaaaattattcctgtagaatccaaaataaatagaatcttattagaaaattatttgtgatttcagttaaatgaaatgtactccagaaacacaaatgatctgtgtgtctagatgttaaaactattactgcactaacatcttcattaaagacagtaggttttgttatttcatacagaaatggaaagataaaaaggctaggaaaatcagccattttctatagtatcatagaatttaagttactgtatatggtatgctaagatgttttattttctttcctaaaactgaagctaaacataaaacaatactatgaaacaatcataaaaggaaaaggaaaaaggaggaacttaatgttaaaataaatttaactttatttaccaaatccacagaaacttttcctataagtattataaagtgactgtcaaacttttgcatcatgttttactttagtttataagattgatttatcttatatcacatatcttgtatcttataaagtacatcttcataattagacatagaaaatgatatcattaactctgaaaaagagggttctttttttttaaatcacatatggtaagtcatatggtttggctgtgtccccacccaaatctcatcttgaatgcccaagtattgtagaagggttctggtgggaggtaattgcgtaatgggggcacatctttcccgtgctgttcttgtgatggtacataagtctcataagatctgatggtgctataggggggagtttccctgcacaggctctctctttttgcctgctgccatccatgtaagatgtgacttcctcctccttgccttctgccatgattgtgaggcttccccagccacgtggaactgtaaatccactaaaccctttttccttataaattacccagtctcaggtatgtctttattagtagcatgaaaacagactaatacagtaagccatgtcccaaaacaaatatccataaagaatatggtagttctaattataatttatgttagtatattgttttcaatttgaaatcaaaagctctttatactgtgtctataaatcaatcttataaactaaagtaaaacatgatgcaaaagtttgacagtcactttataatacttataggaaaagtttctgtggatttggtaaacaaagttaaatttattttaacattaagttcctcctttttccttttccttttatgattgtttcatagtattgttttatgtttagcttcagttttaggaaagaaaataaaacatcttagcataccatatacagtaacttaaattctatgatactatagaaaatggctgattttcctagcctttttatctttccatttctgtatgaaataacaaaacccactgatttgggcatttgtgatccactatgctaaaaagccctgttgtttcttggtcttttttatttcatgactattgtgagtcagatggaaaataggataaagacatgagaattactgagcagaacaatgggtttgagttataaaactgaacagttaggaggggcagggaaataaggacagagaaggtggaatggagacagggaaaaaagcagtgagcatgttcagaagacagtttgccagtgtagtcacaatttaccaagaatcactatagacaatgtcaagggttagcccaatttacattcaagcatttatcctttgtgttacaaacaatttaattattctcttttagttatattaaaatgtgcaggtaaattattattggctgtagtcaccctgttgggaaattacatactagatgtcactcatctaagccttgtttttaaagttaaaatctcagatgattctcccctgtgttttctgattcactgtcctatactctaaatggccatcaactcaggaatagagattattcagcctccaagaactacctaatggagcagtttcctccattggtagttattccaataagttactactcattttggttttcattccattacagttttttgatatgattatttgagcctaaaaatgtaacgtaatttggttcctaagagtttattaacagaagacaagttttaacttatgatgaacagtaggtgctgagaattagtctgtgttacttaaaaatttgaattgaattgtatctcatttagaatgagggatttgtgaaagccaaatatattcacattgtctataaaaagtgtgagtggctgaatgattactcaagaaacatgatccatagtggcaacaagtataattgctgttcataagactttgcttttctataaagtgttatgtgacctgtcttacctacagtttctttcaccttatttgcatttatatatgctccctaaaaatacagatgatgtaaatttctctaagttcttattagttataaatctgaattagaacaaaaataacaagcattcctgctactgaagaagtcataagacttatttaaaagtatgattttctgggcagagtgtaaataaggtggatttattctatatattgctgtactcttttatttcaaatatagtaatgcataaagtttaaaattaaatgtgccttccatgtagattaatactatccatttcatctttgtcaagtagaagtaattgcttggttcaatacaatccagtcccatccgagtagatctctttgttctttttcagaaatgggagagattgagagtttaaaaagcattcatcatcaggagaatttgttttaaaagcttccaagctcccaaacagccagtagataaattacccactattcagagaaagagagcacaattagttttacattatactaaaacaatcagctccataagtgactatgtttcttaagaaaaaagcaatatgaatgtcatagtttgtcctctttctcccaggctttacagccaacagcaagccttttctcatactagaagttttatggaaagctttgtgaatatgttttgacattgtttttagataaggagaaatatattcatgacttgtaaccatgtggttaataatacctacttcacaatgcaaagttaatgagtcttttgttttattcaaatgctttgaagctttatggtaagaaggaagacttcaataaattattttcaaatctacctttctttccccaataattatttttatgtaattatttacaactaagaagcaaaggaaggtgtaagaaaaaattatactgggggtaatgaattatgcacaaaaaatctacaggttgtttttttcatcttaacaaaatacatagttgctaaacagtcattacctcttttgacacatgcaggatggtgtaagaatgtactaaattcatgtcaactgccatgacttaacctggagaaacaccatgactagtaagctttacatacacagctgctacagtatttttagcattttccatttataataagaaagtgatcaatggaggccttagaggaaagagtgcaattgcaatcatataaatagccttatttccttttttgcacacaagtggtatctatcaaaattcaaacattgtaatacctattttcatatatcagtgttcatctatgggttacttttattttattttttaagttattcattctcataatgataattgatcattgttgatatgtgcatgcaggtcatatacaaaacttcctttacaccacacaaaaagtagtctacttatgttgtataataagttcgaacctttgtgccttaagtacaaaactgactcttctcatgcacataaacacaacctggaactgcatgacaaacacatttgaataaagctttcatttttcaaaattcatatatatgtgatcagtgtacagtatgaattgggtaaggagaaagagagggaagagaaaaggaaaaaggcagtgaaggagagaaatagagagaaagagaatatatcaaaatacagtgtcaaaatgtcttattcatgaaagcttctttcctagggatataagtttttaaatgtgtctgactatagaaaagactattaagtgggtatgttttgttttagatcagtttattaaattttttttcatgttagacaggtaatgtgccaatatcataacaagatttgagggaggcacatctcacacatgagtgtgaaaattcaatcatcacattcactgagtctctttcaaccagtagtcttagccaggcatgaaatctggggggctgcaaacctccaaagaaattctcaccacccatttgccacactcagtctttttcataatctttgtatcatggacttcaaagctttaataaataaagtcaagttacctaattctctggctacttataaaaggtcaacatgtcccatcccatctgataccttgatttgcatgtctttgactcttaagacatacacagattttctatctaacccctaagacctttgaagttgatgggataacagtaggtctaatattttttatctaaatataaagacctggaacttgataggattctaagataaatacataattttccccactgattgagtcttgcattattttgtcttcatattcaatttcaatcagttgttcaaccaattgaatttgggctcttacataatgcttcagactcatggttgcaccatgaagtctttcaatgtttctgattttcttcttttgcaaccaagattgtgaaatgcagatcaaagacctgtattggctttttctcctatcccagatgcataaggcttaggacagcactgttcaaagcctcgtagtaggggtatcctatggtcattcttgttaggggcacaacaaagattcacgagtaattgaaatctctttccctagtctagaactttaagtggttcctcctttgacttggacaagagctcaggttgaaaagtaattgctgacctcaggcaataaattagctggattaaaaaaaatcgtaacattccataaatgaaaataattatagatttgcctacaacaaaggacctaagaacctaccatcaaaattatttgtcctaaatatctaattcttcctttattcttcccctgatctaaccttaaaatctaacttacatatcagtatacgcatgctatcaacaataaaacacaaatctctgtattttaaaatttttttttattttctcagtttctacagataaagtgatctgaaataacgcatgatgccacaaagcagaaaagagaaactgtgacaacccccagaaatgtgaaaggaggtttcttactggacagcagcatctttggttcaatttatataaaaacccaaataaataaaatggacagtattgctcagttttagaaattccatttcttctatgttttaagctgtacaattgtcaggtttttatggtttaaattgtaaatgtgttttcccctttgctaattatgttttttttttcagtcttaaaatgtgaaaggcatttatgaatggtaagggaaacactatatacaaatgtatatttgtaaaagctatttttatgattagcatgtttcactgttgatcatatataaagtcaggtgatattgcaattctgtatttaaagcttatttccaacaatgtcatgtaagaaaagatgcatcttatgctagtttttataatttatttataatttatagtttaaagtacttcagatcataatgataaaatacttgaaaaagttatatttctgccctgtataagcaccctttttattaataaagaatgcagatatttcagatgtgatataatagttaaagaactgttggtttgatctgtgattaagttgagcatgctccgctctactgaactaaatgatccaattattacttcagtctgggtatgagattccatggacaagtaaggactagattgccaaggaaaagactgtcttgcccttggatccaaaagtttaaattagtgcatacatcatgtcatttcacctcctgttcctaggaactctccattcccaagcattgccagtgttttccagataatcttagctgttgtcttgtgctgtggaaatggaagaaaccatcttcacagaccgtaggagaattcaacatataatttcttaataaatactgtttcttttaaaacaa

SEQ ID NO: 595 - DNA, 150903 bp, Homo sapiens
ctcagaaagaataaaacatctgttttaattggccagtaaaatacattgcaaatcattagtattttataaacagaaacattaagttataaatccatgttaaaaattgcagctcagtgcagccccaacagctgtgtgtccaaaagtctatttttacaacattttcctccagtatttttgtgacaagaaagttcctatctgccatctagatcaagagcctgaactacagtattttcaaacaagaaccgggagaagtcggtacaaggatacgtcgtgctgtgtatttaaacggcgcttcccacacacctgccgtctgcatcccgggaggacgccctttgggaaaggcctcctcggcagtgtgaggtctggaggggtctgcctggaccccatttttaggatgctcccctccccaataaaacagcagcccccgcccctgccctgcacagcatctgggggttcataacacaggtgcaatactgaccatgggccctggagggacgtctgcaccccgaagcccctgtacctcaaactcagagtttcttcccttctttgattttctggaggacctgcagctggccttcctgagacaggctccattcctgttccatttgccttcccggcagccttccctttagtgggtataggttttgacgttctgagttactttgtatcaaagagctaattaaaaatggtccttcaaaaacataaagaaaaacagcttgaaaaatgtacatttctatttttaaaatcttcaaacttccacggggggtggcaaatgttaattctgattttaaaccccattcaacagcaaaacgatgtgggcttcaactgtgggctccgcagacgcctggagaagctggagcccacacctttccctccaagggactctgtggacagaacccgtatcccccaagcaccaaggacatcctcagactgggacttctgtgtaattctgcacctcccagccataaaactgacccctcagccaggaatcaaacgaacctcgaaagtggaacagggaggccgcctcccatggctgcctggatggcaggcacagtgggagagtaatgctctgaacctcccaatgtgatgaagccgaaagccgaggcggggccagcaggcctcccgggcacagagccacagagcccagcgtcacacgcaccgtgcacgcaagacagacgtgcacgagactgacgcacacacggccggaggtgcatgtcacagtcgactagacgggccgtggctccctgaggctggctgtggtgtggctagggcacagcccacacttcctgatccttcagctgatccccagatccccacaaacaaggagcaaaaagcacagaatcaaatgacgacacgttccacagggccaggtgggctttctgcggagggcgtggcggtggtggcagcggttctgggagagggaaaccccagcgccacttgtctatgggccgggacggcgtgcatctcactttgccggctctgcgctcttccttctcttctccctcccaaaggctgcggctttgcatgggcagcttgctggcgccactgggcgcgtcccgcagactttaaatggaatgagtggaggtctcggactgctgccggatgtagttctggaagctcttgtctccgatggggtgctccctgaaaagggggatgggagagggaatgaggcacagaccccgttgcctggtgctcacccgtggctgcgggagcttttcctgttcctaaatgtgacacactcacactgcaatccacacaaaaaatagaggagccaaaggaaccacagtgcccccggaagcacccacggtgactctgatgtgtgtgcacaggtgggtcaggcgtgcaagtacatgtgcacgtgtgctctccctgtggcacgtgtgtagcgcatatacatgtgcagatgtggaatatgtagagtgtatggcacgtgtgcagaatgtgcacatctgcactgcaaagagtgtgctcatgtgtggggagcatgagctccagggacacagatctgtcccagtgctgggacactcagcaggcgtgggcacctcctccccacatgcacacctccctcataccatgtgtgtgcacctcctgccatgtgtgtccactacctccatgtgtgtgcacctcctcctacgtgcctaccacctccatgtgtgcatctcctcccacgtgtgtgcacctccttccacgtgtacctcctcccatgtgtgtgcacccctccgtgtgtacacctcccacgtgtgcacctgtgtgtgcacctctgtgtgcctcctgtgtgcacctcctcccatgtgtgtgcaccacctcccacgtgtgtgcacccctctcgcatgtgtgcacctcctctgtgtgtacctcctgccacgtgtgtgcacacctcctcccacgtgtgtgcacctcctcccacgtgtgtgcaccacctcctcccatgtgtgtgcacctcctgctgtgtgcgcctcctccatgtgtgccttctcccacatgtgcgcacctcctcccacgtgtgcaccttctgccatgtatgtgcacctcctccgtctgtgccttctcccacatgtgtgcacctcctgccatgtgtgtgcgcctcctccgtgtgtgtgcctcctcccacgtgtgcaccacctcctcccacgtgttcacctcctccgtgtgtgcacctcctgccatgtgtgtgcacctccacccatgtgtgtgcacctcctgccatgtgtgtgcatcttgtaccatgtgtgcctcgtgtgcgccttctactacaacaaacagcatcatgcttcgcgcattttcaacctgctggcttttggccatgaggttgatggacctgctgatatcaacgaggcaacatatttggaaggcaaatggggctgtctccccagaagggtgtcgagagggatctgatatgatgatgtcagaggtgaagtcacagcactcaggaggtgttgcaggctcagtcccctgagcaactcggtccaagtccgggccacagggacctgtcactctcctggagcctcaccactgcccttcccagaccagacccgcatggtggaaggaaggaggggttaagaaggaaggaagggaaggagggagaagaagggtggaggaggagagagggaggatcgaagggagggaggaccaaagagaggagtgagcaggaggatggaagtgaggaggaggctgtacagctacacagggctctagggcttacccgcccctgaatgagcccgtgtgggggcttctgccatggtggacctgggtacccactggatggagagagtgacacagacacatctgctcactccaggctaagagccagcctagcactttacatagtttaagtcaatcttccagcaactcatgagggtcttacaaccctctgttccatggagtgagggggagtggagcttagctaagcgccacctagcctgcagctggtgactaagctgaacgtactcaacctcgccacacctgcctcatgagacaagagtgggtttcgtccagagctggccctgctcccgggcaccatgggtggcctggagagatgccagagggtgtgccactgaaccaaggcagaacaagacctgggcctagagactgccagagcacgtgacaccagtatagcagagaggctgggaggaagcaggtcagggaggcagcccggacgctggctgggggcctggagagcaaaggcagcacctgctctgaaggagggaccagcagcgccgggccacgtccactgactaccgccaggtgccagcccggtgcaagtgggactctcctcccaggcggacacctgagcacgggcggccccacccgggagctccctgcagccccacccccactgcaatctcccgcccactacactggccgtccagggcaggcacgggagtggcactcactggcttccatatttcgtcttcttgaacttgtccctcttatactgggcgtgctcctgctccaaagccccaaccccagcgatgacttgctttagcgtcttgtaggtctcctgggggtcgtcaatgacgaacgtcgaatactcctcctgctccgggccgtcatacacagatttgctcccacaggcctctgtggagggcggaggggtcagcgcagggcaggagcccaggccaccggccccgtctccacacagctgcgtcgctgcaggccccacccacagtacacatccttccaacgcaagctcctccagaaagggctgaccaccactcgtaaacgcagacggagatagaaaccattcccgcaggtaggcgagttgtgcccacactgagcccagggaaagcccattgggagctggatgctgagcaacctcattcacctctgagggctctgctgcccctagctcccagccttgtcaccaatcagccattctcacagggggatgtgcacatctctgcacgccccaccagcccgcccagccagaaccaggaggagagacacctgcagctggacgctgggctggctcatgggccctggggcagccctgaagagtcagctgagggagtgagcacgatggggttcagcacatttcacacccagctgccactgagcatgtccagccaggacaggcctagcccagggctggccgagcacagggcggacaccagtctgtgccgcagcttctaaagaccactgccccggaccccacctacgcaccggggccaccttcctaatcggaccacatcactcctgctgaaggccattctggtgcctcgcccctagcggacagccatggaacccttgagccagggcagggccctgtgccacctgagtccaaacacctgaaccaggtacacgtctctgcctcactgctcacagcgcctgggcacgcactcccggagccagcaccgatgccctgcagctgtgtccatctggatggaatgaatgtttgtgcccccaaatctgtgggttgaaatcctaactctcaagggatggcatcaggagatgaggcctttgggaggtgacaaggcgtgagggtggaacccttgtgcaggggatgggcgtccctatagaagacaccaaggaagctggcttgcctcttccacatgtgaggacacaatgagacactggcgggctgcagcccagaagaggacccgcagttaaaccagcactgctacgcccggatctcaagcttctcaggccttcaatctgggaagtgaattcctgctgtctgtaaccacccagcctatggtacaatttttacggcagcccaaactcaccaagaacttggtactgagaagtggctgctgctgtaccttcaaatgtggactggctttggaactgggtgctgggcgaaggctgaaggggtttgggggtgcagagcggaaaaggcatggctgccatgaatgtccttaaaggacaatgctgggggctcgggagaggagagctgcagagaagtcctgtcttaggggatatctaagtaaccctgaacagaatggtggcatgagcatgggtggcaaggctgttctaacaacatctcagacagaaaggacggccatgctactggaccgtggagaaaaagccatcctcgtgacaaagtggacctgtgttcatgccctcgtgttctgggagggtggaactcgcgagtgatgacatcagacacgtaattgaggagatttctaagcaaaatgctgtgggagcggcttggttcctcctgaccgctgacagcaaaatgtggggagagagatgatttgaaggtggaattgttgagcaaaaaggaaccagaactcaaaggctggttgagttaaaagatttgagaattaaaattccagcctacccatatctcaaaaaaaatgagacagcatgtttggaagagaccattaagcaggtggctgtgtggctatctgataaggagacaagtgtggggctgagccttggacttgaccaaccatctcagcaacagccgggagcagagaaggaaccgcaccagcagaggcactgccagaagaaaccaggaaacagagaaaacaggatgaaatgaaggcaggctgcggtgtcttaagccctacaagccaggccatagagctattcagctgtgaacatgtgccattcttcaagacgagggaagaaggaccctgaagcgggtagggccatcagaatgccactctcacccagaatgagtccatggaccatgtatcagatgcaaaattctcagctggaatattgattaaaaaataaaactggcaataactagaaaaaaaatcgcaataaggaatctgtccacccagccatcactcacccatccgtccatccacccatctgtccatctacccattactcacccatccatccctccacccatcactcacccatccatccatccacccatgactcacccatctgtcgatccacccatcatcactcactcctcggtccatccacccatcactcacccctcagtccatccatcactcacccatctgtccatccatcactcacccatctgtccatccatccattactcacccatctgtccatccacccatcactcatccctcggtccatccacccatcactcaccctatccatccacccatcactcacccatccgtccacctacccatcactcacccatccgtccacccattcatcactcacccatctgtcaatccacccatcactcacccctttgtccatgaactcaacactcatccatctgtccatccacccatcactcacccatccgtccatccacccatcactcacccatccgtccatccacccattactcacccatccatccatccacccatcactcacccacccatccatccatccacccatcactcaccctttggtccatgaacctaacactcacccatctgtccatccacctatcactcacccatccatccatccaccatcactcacccatccttccatccacccatcactcatccatctgtctatccacccatcactcaccctgtccatccatccatcactcacccatctgtccatccacccattactcacccatccatccatccacccatcactgacccacccatccatccatccacccatcactcaccctttggtccatgaacctaacactcacccatctgcccatccacccatcactcaaccatctgttaatccacccatcactcgtccattgctccatccacccatcagtcacccattggtccatctgcccatcactcacccatctgtccatccacccatcactcgcccatctgtccatccacccatcactcaccctgtccgtacacccatcactcaccctgtccgtacacccatcactcacccatcggcccatccacccatcactcacccatctgtcagtccacccatcactcacccatctgtccatcaccatcactcacccatctgtcagtccaccgatcactcacccatctgtccatcaccatcactcacccatctgtccatccacccatcactcaaccctcggtccatcctctcatcactcaccctgtcctccacccatcactcacccatctgttcatccacccatctacccatccatccatccacccatctctcacccatctgtccatccacccatcactcacccatccgtccatccacccattactcacccatctgttcatccacccatcactcacccatccttccatccacccatctctcaccatctgtccatccacccatcactcacccatccgtccatccatcactcacccatccttccatccacccatctctcacccatccgtccatccacccgtcactcacccatctgtccatccaccatcactcacccatgcttccatccacccatcactcacccatccgtccatccaccatcactcacccatccttccatccacccatcactcatccatctatccacccatcactcaccccagtccatcctctcatcactcaccctgtccatccatccatcactcacccatctgtccatccacccatctacccatccatccatccatccacccgtcactcacccatccttccatccacccatctctcacccaaccgtccatccacccatctacccacccactcagctgcctgccccgccatctgtccagcacacccatccaggtgctaggcacttcctctgtgccaggcccaggaaggtcactgcatatggaagctgaggagatgggagatggttgtgactttggtgacacaggtgagcccaggtgatgtggtttggatttgtgtccccacccaaatctcaggtcagactgtaatccctagtgttggaggaggggcctggaggaaggagaggggatcatggggacagacttccccattgctgttctcgtgatagtgagttctcacgaggtctggttgtttggacgtgtgtggcatctacccccatctctctctcttgctcctgcatgtaggaggtgcctccttccttcctctttgccctcccaccatgatcgaaagtttcctgaggcctccccaaccatgcttcctgtacagcctgcagaactgtgagtcaatcaatcttcttttctttatagcaacatgagaactaatacaccaggctatggggatggtgaggttgggaagcgcctggaggaagacacttccaaggtaaacagggtctgccagcctgatgcgcaagggtgttcccagcagaggaagagctggagctgtgatgcggggcgcacggcctaggaggagctgagcaaggttggacagtggtgcagggagcaagctgatcatggagggcctggtcagcatctttcagaacctgggtcttgtgtgtgatgacctcaccctctccgaggctccctgactctggcctctgctgtgtcggttcctgctatgagagggctgggaagaggctggctgatgccagacccactgtcttggccaccctgaggccttgtgccatcttcacagtatccagggacctcagacccagggacagcacctcgcacacttgctgggggagaagacgctgtggtgggtggtggcccatgagtgtgtacatgtgtggttgtctgcacatgtgtgtgcatgcctgcacatgggcctgcacatgtgagcgtgttgtgttcaactgcacatgtgtgcaggtattgttgccttgcctgtctgcacacacatgtacctgtatgttcatttcacacatgtattgctgggaacatgtgtgtacatggctatgcatacatgtgtatgtgcctgtgtgttagtgtaggcctggaacccacgtacacccagggcatgtggggctggagaacaggcgtggccaagctcacagatgggcagctgcacggacacccagggcatgtggggctggagatcaggcgtggccaagctcacagatgggcagctgtgcggacacccagggcatgtggggctggagaacaggcgtggccaagctcacagatgggcagctgcacggacacccagggcatgtggggctggagatcaggcgtggccaagctcacagatgggcagctgtgcggacacccagggcatgcggggctggagaacaggcgtggccaagctcacagatgggcagctgcgcggacacccagggcgtgtggggctggagaacaggcgtggccaagctcacagatgggcagctgcatggacactcaggcaggactcatgtgtttccaggccaaggcacacttgacacttctgggttaaatcaggggaatgaaaagaagaaaatctaacaggcataactccaggcacattccgctctatttccattctgagtgggactcaagggccctgtcatatgatctccaagagcagatccgagttctaccagacactggcatagaaacaaacgcagctgcttcacccccgtgggcttttcttgtctctgcctctcctgaatcacagacctcaaaccactgtccccatgtggtctaactgggcttatctggattgctatttcaattctgtaaagcaattcaatgtcacagataatgatacatactgcatatagatttgaaacacacggtgtgcctggcactgtttcaaatatatatgcagtatcgttatctgtgacattgaattgctttacagaattagatggcatgtgtgtacccacatatatgcatgctgacacatgtgcccaaagacatacatgcatactcacacgtgccctcatgtttccacacatgcacaaattcatgcatgctcacgtgtccccacacacacatgctcacacatgtacccacacattcactctcatacatgtcatgtccatacattcacacacactcacacacgtccattcatgcactcacacgtgtccacacattcacacatgctcacacatgtccacattcacacatccacactcatacatgtcatgtccacacattcacacacgctcacacatgtccacattcacacgctcacacatgcctacacatatgcacacatctcatacgtgtgtccgcacacatgcaagcacactcacatacgtgtccacacacatgcacttatccctctggaaaacaaaggaatgaaaaaataggtcctctaaagaaacttggcagtacagaggttacaagttaaattccatctaaaaattatctatagaacctattatacaggtaattgtcccccagatagctgcctaccctgcaaaaagcttttcgcatccatccgtgctacaaagacaactacatgtagcccacactacaccagaggctcagaccacaggttttcaccccacagcatgctcctgaggccggggcctcgccagccatcccctcgctgcacagatctgtgtgccgggcagactcaccctgcatcttctccagcttgctcatgtacaagttgaagagggagtagatacgctccgtctcacggtccccatcaatgtccagctggatgttggctgggaggccgctgtccagacacagcaagaacagaaagataaaaacacttatttaaacgatgcttttaataatgacattcatttttaaaatgtcactgaagaaagacaacgattgtgttggaagtgaaattcgacaggatcgatttgctgtccgtctgtgcacagccggtgtgttggcttgctgagcaaggctgacagcgtccacagcagcacggacagcagtgtcaccaggctgcaaaccggaactaactagcaacctctgcttcagttaccattggcctatttggacacgtggcaaaagatccttgctgtttagtatttaaaatgtgcttatcatttgtactaactgacctttcctgaaatcacgcagtactgagttatgtcttgtttaaatctattcctactccagaatcttatcaatacataagaaatttaggaagactaggtgctaaaatccccagtgtaatatgtaatacttgtacatttttagtatcatacagaactcaattcccaggaactatgaacactccagacctcatgtggtttattccttcagtcatttcaaacacagaaggaggctgtgtgcttgtttccctgctcattctatgtctgcttctcctatgttcacaccagcacacgtcaggctggagcgcggtggcacgatctcagctcactgaaacctacgctttctgggtttaagcgattctcttgcctcagcctcctgagtagctgggattataggcacacaccaccacgcctggctaatttttgtatttttagtagagatggggtttcaccatgttggccaggctggtcttgaactcctgagctcaggtgatccacccacctcgacctcccaaagtgctaggattacaggcgtgagccactgagcccggcctcatgtctttttataaatcttactttgtgttattatgaaaaacctccatagccgggtgtggtggctcacacctgtagtccccacacttttgggaggccgaggcaggtggatcatctgaagtcaggagttcaagaccatcctggccaacatggtgagaccctgtctctattaaaaatacaaaaattagccaggtgtggtggtgcacacctataatcccagctgcctgggaggctgaggcaggagaatcgcttgaacctggaaggtggaggttgcagtgagccgaaatcacaccactgcacttcagcctgggcaacagagcgagactctgcctaaaaaaaaaaaaaaaaaaaaaaaaagaaaagaaaagaaaatctacattgtacagaagcacgtctttgatggcttcagacaaagtggcctcacggttaatttcacatttgcacgcaggtgcaaccaacagggagggcctgataggaacgcgcggggctgttatttttagcaaaatgctgccttgtgcagaacgtgtgaaatatgctctttaatttagtaaatactttttaaaaggcagaaatgcttattatagctaaaacaattcttaaatcataaaatttctgaaacgtctgtaattttttccatactgattagaaattgtttccaacttatttttgtttgaagtatgacagtttttcccttttcttcccaacttctcttgtaaaaaaagaagtgggtttctgctaatgaactgatcagatgtcaatactgtatatgccttttgagctgagtagctcagtatttggatacttggtcatttgttttattaggtaattgataaaattgtgtcacttattcatgttcaaccatatatttatgctgtctggggatgggtggttatagttctgtgtgagaaataatttgtcagtcttcaacagcttgtaaaaactttgcagtgagagcttaaacatctaaataaataatgaaatgcatttatcataaaaaaaagaagaaagaagatgaagtgaccaacattaaaacacatccctggccagtcagggagttcatgtgggtaatcccagcactctgggaggccgaggcaagaaggatcgcttgagcccaggagtttgagcaacaccaccctgggcaacatggagagaccctcacagtgagacctggcaacatagtgagaccccgtctctacaaaaaaccaaaatttaatgagctgggctggtggcatcagcctgtaatcccagctacttgggagagtgaagtgggaggactgcttgagcccagaagtttgagaccagtctgggcaacgtggtgaaaccccgtttctacaaaaaaccttaaaacaattagcctggaatggtggagcacacctgtagtcccaggtacctgggaggctgaggtgggaggatggcttgagcctaggaggtcgaggctgcagtgagctgagattgcaccactgtactccagcccgggtgacagaacgagatcccatctcaaagacataaaactaaaaaagcatccccgagctgggagaactgaggctggctgtgggtgtgcgggataggggaggctcccgagctgtccggcctcagcggctggagcctcttgggacccacagatctgccaaggcagtgagcaaactcggcagacgtgttctcatggagataaatggcctggaaggaagcctcctgggactgtgttccctgcacggtcggctgcgggtggggacaggccaggttttctctcctcgtcaggctgcaatgcttcccgctgtcctgggatgcgaggacatgggagagcgctggcctctcctgggggattctggggcggtggccacgcatgcctgagcagcagccaggcccccttcctgagcttcagcctctgtgtccacgaagcaggatctaaggtcccacctctgaggctgtgggaggattaaacggtggcccagcatggagcacagctcatcccctgcagggcccttatgcgaaagcatcacgtggccacaacaacagcgaggtgcatctcacggagcataaccagggggaccgccaggcacccaggcctcctccttaggaccggcagatatgacccaagcctctgtgcaactgccagaggcccggctgatggggggccctgctgatggggggcctgacagggggcccagctgacggggggcccagctgacggaggacccagctgatgggggcccggctgatggggggctggctgacggaggacccagctgatggggggcccggctgacgggggcccggctgacgggggcccggctgacggggggcccggctgacggggggtccggctgatgggggtccggctgacggggggcccggctgacggggggcccggctgacggggggcccggctgatggggaggcccggctgatggggaggcccggctgatgggggacccggctgatggggggcccggctaatgggggggcccggctaatggggggcccggctgatgggggacccggctgatggggaggcccggctgatggggaggcccggctgatgggggacccggctgatgggggggcccggctgatgggggggcccggctgatggggggcccggctgatggggggcccggctgatggggacccggctgatggggggccgggaagacaacgggctgctgcgtcatgtggaatcaaggtgggtgtcctgggccagacgaagctttcagggaggggcttgctcccagcctcctcctagagaagcaggatggccacggcctggggagtcccccttcaccctgacctcccgctcccccggggcagggcctcaggaagaccctcgaaggcctgtggcaccctggagtctgcgcagagccttccagaggctgggccccagatgctccctcgagggaggacccctcgggtgggaggctcctgggaggaggcgagggcagccctgtttatgtgcagcttacaggcaggcatgcactgtctgctggtccctccctactcagccccttggccacatttcctgcacagtgcacgagctgggcaccgaggcacagacctacccagtgcagggcgagcagcccggagccgagtcggatggcgccctacagcacagccagtggccgctcaggtaggcggacgggtggtagacggtgaggcgcttctggttgcactggctcactttggtgagaatgtcgatccagtccttggcctccacgcagttgttggcctggatgtacagcgcacgctctggctggatgacctggaacatctgaggacacaggtgggctcaggacagcgcacatgaggtctcgtggctgagcacgtgcaagagtccaccaggcacctggccgtcctcgccggagtcgtaagaggggacgctgagggtgcacaggcccaaaagtcctggagctctaagccccagaagaggccaaggccagggggtgcatggagctctctgccaccctaaaacctgacagctggggccgtggggaatggaggtgagaactggtgcagctggagatgtggccaggtggccaggaacagcttggccaaggccctttatgtcctggagccttggaggtctccattcaagacaaaagaggggccctgtggcctccccacaaggccctcctgcagctgactgcaggcatcccatccacgtggtgctcgtgctgtgtcagcccaggtggcccggcctgctcagctccttccccaactgaccagcccaggattcttcctcctcctcccagctggggttagggggctgcttcctcttgaagcgtctcggggcagcaacaacctttaccatttattactcattcaacaaacatgactgagcaccagcactctcctatgtcccggagacaaagcctggcatagagtttctactgaacctgcagccaccaagaaagactaaacgagggcaggtgtcagcagaagctggaagtgagcagtcctggtgctgtagtcggcgttgactcaaagttagttaagcagggggtgggggcaaagggtgtcaaaggcagaagaaatgggaggcacaaaggtcctggggcaggtgggacaggggtcctgtgattggagggacaggtctcccggggcaggagtgacagaagccttaggattagagggacgggggtgctggggcaggggggacagatatcctaggattggaggtcagaagctcccagaaggagccggctctgttgcacacagaagacaggttttctgagtaggagactgactggaggttgggagggctctcatgtgggacttgcccttaagtcaggagtcagggggacagtggccttctctaggggacgggccttctgcactcatctggggaggatttgggctccaggtttctggtgaacagctgaggtcttatttacagaggccaggagcctcccgccttgcacccggcacatgtgtataggtctcggactggacgcccccgtgcatggctgtgatcccccatggagggcgtcctggccatcatcccaggctcggccctgccaccaggagcagccttcagaaaggtctccccagctggtgagagcctggcctggcagtggcctcaggggaatcgggctctgaggaagtcagtgggaatgaacagctgggaacaggcggctgaaactagggaattattgggaatctatgtgaagggctggaggtgcttccaggacatgtccacactgcttccttcgagggacggtctcagggccaggttccggccatccccctcagtcagcaggcattgagcccacaccctcctcttcccatctccccctcttcccaacccttctcttcccagccctcctcttcccagccctcctcttcccatgccctcctcttcaaattactctccaaacttatgccttttgcaggatctgtctggactgcctgtgaataacatgctagtaaaattctgccaatggtaaggaacatgcgtcaactttggcacgaggcccagggactgtgccttccctgcaactgttctatgaccctcatgctgcagtcggggcacagaaggcttgtcccagccagcatgtgtcagggtacggggtcagcctcaggatggcacggacggcggggtcactggctgaaggggcactgagtcaccagggagaacgtggccagcggccgactctgggaggccaccacacaatggtgacgccacggacacctctaggggattcccgccagaaatgcatcatcagaacctgccacgtcggcacatccgacaaacccacagggagggatgtccagaaaaccgaaggcctgcacgcctcaaagatgccaaggccaccacacacaaagaaaggctgggagtgtccagtgggccagacggagggggcagcagaatgcagcgcagactggatccagaggggaaggaaccacagccggaagaacgggactggacagcggcaaactcgaatgtggtcgcgccggcgacgtgcgatggtggctgctgtggttttggggactgcacggtgggaaacacacttggaagtgttgatacattcagaaaagcacgggcgggaccgtgaagggagaaggaacaagtgtgactggggaacgaggcgacatgtgggtccgggtcaagcgtgaccggggaacgaggccacacgtgggcccgggtcaagcgtgaccggggaacgaggccacacacgggtctgggtcaagggtgtgtggaaagtacttgttctactcgtgcaacttctataaattcaaaattatatcaaaataaaaaagcttccaaaaggaattccagacggtcccaagcctgcttctgggatgtctttgacagagggccccttgacattggggaccctgcgggggacgccacctgaagcagctcaggccccaccttccggcaggttccaccccaccccggtgaccccgggcacagagagtgtggctgctttgatgcgagattccgacacaaactcaccagcacctggtgaacaacccgagtaacacgaagactctgagaagcctggagtgcagtgggtggggaagggtgagcccagggccaggtacgggaagagagcagagaaaacctggccaggcctcaacccgaaagagaggcttgggggccccacactcacgtttttcattttgaaagactcctcctccagcttctccactgccaggatgttctcgatgggaatgctgtagagaggctggtcccctgcagcagagatggactgtcagtgggtgcgggccccgctgtcccggctggggtccgggtggggctgaggggtctctgccggggggtctcccagggggtctttaccggggggtctctgccagggggtctctaccggggggtctctgccagggggtctctgccagggggtctctaccgggggtctctgctgggggggtctctgccagggggtctctgccaggggtctctaccgggggtctctaccggggggggtctctgccagggggtctctgctggggggtctctgctgggggggggtctctgctgggggggtctctgtcaggggatctctaccggggggtctctgctggagggtctctgctagagggtctctgctggggggttctctgctgggggggggtctctgccaggagggtctctgctgggcggtctctgttggggtggtctctgccaggagggtctctgctggggggggtctctgttgggggtgtctctgctgggggtctctgccagctgggggtctctgctggggtgccctgggccggaggaggtgccccatgttcatctccttggggatgatggctgaatcactgacaggctgcaggtgcgggggctgaggaagcctgggacccacctggccctgccatgcacccaggctgggcccaatgctcgcatcctcacagctgccgtggcctcaggctctgtccccagaacatgttcccgttctgggacatgaacatgggagaaactgctagatatttcctaatctagatctgagccagcagatctgacagcgaggggcaggaggtggtgggaagccccgtctacctcggcggagcggcaccctggccatgacgaggcgaccagaggaggaagggacgtggacagaaaagcaccttactgatgtggtcagctctgcgtttactggttctctggggaagcagatttccctcactttccagcagcaggtctgaaagaccccttcagggatctttgaagggagaaccagaagcagagggctctgggtcaccgcggccccgggctctgcccgcagcactgaatccttcctcccctcagctctccccctgaaaaagcagactcagtcccagggcccagcacgctccagcaagagccagggaaagcgaccttgctccttacctttgcttttgtggtaggtaaattcatggttggtcaagcgaaaccatctcttcttaaaattcttcatcccaaagcgcttccgtccttgggccctcttgatcatgaacctgtgtgaagagcacacagggccggggtccgggcctcagctgcctccctgcacaggtgaaaaaccacaccccccactttctgcgttctgagacctgaggcaggcagtggattttcaatatcttatcattttactccgagtgatgagattaaaattggaaggcaatgcctctcctttgaaaagttgagcgctgactgctttgagtcaccagttggtgatggcaccaggttttaggagatctccaaccctcctgcctcccacactgaactttcaacagtggtgctgccactggaaatgccaatgcgatgctcccacggcggacctgcggccgtgggctcagggtcagggagggcagcggacgcccacacaacacggaggacctgcggccgcggacctgggatcagggtgggcagtggacgcccacacaacatggaggacccgcggccgcgggctcggggtcagggcgggcagtggacgctcacacacagaggacctacggccgcgggctcggggtcagggtgggcagtggacactcacgcaacatggaggacctacaggcgcgggctcggggtcagggcaggcagtggacgctcacacacagaggacctacagccgcgggctcagggtcagggcggacagtggatgcccacacaacacagaggacctacggccacaggctcggggtcagggcgggcagtggatgcccacacaacacggaggacctgcggccgtgggctcggggtcagggcaggcagcggacgctcacacacggaggacctgcggccgcgggctcggggtcagagcgggcagcagacgcccatactcagaggacctgcagccacaggcttggggccggggcaggcagcagacgcccacaaaacccacacctgtgttgtgcgggagtcacgcaccagcgcctctgccagaccaaacctgccccctcagggccagccctgctgtggtagaaggcgccactgggccacgtcctcaggaaacgtggggagcaggagacaggatggccaccgaggatgcaaggcctcagcgaggaggacctcaagccttgccctgggcagggtcctcgaacaccctcccggcagcccagggccctctgaggctcggccttcattgccgggcaggggtccctgaccagaaccggcggccgagctggaggagaagaaagtggccagacagagtgactggaggacagaggtggaagctgaggacgagaagccaagctggagagacagagtggggaggtgggcgggggagacgcacctcgacaagcgcactcagaaatcggaaagaggggctttgagcagcaacacagccagatgtggccagagagctgtggacgcacaccggagggtgtggaagctgctgggagctgttcaagagagaaaagggcggggcgctgggagccgccaggacagcgcagttcacaaccagtggatgccgaacgccgttcattccagggattcacaggcaggaagtcagcccaggaggctgttgaggaccagcaggacccagtgggatgcgcagggcggggcctacacagacgggggttggggggggactgggagctccacgacatgccggcctccttgagggcaacagggcgcctctgagaagactctggaccatgtagcagttagatttgagtagcagtcttgttataaatgttttcggctttaggatttttttaagaaccccaactttctgagggccttcagtggatgaggctgcatgtgaattttatgtgcagtttccaggttaaggcagcactgagtggagagaagccagtggctcctcactgcacagctctggtctgggcgcctggctctccaggagtcggttttctaaccgggcccatcgcgcgtgtgggacggggaggcaggagccacggctaagccggaagcctcaggctgaaagcagctcggccccgcgcagccacggccaactcaactcagcaaacacacgctgcgctgcagaggccccgtccccagtcctgtgtcccagtgggtgaggacacacacagccctgagagacggcagaggtgtgggagcatctcagcacagggtgagccctcaggaaacatggtcatcaccacccccacacatggacgaacatggcaagacacacttggcaccaagggctgagatggcagaaccgaggccctaggacggcccatgcttgcacaaccgagggtggccctaggtttggggatgtgacagagctgaggtgccggaggagaagctgatccaggggctggaaactcgagggcctgatggaccaaaaccttggtgtgagtcgcaggtggtgcagctgctggaaggagctggtggagcctcagctgcatccagggcacctgggaggcgcctgtccttgaacctctggctggtggcacctgggaggcgcctgtccttgaacctgtatctacagcagcttctcggcgtcagacacacaagccctgagtgtcctgtgttgctttagggattacaggatgaatatctgttgctttgaaagctgtgaatttatgaaatgtagaaagtaaaaagtttcctcttcaaagtttcccttcttgttaaagaataaatcataagtgttagaaataatagtttcttttaaagactaacttccttcaagcctccttgctttgtgctaataactctttgttaagctctatcctgtgtagctgttggacgtgcccacaggctcgtaatatattctgtgtccttgtaccttaaccaaggcaattgtgttagacgtactcataggcatgtcccagctcacagcctatgccccttccttatttaaacatattattatttttctacctatttaaaaaagttttaaattattagccaatcaggtcttaatttagattgtgaggtccggctccaggcaatggggacaggacacgacaacaggaacctcgtgcgtaaggaataaatattctggcgtctctttattctgtgtgtgcccttgccattactccttctgccagggacaccctttctgcagaaagtaaaaattgcctcgctgaaagaactttttgtctaaatgctaatttttccttatggcaccgaagaacaaacattttgcatttctaacatgaaatgtgtgtattgcaaatgttattggttaatatatgattaagttaaatgaaggtgattttaagaaaaatagcaatgtaagtaatgccactggggtatggtccaccagtgacccagagatgatccaggtttcagcagatggctctaacagagtatccacaaaaatagacaaatgggacttaattaaactaaacagcttctgcacagcaaaataaataaccaacagagcaaacagacgacctgcagaatgggaggatatttgcaaagcacagatccaacaggggactaacagccacaatttagaaggaactcaaacaacttaacaaaaaaaataaaaattaaaaaaaaatttaaaagtggccaaaggacagggggatagacgtttttcagaagacaaatggccaacaagcatacgatataaagcccagcgtggctcatcacctgaggaatgagagccagagctgcctgtgaccccacctcacgccaggcagaacgaagccacctgcgaccccagctcacgccaggcagaatggagccgcctgaacccagctcacgccgggcagaatggctgggatcaaataaaacacggaaaaatgacagacgctgcagagctgtggaggacgtgagcgcttgcacgctgtggggaatggaaattagcgcttaaggaaacccacggagatttctcaagaagctaaaggcagagctgccattcgatccagcaatcccacaccaggccccacccaaaggaagagcaattaccaaaaagacacctgcatgcgtacgtttaccgctgaaccactcacaacagcaaagacacggaatccacgtgtccaccaacggacgactggataaagaaaacgtggcataaatacaccacgacatgctactccaccatcaagaggaaggaaatcttatgttttccagcaacgtgaacggaactagaggttgttatcttaagggagatgactcagagacgaaaagccaaacgccccatgttctcactggtccataggagataaacacggaggggcggggcgctctgggacacgtattcggaatcacagactgaggcctcggaagggtggaggtgggagcgggagaggaatgagaaattactcagtgggcacaaagtgcccgttcaggtgacggtttcacgagaagccccatccaatacaactgcacttgtgcccgacatgttggcaaacacataaaaaatacaggaacatggtccacaccaggcagagcaaagccccgagcgggagtgggagccgggccacaggacggggttggtggaaacgggcagacgtgtcagttatgtaaggaaggttgatgggctctgatgctccagggacctctgggtggaggttgagggaggacaggcctgtgtcagaaacacggggtggctgtgggacacagacgtccccctccaaggtcaccgagaaggtggcagaggggtcccaggctgaaggcgcaggggccagacccccagggctgtcccctctgactctggttccctgagcaaagagccctcgggagcctggagggaaggccagccccaagtgcgggtgtggacaacacggccagtggtacagaaatcacaaggctgctggccagcaagggaggaggctgcccccgactagggaatcttctggaatgtgctgggtgctctggggactgggggcccccatccctttctcccctccggccctgccggatgccaccttacccttctcccccctcctgccctgccggacaccaccttacccttctcccctcctgccctgccggacgccaccttacccttctcccctcctgccctgccggacaccaccttacccttctcccccctcctgccctgccggacgccaccttacccttctccccactcctgccctgctggatgccaccttacccttctcccctcctgccctgccggacgccaccttacccttctcccctcctgccctgccggacgccaccttacccttctcccccctcctgccctgccggacgccaccttacccttctcccctcctgccctgccggacgccaccttacccttctccccactcctgccctgctggatgccaccttacccttctcccctcctgccctgctggacaccaccttacccttctcccctcctgccctgccggacgccaccttacccttctccccactcctgccctgccggatgccaccttacccttctcccctcctgccctgctggacaccaccttacccttctcccctcctgccctgccggacgccaccttacccttctcccccctcctgccctgccggacgccaccttacccttctccccactcctgccctgccggacgccaccttacccttctccccactcctgccctgccggatgccaccttacccttctcccctcctgccctgctggacaccaccttacccttctcccctcctgccctgccggacgccaccttacccttctcccccctcctgccctgccggacgccaccttacccttctccccactcctgccctgctggacgccaccttacccttctccccactcctgccctgccggatgccaccttacccttctcccctcctgccctgctggacaccaccttacccttctcccctcctgccctgccggacgccaccttacccttctcccccctcctgccctgccggacgccaccttacccttctccccactcctgccctgctggatgccaccttacccttctcccctcctgccctgctggacaccaccttacccttctcccctcctgccctgccggacgccaccttacccttctccccactcctgccctgccggatgccaccttacccttctcccctcctgccctgctggacaccaccttacccttctcccctcctgccctgccggacgccaccttacccttctccccactcctgccctgccggatgccaccttacccttctcccctcctgccctgctggacaccaccttacccttctccccactcctgccctgccggacaccaccttacccttctccccactcctgccctgccggatgccaccttacccttctcccctcctgccctgctggacaccaccttacccttctccccactcctgccctgccggacaccaccttacccttctcccctcctgccctgccggacgccaccttacccttctcccctcctgccctgccggacgccaccttacccttctcccccctcctgccctgccgcccccctcctgccctgccggacaccaccttacccttctcccctcctgccctgccggacgccaccttacccttctcccccctcctgccctgccggacgccaccttacccttctcccctcctgccctgctggacgccaccttacccttctcccctcctgccctgccggacaccaccttacccttctcccctcctgccctgctggacaccaccttacccttctcccctcctgccctgccagacgccaccttaccctccttacccttctttaagcacgatgggctgctcaacactcttggggtctcttctccccgaggacgaaatcagatccaagaactaaagttggaagaaatcaggtcaccgggaggaagccacacatctgacgtgcacggctctctgtataacaacagcgtcggcggctactgcctcctttgtaataccagtggagacagaatctgggcaagtgagtccttccccgagggctgtggggcctctgctccccactgtgccaccccagccccggcactgccacagagatctcaggtgagaggccgggctcaggcaacacctggggatcaacctgcatctccagaggccacccaggggtgactctaagcagggaatctgggtcccggtagtgaggaggctcaggcatccctgactgtggggaggagcagagccctggggcctggaggttgcccccacgcaccgcgttcctgactgtggggaggagcagagccctggggcctggatattccccccacgcaccgcgttcctgactgtggggaggagcagagccctggggcctggaggttgcccccacgcaccgcgttcctgactgtggggaggagcagagccctggggcctggatattccccccacgcaccgcgttcctgactgtggggaggagcagagccctggggcctggaggttgcccccacgcaccgcgttcctgactgtggggaggagcagagccctggggcctggatattccccccacgcaccgcgttcctgaccgtggggaggagcagagccctgcggtctggatgttccccacacaccgcgttcctgaccgtggggaggagcagagccctgcggtctggacgttccccacgcaccgcgttcctgactgtggggaggagcagagccctgcggtctggacgttccccacgcaccgcgttcctgactgtggggaggagcagagccctggggcctggaggttgcccccacgcaccgcgttcctgactgtggggaggagcagagccctggggcctggatattccccccacgcaccgcgttcctgactgtggggaggagcagagccctgcggtctggacgttccccacgcaccgcgttcctgactgtggggaggagcagagccctgcggtctggacgttccccacgcaccgcgttcctgactgtggggaggagcagagccctgcggtctggacgttccccacgcaccgcgttcctgactgtggggaggagcagagccctgcggtctggacgttccccacgcaccgcgttcctgactgtggggaggagcagagccctgcggtctggacgttccccacgcaccgcgttcctgactgtggggaggagcagagccctgtggtctggatgttccccacgcactgcgttcctgactgtggggaggagcagagccctgcggtctggatgttccccacgcaccgcgttcctaactgtggggaggagcagagccctgcggtctggatgttccccacgcaccgcgttcctgacactgagtctgcagccccagggctccacgactgcagcctagagtgagtccggccaccacacacactgaggtgggacgcgccctcattcggggggctcagacacagaacaagatgggcgagggccccgttttggccccaaaggcagtcacgccaaagagtttaccaactgtgggaggaggtgtcccaggacttgggacaaggctgtctggacagcgctgtgaatgcaccgaacgcctttattgtttaaaatcgctaatggccaagtctgtgtcatgtgggttctatctcaattttaaaagagaactccgtctcctgagcacggcacacgggcggtcggagggtgagtcgatacttacgttcttcaccgcatcagcatatttctgctcattgaagaattcataaaatgtagccatgtaggactccttaaaactcgcctaaaatgaaacggagatcactcgaggacagcccgaagtacctcggctcacggcccaaatctgaaaaagctagaggcaagaactgtccaagcctaaatgacgataaacaggcaaagaacccggtgttaccgggcaagtgagagcccgcagggctgcccggaggacgaatcacataaatcgctcaggcgccaacgaagaccatcagacctgccagtgcccgtgaggtctccaagcaccctttggcatcagtgactccgtcctggccccgggctgtccctcacacctgggtcccaggctcatgaagaggtacgttggggcccagatgtggctgcctgggaacctggagtcataggccagggtcccagagcccccacgcccatctctcgcccgtggggcataagggccgctctgaggtgggaagagggggcagggacctccatcacacggggaagtggaggcacccagggattcgggggggcctttgcagccaccattcctgaggctcgaccccaagttcctgttgtttccacactgaggtcactgcacagttccctggctgtgaaatgaggtgggtttggtgcagacctcggaggaggctcaagtgcctgttatggagtttccagcccacagcgcagggcctggctggtgggaaagagcggtcggtgcacctcggcctgcctgcgagtgtggcacatcttttactcactcggactcagagaaacccaacgtttgccccaagcgggctgctcctccagtgggggcctctgctccccaaagccctcatttctacctgggccccaccaagaacagggaaccaggaggcctgggcatctgtgcaccacagcccagccctctccagacggagccccgagggggcccgaaggcatcgaactgccctggcctggcccctgcagagacagccttgggcctcaccaggagcactgcccccgggacgcctcaaacgtcagctctgaccccctcaaacacacaaggtgctcttagggggaaatggggcagatgcctgagggactcctgacctggtggcaccagatccagtctgaagggacgaggatggaggacggaggttcatatccacagggagagaggggccctgggaggagggggccgcgtggggaggggagcgccacgttgggaggaggcggccgcttggggaggaagcgccacgtggggaggaggcggctgcgtggggagggaagtggggaggagggggctgcatggggaggtagtgcagcatggggaggagggggccatgtgaggaggagggggccgcgtggggaggtggggaggagggggccgcgtggggaggagggggccgcgaggggagtagggggctgcgtgacgaggagcctccagcaccgcaacgcccaggaggcgccaggttaggccatctgcctggcctgttcagccgcttcccacacctgacaggtcagatgctgctcctgccacggggccggcgacgagccacaggctcccgaaaaaggcaaggggttcactttaggaggggagaggtgagcgggacggggacgctcaggtcctgggtttcaagagaggatgtggtgccggctttgattcttgatctttatcttacgactctctcaaatgtgggaggtttttcacgtgtattttctgaagagagaaaagaatcagttgtccctaaaaagagaaaatgaagaagagggactcacagatttggacttggacaggctgccgagggtctgaacggtcttggagatcaatgtcagcgtcctggacgtctgggggtcctggggaggcgggagcaagaaaggtctatgtcagcatcacagaaatgctgtgactgtcccagatcgaggggacgaaatgcaggagtcacctcagagctgctgtggcttgtgcatgagctacggagaaacaggggtagcgacgcagatgggactggagggggtgggcgtcccacagtctcaggagctgctgagaccatcccgcaggcaacatccgacggcaccgcggtgacccactctctcggcccagcgtgcagggtgcatctcaaagtcgaaagcatcaggtggggtcatggctctggggcgctgagtctcggggtgctgagtctcctggccctgcctggggctcatctcagccttcacagggtttgaaggttcaactcagaagtgctgggggccgggcttggtggctcacgcctgtaatcccagcacttcgggaggccgaggcaggtagatcacttgaggtcaggagttcgagaccagcctggccaacatggtaaaaccccatctctaataaaaatacaaaattagctgggcgtggtggcgcacgtctgtaatccaagctactagggaggctgacgcacgagaattgcttgaacccaggaggcagaggttgcagtgagctgagatggtaccactgcacgccagcctggtgacagagcaagactctgtctcaaaaaaaaagaagtgctggggaatgggcaatccctcacgtcctctcgccctggccatctccttccagctctgccacccgcacgtgcaacacggtcaccccagatccctgtaccctgagagctgcggccccagcaaccacattggggcctggagaaaatcagtgctaaataggaatctgttgactcaatacacggatgatacgccgatcatcaatactccatatgtgatgggcaggggaggagagcagggcggtgaccagcagctaaaaccctggacaaaccgtccactgcttttgtgacactgtctcgactcccccagaacgtacacagcttaaataggtcggtgaaccacctgcaacgaggacgttccaggacccagcgcatccaccagcactccccacgcaccgtccacacactccacacacactccacacgcactccccattccacacaccttccacactccccgtgcaccgtccacacactccacacacactccccattccacacgtcttccacactccccactccccatgcaccgtccacacacactccccattccaaacgcactccccactcactcattacacacactccccacgcattccacacacactcctcattccatgcacactccccatgcattccacacacactccccattccacacacactcctcattccacgcacactccccactcactcctcattccacacacactccccattccacacgccttccacactccccacacactgtccacgcactccacacactcctcattccacacacactccccattccacacacactccccactcactcattccacacacactccccattccacatgccttccacactccccacgcagtccacgcactccacacactcctcattccacaaacactccccattccacacacactccccactcactcctcattccacacacactccccattccacatgccttccacactccccacgcagtccacgcactccacacactcctcattccacaaacactccccattccacacacactccccactcactcctcattccacacacactccccactcactcctgattcctcacacactccccacgcattccacactccacacggtcggccccctacagccacgcagatgccccaacccaggccggcgtcgcaggacagctcagaaagcctcggtccctcagccggtcactcaccgtgtggtgcggcgtgagctggaagaggttgggggagagaatggcgggcgcaaagaacctcaggaagatgaagctgctcactgcagtgtacctgacgtccgggtcatctgcgggagagagaagcagggtgaccgttttcctcgggcacaatggcctcgtggggacaccatgccccggccccctgagggtccgcagggaagtccagccacagtcctggctctatctccacctgtgtctgtctctctccctctctctgtttccctctctccctctctctgtttccctctctctctccatctctctgtctctccccctttgtctctctccctgtctctctccgtatctctgtctctctctctctccctctatttgtctctctctcatctctctgtctctctccctctctttgtccctctgtctctctccctatctctgtctctctctctctctctccgtctctggctctctccccccctccatctgtctctctctctctccatctctttgtctctctccctctttgtccctctccctgtctctctccctatctctgtctctctctctctctccccctctctctctccgtccgtctgtctctggctctctctctctctctccatctctctgtctctctccctctctgtctctctccctaactccatctctctctccccgtctctttctctccgtctgtctctctctccatctctctgtctctctccctgtctctctccctatctctgtctctctctttttctctctttctctgtctctctctctccgtctctctctccctgtctctatctctctgtctctctctctctctctccgtctcgatctctctctccatctctctccgtctgtctctgtctctctccatctctctctctccgtctctatctctctctccgtctgtctctgcctctctctccgtctgtctctgcctctctctccgtctctccctgtctctctctctctctccttgtctctctctgtctctctccttctgtctctgcctctctctccatctctccctgtttctctccatctctcatcaccaccacacagcgcagcccctttggtgtctcattccacagtggtctgtgctcatctgggtgagaggatgtgttttatctcttcacttccaccttgttcaaagtgggtctggggctgggatgtgcttgggaactgcctcccccagaaccctgggcccctcggccggcgctgtctgactgtctgatgtcctgagaatcaggggtggggacagcgtttgtctcctggggacacagaagcgtggacggctctgcaggaccatggccaccccggggtgtctgcagctgtcccgaggccacaggacacgcaaggaagagaggagccggcagcaaggccctcgctgagcctctcagcgccccatacatagcctgagtcctggcggggtcttgagtatcgcaggtgatgggtgggtgcaggcacccagctcctccctgagggtcggcaaggttgagaagtggggtttgggtgctggatgcccaggtccctaggggatctccggcttgggggtttgaagaaagggcagctcccccaggggtcctgtctcttcgaagacacgggcaggcagagcccccaacaccactctgggccctgccagggtcggccacaaaaagaaaccactgggaaaacccaggggtccacatcaggaaaattcacattccaccccgacaaagcctggccacccttcccggcccccccagagaccactgtggtcgtgaactccagggctgggcccctctagagaccactgcggtggtgatctccagggctggggtcccctggagactactgtggaggtgaactccagggctggggtcccccagagaccactgcggttgtgaactagggaacactggcccgggcacaaaccccggaaaaatccagcatcggaactggggttcacgaccccgcagttctagtctagccagggctgcggggggttctgcctgggtgggagtcaccctgcacagcgctatggcagtttctcagcaacatgagggtgttcagggcactcaccctggaagcgcttggccgccgcctcccggagggagaagaagatgtcacacatgacggtcgggcagctcaccccagactcagtgatggcgtggaagacgcggtccacatactgccgtaggttctcctgcaacgggacacggcactgggacccactcccgaggctgcccacaggtgcgtgtagcaccagggcacgcccagggaggggcgcgtggggaggggctgagggcgggcgcagggcagctgcggcagtgagacacgtgtgaacagccactccctggaaatctgtgctgggagctgtggcaattcacgcgtgaaaatcactacacaggcaccacgtcggctccccggctcggccccgacctcgtttactgagtggggaatggacgttcactagaatgtgcctgcccaaggcaaagagctctgtcatttacatacagaaatgacgaaacagcacgctctgcaagaagtatcatgtgaagtgactaaaatgttggagcaagttcaacatcagggagttttgctgttttaaaacgcagtacacagctctggggacagcctggggaggcagggaggccatcctgtcctaggaaaagggaggggcaggagccattgcccaagggaaggaggagccggggcggaggcagagctggtcaggattgtccaggggaggcagagcagggtgtgcagggcagaccctccgggggggcagagctggggcatgcagaccggatcactccaggggaggaagagctggccgggaccccccaggggacgcagagcccggcacacaggccaggccaaaggtggtggctgaggcctcccagtagtgcagccagcgtactgcagccgggtgaggcgggtatccccacgcctggtcctgctcccaccccaaccggggtcacggggtgagtcagagcttccaggcagccatcggctgaaaaaccccaagcaggtgactggctttggttggttcatgaacaaaacctaccatgttgttttcaaggttttctccgtctttcaacttcacagggtcgatttcacagggtttgtggctctggcatatctggggagaggtttaagacagggctctgtgagtgggttctgggggcacaggcagggagggtggaaggggtctcaggcctggctgagatgtagaccctgagcctcatccagaaaatgccacgacagctccccgaacccggccactggcacggaggggcacggtgaggccggactgcagggccaccgtggggtggtgtcgtcccgagcctcagctgcaagggggcaaccctgggcctgtgtcactggctgcggagggacaagtgagaggtcaggcgcaaacactaggcacggggcccagtccatggccgcgatcagacgagccgggctctctcagggagcgatgtgcgcccgcgatcagacgaatcgggctttctcaggagtgatgtgcaccagcccacacggactaggcctcacagggctttaataatatttttacttcaaaatgctgccatgattttgcccacagagcaaaccagaatgctatgttcaattttctcacatttgcaaagaacctgtttacaaacccgctcataaacggggggcacagcctggcgggcatcagagggtcaggtgaggagtgggtgtgcgggcatcagagggtcgggtgaggactgggcgtgcagctcaaacatgccacgcagccagggcccaaacacaggggactgcaggacatgtggagaaagaaggtctccctgggaagagccaggcttttcttgcatgttctcctttgtggagtggtggattttcttatgtatagttttaatttgggagaatttggaaggttctggagtacacagggaacatcctcttgataaaagtgaatgaatcagcatccccgtggcgaggccagaggggccgacattcaagcccagctcgtggtctggctggatcccagtgcagtgccctctgttgggggaaatcctccccacgcctcgtgaggctgaggactctcggccccgtgctcacctcctcgatggcgggcttcagggtgacatgcaggtaatgcatccccgccagcttcatggtctcgtcgatgcacttggacgccagtgagtttcctcggaagatggtgttggggtccctgggaaatggcgatggggacagcgtttgtctcctggggacgcggaagtgcagacggagcagagcctggccccgagcacctgcctgtgggctgtgaggtcagtgcacgcccatcagtcggcttcctgacattttacaaggagcacaaccaggccaggtgcttggaggccctggccatggaaccgtcctgtgtcaacactgccagagggaaccgttcggctacctgcgtggccaccagctcaggaggagcctggctggccttcgccctcccgccctctcccctctgcggcctctgcctgtgcagagagttgggcaccagaccctggcagcatccaagggccagcagagaagcaaaccctcctgtcagctacagtggctgcaggtgcagccagatgtttctagaacagggcgtccggaaacagcactaggcaggtcctgagggaagctgtgctccatttttgtgggctcccaaagtgccccagggaggggacctgagctgtcctcgagccccaggagccgtttcccctccccactcactcactctacccgggatttcaaaggcaaatgggactttcaaaaaaaaaaaaaagaatcattaactgggtctgtgaaagaaaacctgaatcaacatggtttctggggacccttgaattccctcaagccctgccccaggacacgtggttctcggcgacgaccttgccatccctgtagcgggtccaggccgctctcccccggggcagggtgggcactcactgggtccgcttcacctccgcgctggcgatggcactgatgaatggcaccaccctgccatagtgtaggaagagccgcaccagcgggacggccgcctcctgcttctcccggcaaacctcgcccaggatgtgggccgcagacgctgacacgggctgcggggaggggtgaggtcagtgccagggcccggggtgcaggaaccccagaggcctgtccccaccttggctggggtctcacttccagccacaatagatacggctctttgctgagacagaaacacacacattcacaaaaacaccaaacttcccatttgctgctgcttggctggacccttggaggggcatctgcacctccttctagcgacccccccatgcagccagctctagggcccctgagccggtagagggactctgatgatggggtccccctcgaacaacccggagagtccttagcatcaccaggctcccacggctctaactgtcgacggaccagtgcccccagcaaaggggtccaggcatctggacgggaaacaggccaggctgggaggcgtgggaaaggccccctcagggagaaggtgccctctggggtgggcccgggtgtagggtggggccccaggcaggtggcacctcctgcccacacccacaggccacggcgtggacaagcacctccacatccgcagacttcaacagcaggtcccgcagagggctgtaatagtcagaagaaaacacgtggtcttccgtgtataccacgttcagccgcagggagcccaggtcgtctggctttaggctcttgctaccattgtcccggggctggaggaagtacctgggtgggagggacacatggaggggaggcatgaggctgcatctgccaaggagcagctctcagggaagcccagctgcctgcttgaggtcgactggtcaggagggtgatcctgtaggacccctcagagtgcagcccctggggactccccaccgaagacccccagcagggctggtcaccggggatccccaggaggcaagtgttggagccaaaggcgcaggagtcaaggggggaaacgcggagggggatgggggtggaacgtggcaggaacgggtttccgggaaccggcacagaagtggtcagtgacccgccctaagacccacacccagcagtgtcagcagcaggtggaaatgaaaattatctcaaccaaagtgtgccgtggctcccgatgtcacggggtgggggccttgggctagtgagcctggcaggccacctgggcacctggtcattgtaagagacgttttctgcccggacattcttccatctttggttctaccccacgcagtcacccaggagccctcttctgctctcatttgtgggccaggcagtctaagctctcaggtgggtggagcctgtgtccgaggccccgcccccatcaggtgggtggagcctgtatccaaggcattagcccccgtcaggtgggtggagcctgtctgcagcattagcagcccggtcaggttggtggagcccgtgtccgagacattagcacccctgtcaggtaggtggagcctgtgtccgaggcattagatcccccctcagatggatagagcctgtgcctgaggcattagcccccgccaggtgggtggagcctgtgtctgagacattggcgcccccgtcaggtgggtggagcctgtgtccgaggcattagcccccctcaggtgggtggagcctgtgtccgaggcattagcagccctgtcaggtgggtggagcctgtgtccgaggcattagcccccctcaggtgggtggagcctgtgtccgaggcattagcagccctgtcaggtgggtggagcctgtgtccgaggcattagcccccgccaggtgggtggagcctgtgtccgaggcattagcccccgccaggtgggtggagcctgtgtccgaggcattagcagccctgtcaggtgggtggagcctgtgtccgaggcattagcccccctcaggtgggtggagcctgtgtccgaggcattagcccccctcaggtgggtggagcctgtgtccgaggcattagcagccctgtcaggtgggtggagcctgtgtccgaggcattagcccccgccaggtgggtggagcctgtgtccgaggcattagcagccctgtcaggtgggtggagcctgtgtccgaggcattagcaaccccggtcaggtgggtggagcctgtgtctgaggcattagccgccccccatcgccccaggtaggtagagcctgtgtgcgaggcattagcaccctggggctctctggggtatgtggtggctgccttggctaccagggccagggattcattcagcataggaggaagcctaactcagctcagggggcctgtgcccgtgccgtcttcgtagaatcaaaagacacgcgtgtttcacggtttctgggatggaaacctgccctcacacatggcagagggacacatggggtgcgaggccccggcacacagtccacgcctgggagtgcacgcttcccgtgactccgggccctctcaggagctgcctgtcgctaagggacacacatgaactggagataaaatgaaacaatggcctgttccttccaccaaaacaccaagcacctggagacaacaggaaagaaaggcaggaggcagcaacacacaacatgtcctggggtgggttctgggtcagagccgaccactgaggtctagacgtgcagaggggagtagagaaccctgtaatgcgccctcaacaggaggtgctgccgagggcccagaacaagacccggagcgcagccgcggcgcagccctgctgtgtgcgcattctgggctcctgcaccggctgctgatgccctcccctactggtgtcagacctcacgagctgctcgcggctcagggccccgctttcacccaggatcagaccccacgagctgctcacagctcagggtcccactttcgcccaggatcagaccctgcgagctgctcgcggctcagggtcccactttcacccaggatcagaccccgtgagctgctcgtggcttagggccgctttcacccacgttccctgtcttgttttgaggtgccagccattgtgagtccctgctcagtgtgatccctgctgcctctcctcacctgccatttctcacctgctgtggggcagaaactcatcaagccagagctcgtcagagctacatgcaaagtaagagcaggtgggtgctgggcacagccgaggaccagcacatgtggcctctgtgcctttccactcagaggcagcacgtgtttttgtggctctcagagatgcggaagtctgcaggtgcaacatcatcttaccacgcctcgtaggagctggactgccgcaggactttcaacgggatccttagttctcccaggaattcatctccaaacttcaggttactggcattccagaggtcaactctgaaaaacagcatcaggacagctctagctgacggcgggcagcccgtgtggagcaaagatgacaggccacgctttgttcccccaggagcagaatggagcctgcagcgcctcccagagtctccatcaaggctcagcccacagggcacgtttcaaacacgtcagaccagcctgtggctttggaataaagatgagtgtctcccagtggtaatgggcaggcagaggaaggcggaaggccatgggcccggactcagacccaggctcttagataggagggagcctgggcatcgctgcgtgcacccagaagctacatgaccccaggctcttacataggagggagcctgggcgtcgctgcgtgcacccaggagctacatgaccccaggctctgtgccaggagggagccaggcgtcgctctgtgccaggagggagccaggagttgctgtgtgcacccaggagctatgtggctgctgccactctcagctccagcaccatctgtcccctttgcccacaacaggcccagcaccagcagtctgtgcacggcgggcaaatgtagaaccctgtctccatggattgctcatgatctaggggcacaaagtggattcaggggccatgcacaccacagcggggggagaactgtggccacaaaccacagcacggtccacgaatctccgtgactaccgcaggcccagcattgtgaagcttctgctcatgtctaacacagcagcggctcccactaatgttctgtcctagtgtgggatggtacgtgtcccctcagacctggggctgtgaaattctgacagacatacagcatccccggctgcaacaagtctacagggctggtaacccagtccctcatggccaggacccactcataggcctgaaacacctgaagtcatgcgtggccagccctacccacgggcctgaaaccacacagttacacgtggccagccctacccagggggctaaaactcggcaggcctaaccacactgtgggcatcaggggcatccccctggagggagaagattccagaaggctggggattttgttacccttgcgaatcctgcagggaagtggcaccacagaggcactggcatctgggccggggagggctgacaggctgcacaggaacccacagcgcgttcctttcagaaggaacatgaggggaccgctgatctgcccatggacactttaaaaaaatgtgctgagtggccaggcaggcgcatttgcctttaataagggaaatatttaaaacatgttttgtgtgcttttaaaaaatttaataactaggacttcactcctgaattcaaaacttggtgtaaaaagaaaccaacaatggcgcttccttctcttgaaaaaggggctggtgtgagtccctggggaggcagatctgaccgaccacgtcagggacattctatggttcaggaccctgacccctcaggaggtggatctgactgaccacgtcagggacattctatggttcaggatggagacaactatgggggacggatctgaccgataacatcagggacattcctacagttctcaaccacaaaaccacgcctcccagcagccgtagggcctgagccacgcaccggctccacgtgtcccattaagggtccccccagggcagtgttagcccctgggagggagggtgaccagggatttgatggccagcacattctccaaaatgacctaaagaaagcaggtgcatcccaggctcagggacatcccaggctcggggacatcccaggctcggggaacatcccaggctcggggaacatcccaggcttgggggcatcccaggctcagggaacatcccaggctcgggggcatcccaggctcgggggcatcctaggctcggggtctcagggccggctggggagggtcaggagggagccgtttccttccttctctgtccagcatgggaagattcgggggcttcaggggaggctcatctgcctcttcatagggaatggaggcattcgttggtacagaaggaacagaggctacgttcaaaaataaacaggaatccagcttattttcactgggaggagggaacccgccggggtttgtgaagggcacattctgacgcctgccctccccagaactctgagtcagcgggatcgtggggctctctaaatcctgggcctgagatcgcgtcctgacctgcgtgaacccacaagcgatttccccgtttcccgtgggaggcgttgaggagccaggaaagggcggtgggggctccatgggcaaaggctgaagatgcagcttctatgaccatacacaggaaacatgaacccaggacgccaggtgagagtgtttcactcgagtcaaaggggacagggtctccacagaggccacccagccgagagtttcagcagtgccagtgggtcctgctcggtcagggccaggcgtcgtgctgacccgccaggccctgcgacctctgagtgaggcctgaacccatggaaggcggagggcttagaacaagaccttaagaacggctgcagcccccgtcactccaggtggatgaagccttacggccagagggatgcggacctctggctttcgcctcttcgcaggtattgcaaggtgagccctaacaccacccacaggctgtcacttcaactacaacttctaacatcctgttgtgaaaattaccaagaaaatggaaattcatttctatctatgaccctatatttagtaacaaagaacaaaagagctgaggagtttgggtgaaaactgccaagttggggacgcggagcctggttttctcacctgatttcgagcttgtccacgtcttcctcctcaaagtcaaagtgggacttcttgctgtagctacagggccgggtcacctggagtcagacgagagagaaagcgctgagaccgcggtgccaccaggcgggggtatatgcggacctaggccccgggctgccctaccctctgcgcttacccacacaccactcaagggccacaaccaggaaggcgccaggcgggattcgggattcaggcctggcttcctgagtgccagcatttcctactcacggcgcccctggaggggcagacccaggtgagacctgccccaaggctgttcacggccacggccggactctcccagtggctcctgatgggtgccgggctctgggtacctaaatgtccgtcacctgcgcctgctctgggcctgccaccccgtgagggagggagggtcccctctgccgtggagacgaagccagcgccgccctcccgtggccccacctcaaggctctatttgccaacaggaagtgaaacgcgtgaggtctgtggagcctgaacctggccggccccgaacaggccccagcactccagggagggtcagacggtggaaagtcaagacgctgctaccttcctcctgacacctccgcaccgtgggttccttagaacagaaacggagtgaaggcgtgaagggtcgaggctccgggaccgccccccgccagccagcagggcccttgcagcagagcaggaggccgacccacaggctccaggagacagtggttatcacctggagttccgatttaaccaccatcagccgtgcaccaggtcacctgcgtttacaagaagggctccgtcctgcccggcctccctccctgcccccccttctccgggcctcagcagtgatgctggctcaggagctctcagctcgaagttctgatgtaaggcttgacaccaaaatcatgttgctaaaactgcctaacctctgagcttgcacttcctgattggtaaactgaggtgaagatcacgcaggggcagttctctgcttcgggttgagggctgctgacgcctcctccttcctgacctacacaccactgtccaaaaatttgcttccccccaacttccccatctcacaaaactcaggtcaggcaatgcctcctccaggaagcccccagtgcccctgcctcatgccctctctgcagggcaggtcaggcaatgcctcctccaggaagcccccagtgcccctgcctcacgccctctctgcagggcaggtcgggagctattgtaggggcttgtctgtttgcatccctcccatgctggcctggtgtggtggccttggactcctctgttttctgccacatcttatcaccagctgatcaccagcacggtgctggcacctgacacgtgttgagtgaatgaaggcagctcctaccaaatttatgagattatttaatctcatttagagagttaaagggtcttaatgtgtctagttgttatcctggaagaaaatggtacagacgctgcttcccatagaaacggaacatctgttttcctgggtctgctcccagtaggtggctgtctgaccacagcccgcgggggatgtgctccctccccggggctcagcctccagctgggtcagaagcagctgaagccgaaagagacagagtcctggtgaaagaggtctgctaaggaaggggaggagacggagtgaaaggtcacagagcccaaagagcagggccccgcgcgtcccacacagcagcggtcagcgaggtccgggccttccctggagccccacaggtggtgacgcagaccatggttttcagactgtctgtggtcactaaattgctcctgtaggctgagacccacgtctttacagagtgaaacaggagtgcacacagtagaaacagcatgagaacactgcaagcgtgatgagcacccgtgtgtggccgggcagtgggcgagctctaccccactgtgtgtatgacagctctgtgtgtggcagccaagccagcagccgaggcggggggagctgccacctggaactcggtccatgctgcatgcctcctgcacctccaacagggcccaccctccccctgggagcctggcagctccctgccttccctcgctctggcaaaaccatcttctccgcctgtctataagtgaggcttccgtttgagacagagaacagattccacctctaaagccctcctcacagtggccctgaaagcctggccctggctttggacaccaagttcccacctctgcctgtggggccctttcgagcctcagcagtgccagtgggtcctactcagtcaggacccactgaccggtaggtccactctcctacggtcccctgagagctgcatgcatcgagccccactcagccatcatggctcaggggagcccgcccgacccctcagatgtgactggccatgctcttgccacagaggcctcatccatcctcacatctccagggcctgtgcaccggaatgtttgtggatgggaagaacatctgcctaaaggccctgcacacagctgtccccaaaccgcaccggccacatggcaggtcctcactccacgagatgcagccatcccaaacggggtcacattccaccaggtgcacccttgcaccctccttttcatggattttggtgcttcatgttctgagaggatctctgtgtctgaatcctttcccctttgtttcaaaaccctgcctatttccactggaacaagccttccgcctctcagggatgcttgggcagagcagccaaaaaaacaaaaacccccaaggtcctggtaatttggaaagcattaatctgtcatcttttaactcaaatctgggccagttcgggagacaacgaatgacctttctctcttgggagaggagggaaggtcctgtggccacgggtccaatccccagggctggctggctgggctcgctcctctccggaaggaacccagggccggccggcggggctcgctcctctccggaaggaacccagggccggctggcggggctcgctcctctccggaaggaacttccagagggaagagactgagatcattctggatccagactttctgccaacgtgtctcgggtgcagagtttccacttaacgttgacccatgaagataccaacctcaaaataaaacacttcatcgaactggggattgttggtcttcctcttcactttcgtcttctttgcttctgatctgttatcaagtgagaaaggattgggattaaaacaacactgctgattccaagtctctcagtggtaaaaccgagctctcaaatgcacaagtcacttattggctttatttattttataaatatttctgctggtctccaactccagatggtatgcaaatcaggaacctttactcagccaaaaatacccagcgtgaagagcatgaaggcttcattttctacaaagcaattttggagcaataaagaaaacaaaaggaagtaaaaattcacattctacctcaaagcgcaacctcctgactcctcccaaatgaggcagtggtctcgtgatttcagagctggaccctagccccccaggaccagaacagaaacctgaagcgtgaggcaacttgcctgaagggtcctgccagcgtcacggtggcgtaggggtcacattgcccattcacgatggggaggccctggcactcgacgatgctgaggagagaagcagaggcggcgtcaggagggagcgcagacacctgggcgaatggcgagacagctctgggtcaggcaggaggcctgagttcaagctgtgagatgaggtttcctcaccggaaggcagggagggccacaccagccattctgcctcggtgtgacgctgaatcacgctggccattcacaaaagcccaaaacaacacctctaaggtgagcatgtgctttagcgtggacgccagcagtgtgtgacagcacatctaaagcagcgtcatcgggggggcggggggcaggacccctaaaacagtgtcatcctgggggccaggacccctaaaacagcatcatctgggagccaggacccctaaaacagtgtcatctgggagccaggatctctaaaacagcgtcatcctgggggccaggacccctaaaacagtgtcatcctgggggccagggcccctaaaacagcatcatctgggagctaagacctctaaaacagcatcatcctgggggccaggacccctaaaacagcgtcatctgggagccaggacccctaaaacagtgtcatctgggagccaggacctctaaaacagcgtcatcctgggggcccagaacctctaaaacagcgtcatcctggaagggggccagaacttctaaaacagcatcatcctggggcaacctctaaaacggcatcatcctgggggccaggacctctaaaacagcatcatcctggggccaggacctctaaaacagtgtcatcctggggccaggacctctaaaacggcatcatcctggggccaggacctctaaaacggcatcatcctggggccaggacctctaaaacagtgtcatcctggggccaggacctctaaaacggcgtcatcctggggccaggacctctaaaacggcatcatcctgggggccaggacctctaaaacggcatcatcctggggccaggacctctaaaacagtgtcatcctggggccaggacctctaaaacggcatcatcctggggccaggacctctaaaacggcatcatcctggggccaggacctctaaaacggcatcatcctggggccaggacctctaaaacggcatcatcctggaggccaggacctctaaaacggcatcatcctggggccaggacctctaaaacggcatcatcctgggggccaggacctctaaaacggcatcatcctggggccaggacctctaaaacgacgtcatcctgggggccaggacctctaaaacagcttcatcctggtgggccaggacctctaaaacggcgtcatcctgggggccaggacctctaaaacggcatcatcctggggccaggacctctaaaacggcatcatcctggggccaggacctctaaaacggcatcatcctgggggccaggacctctaaaacggcatcatcctggggccaggacctctaaaacggcatcatcctggggccaggacctctaaaacgacgtcatcctgggggccaggacctctaaaacggcatcatcctgggggccaggacctctaaaacggcgtcatcctgggggccaggacctctaaaacggcgtcatcctgggggccaggacctctaaaacggcgtcatcctgggggccaggacctctaaaacagcatcatcctggtgggccaggacctctaaaacggcgtcatcctgggggccaggacctctaaaatggcgtcatcctggtgggccaggacccctaaaacagcatcatcctggtgggccaggacctctaaacagtgtcatcctgggcagccaccggctctggaaattcttgtgcgttggtgtgaaaacccctgtgtgctcctcgggagccagacatgccactcgctgtgcgctcggtctctagtgaggacgtgtcttaccgtgtggcgagcttgtggcagacgaccccagtgtctgtgatgacctcgctcagccgcagctccaggtgcactttgccctgcaaggcacaaggatggggtgtcagaggctgtggcgctgctcccacaggccactagggccgcgcgcccagggaaagcctagagggcaaagggagcaggcggccccgccctgccctggccaatgggcacgtccagcccctccactccacccccgggacgcagggtcccagctgtggcctttctccaggagagctgcttgcctgactgctcagccccatgtggctgcccaggctcctggctctgctgagagcaggtcgctgcctcagaagtgaggggtccaaccgtgtaggagacggtcattcagtgaagcagacccccaaaggctctgatgctgcaggctgctcgtgtgtccgtcgggacaaaccagaggggaagcacagctgtctcccaagcaggggccactgcctttacctcccctcgggcgaggccggatggaggcccgcaggaacctcggagagctcacacagagggcaaggctcacacagagggcaagactcacacaggaggcaagactcacgcagagagcaagactcacacagagggcaaggctcacacagagggcaaggctcacacagagggcaaggctcacacagagggcaagactcacacagagggcaagactcacacagagagcaagactcacacagagggcaagactcacacagacagcaaggctcacgggggcttctagcagagcagacagcaaggctgccctgcgggtccacctgtctctctagatcagtctgtctgtgtgtgctgctgtgtccatccacctgtctgtctgtgtgcacggctgtgggtgtgtgtccacctgtctgtgcgtacaactgtgtgtctgcctgtgtgcgtgcggtttgtgtgtgcagctgtgtatgtgagcatgctgctgtgtgtgcatgtccacctgtatgtgtgtccgcctgtgtctgtgcatctggctgtgtgtgtgcagctgtgtgtcctcctgtgtgtgcggctgtgtgtctacctgtgtgcgtgcaactgtgtgtgtctatgtgtgtctgcctatgcatgcatgcgactatgtgtgtccatctgtgctgctgtgtgcgtgtctgcctgtgtagctgtgtgtccgcctgtgtgtgcggctgtgtgtctgcctgtgtgcgtgcaactgtgtgtccatctgtgtgtggctgtgtccacctgtgtgcatgcgactgtgtgtctacctgtgtgtgcatgtgattgtgtgtatctgcttgtatgtgtccacctgtgtgcatgttcgcctgtgtgtgcatgcagctgtgtgtgtctgcctgtctgtgcatgtggctatgtgtctgtgtgggcgtgcgattgtgtgtgcgtgtccgtctgtgtgcacacggctgtgtgtctgcctgtgtttgcatgaaactgtgtgtgtctgcctgtcggtgtctgcctgtctgtatgtgcatctgcctgtctgtgtgtttggctgtgtgtgtccttctgtgtgtgtgtgcgactatgtgtgcatgtctgtctgtgtgcaagcagctgtgtgtgcatctgcctgtatgtgcatgcaactctgtgtgtgtctacctgtctgtagtgtgtggctgtgtgcatgtccttctgtgtgtgtgcgcgactgtgtctgcctgtctgtgcgcgtggctgtgtgtccacctgtgtatgtgtgtttgtccgcctgtctgtacatgcgactgtgtgtgcatgtctgcctgtgtgtgcaccgcctgtgtgtatgtgtgactgtgtccacctgtgtgtgtgtgcggctatgtgtgcctacctgtgtgtgccgctgtccctgtatttgctccagcctgaatggcaatgaatggatgggataaacacagactcatccatgcttcaggggctctgcctggcccggcccttagctctagctcctgaggctccgggaaggccaaggcgtgttccccagggcttgtccctgcctgtgggagggtgggacagacgggcagaatgcctggcgctaagacgtggacggcagaaccgacagcagccctgcagcacgtggcctggtgcagaacctcggatggagcagggacctcgcttaggccccacccacctaaatgattaaaaaaccttcgagttccttcaaaaatatatcagacacctagccagccttgagtggtaaatcacctaacaagcaaaataaataataaaataatagccaaaaaattagtcaggagatatttattccctatacaagttaaaaatagcatcttaacatatgtccctaaattgtttttcaaaaaccgagaccctcaccaaacagatctaccaacacagaccacaaatgcaggggggatcacaggcccgaaccctgaacccggctctattctgaatttcttcctcaggggccaggaggggtcatgcctgtgggccagagccaacattcttttctgctgatctcaattgtttggacaaagcttctcctccttaaccaatcacaaatcaaaaacgctctatatccgacccatgggccacacgtcgtgatgtctgccttctcaggtcaaactgacatacggcctccatgtactgatttatgactttgccacaacctcagcctccccaccttctgaaacccttgcctgtgaaccctcggggtgcctgggtcgtgggcgcagcctgccctgccagggtgcacaccccgaagcccctggtcagggagtggaacataaagcccttcagccctcacttgacaccgcgtcggtgcagccccacggcacccccacacttgatactatgccccacggcacccccacacttggcaccacgttccacggcacccccacactgacaacacgtcccacggcacccctacacttgacaccacgttccatggcacccccacactgacaccacgccccacggcacccccacactgacaccacgccccacggcacccccacactgacaccacgccccacggcacccccacacttgataccacgttccacggcacccccacactgacaccacaccccacagcacccccacacttgataccatgccccacagcacccccacacttgacaccacgttccacggcacccccacactgacaccacaccccaaagcacccccacacttgataccatgttccacggcacccccacacttgataccacgttccacggcacccccacactgacaccacaccccacagcacccccacacttgataccatgccccacagcacccccacacttgacaccacgttccacggaacccccgcactgacaccacaccccacggcacccccacactgacaccacgccccacggcacccccacactgacaccacgccccacagcacccccacacttgacaccacgttccacggcacccccacacttgacaccacgttccatggcacccccacactgacaacacgccccacggcacccccacacttgataccacgttccacggcacccccacactgacaccacaccccacagcacccctacacttgacaccacgttccatggcacccccacacttcataccatgttccacggcacccccacactgacaccacgccccacggcacccccacactgacaccacgccccacggcacccccacactgacaccacgccccacggcacccccacactgacaccacgccccacggcacccccgcactgacaccacgttccacggcaccccacacttcataccacgttccacggcacccccacacttgacaccacgccccacggaacccccacacttgacaccacgttccacggcacccccacactgacaccacgccccacggcacccccacacttgacccagcgctcacagggggaatggaactgggtctgtgctgcccaggcaggtgtgggaggtggggcctccgctgctgtcctgagactctggggtctggaggttgggtgtggccttcccgccctgtggctgcagccccagagcaggtcctgaggggccacaaggatgttgggccgggaaggtgggcatgaaccccacgccagcactgtgggcggggaaaacaggtgcctaaaatgacaacaaagaccccaccaagaccacagctcctcttcccacacccatcagagctcagggctgagcggagtatcgcctgtggtcctcaccgcctggcagcgggcctgctatccgtggctatccatgggctaaaggagtgccctgaacaccagccgggcagtgggcctgctatccgtggctatccacgggctaaaggagtgccctgaacaccagccgggcactgggcctgctatccgtggctatccacgggctaaaggagtggcctgaccaccaaagacaggagaaagtgcctgacccaagaataaccaagaatccccactgcttcatccccgttctcaaatgccgggcgcaaactctctcaggacagaagcgttcagatttgcaaggctgtgcagacggaggtagctctattcacattcgggagcttcaggaagagtcacgactgcatgtggggggtcctggtccccagcagcaggctgtgtggcccccgtgtgctctcccggcccctggcagcaggctgtgcggcccccgtgtgctctcccggctcctggccgggtccaggggcacctggctggtcaccatcaggtcctgaggctgctcctgttcctgcagcatgaatccctcctgaccagctgacttgtgtgctttcgtcttctgctgattcaggagtgggaacaaacaaaacccacccctggaaggccctttctcctgccagaaaagccaatgagtaaatctgcaggtgctggcgcaggctggagaatcccagacatttagaggttaaacaacacagttctaaataacacacagatcagagaacgcaagacaaattttaaaatgttccggaataaacagaaatgaaagtgttactcatcaaaatcagtgggatgaagcgggagccgtgctcggggtggaggggaatctggagtgccggccacacagactagagcagaagggagatctgaacgctgacctgagcttagagcagaagggagatctgaacgctgacctgagcttagagcagaagggagatctgaacgctgacctgagcttagagcagaagggagagctgaacgctgacctgagcttagagcagaagggagatctgaacgctgacctgagcttagagcagaagggagatctgaacgctgacctgagcttagagctgggagactgagaaaaatgagtaaactaaacccagagcccaagaacagaaaacagaagtcagatcggaaaccaataggtaaaaatcaaagccaacggcaaattccttgagagatcaataaaattaataaacctcaaaccaggctactaagagcaaaagggaaaaggcacaaattcccacaggaaaggaacgagaggacctggctgccgaccctggcacctgcctggacgctgcactgaggtccctggcgctgcactcctgcgaactcacagacgcagcaaaggggccccagcgtccagctcctgacaacgtgtggctgcagtgtcacccatggggccctgggcgggggctgctgaggggtgtatggaaactctgtactctgctcaatttccctgtgaacacagaactgcccccaaaacagagttaattaatttttaaaaagcagccaatggtccctatccatctttctcaggaaggccttccccagggagagagcagcgcgcagagccgggtcagggtcctggccccacccaccggttgccgtgtcccccactgagcgggcagcggcccagagagcagccaggacagaggtgccttggatgcaggactgttccacgccggccgcagagaggagacgaagtccgcgggcagatgagacaggatgcagaggccatgaggaaggaagcccagcctcggccgtctcctcttacaaccctggagagatgtgaaagcttgacgacggacggtgactttgtttgctccgaaaatccttccaagaggactgtctgctgcacaaacacaaaattcccagaggctgtagcaggaggctggaatttccagcccagtgagatttcacggtgcaactggaaggctccaagggggaaacacgtaggtgtctcttgggcggatggcagacccaggggtttgctgtgatcccctgcagggctgtgctattttctgaatacgtcacagatgcacttgaaagcctggtttataaacggagctcagtgacccccaggcgcccagatcaccgcggatgcctcgctgtcacaggcggtgccctcgctggcatctgacgctggcatctcccccactggcatctgacgctggcgtctcccccgctggccctgcatcaggggagggtcagagagcacaactctgcataataaagtgatttaacaaagactttccaacagtggccgttccagaaggaagcaagaaaggtttaattgtgtttcccccatttctgtgactcacttgctggcctcccccatgggctgcttctgtgacactcgctgtccggacacaggactgttcctgggaatcacagagcggagggactcatggagccacatggctaccccctgccttcctgaaaatggtcactgtgacatcttatgatgaaacggcggctcctgagactggagttgtggggttttttttcttcttcttcttctttttttgagatggagtttcactcttgttgcccaggctggagtgcaatggcgcgatctcagctcacagcaacctccgcctcccgggttcaagcgattctcctgcctcaacctccggagtagctgggattacaggcatgcgccaccacgcccggctaattttgtattttcagtagagacggggtttcaccatgttggtcaggctggtctcaaacacctgacctcaggtgatccacccgcctcggcctcccaaagtgctggaattacaagcatgagccaccgcgcccagcctggagttgaggttttaaaggttggctggagtccagcagggccactgctccctgtcacgctacgttttgggcggcgttggggctgactgcatcagtgaagcaacgcattggagagcagcgggcattggagagcaatgaccttgcctcctcccttttagacaacagctcgcatttgccttccataaagtgcaaattcccgggagactgacaccactcggttcaggatcctcatgttccggacagtgagagtcaggcttggaggacgctgggcttggccacgggtacgcagcctcgggcgttaattatgagattccaccagctgtgagatcaacctgcggcattcttatttacagctttgtggagatgcaacgtctgagtcctgatcgtcatggtggttacactatctaccctgtgatgaagttgcaccgactgtcacaacagcccatcggcaggtgactggagcaacagcacacgcttcgcacctcggaccattcctcagccttggaaggaaggaggttctgataccacaagcgacccggaggatgtcacgcagagcgacattagcctcagaaagaccagcagggtagagctcactcccatgagccacggggagtggcctgcgtcagagacagagtgccatggggctgccggtggggaaggggcggacgggagcgtgtgaataaaactctagccaggggacagaggggacggaggttccgttttgcaagatgaaaggagctctagagatgggtggtggtgacggttatacaatattatgaatatattcaatgctataccactgaattggacattttaaatggttaaaatggtaaatttcatgtctctgttttaccacataaaaaactggaaaaaatagcatagaatacacagagagacacacacagaaacacgtgcctgtgaactggtgaaatctggataacatccgtggactgcacaaacgtcggcgtcctggttgacgttgcaccagctgcgcatggcagtgcctggggaagccgggagaagggagcacagccttctgtttggggaagccaggagaagggagcacggccgtccgttcgggggagccgggagaagggagcacggccttccgttcgggggagccgggagaagggagcacggccttccgttttcagggaaaggtgggaattcgcccctcgccactcctgtgtactgttttgatgccttcctatagatctataaccatttcaaaattaaatcagtaaaaaaaaaaaaaaggcaagaaagaggaaaagctacacctgccaataaaaccaaacttgaatccgaggcaaacgacgaggccgcactctgccagctgctcagaggccgttgtgacggagaccccagcgacggcgggtatcccagaatagaagagctggggaactcgccgacacgcaggcgggagcggcccagtcaccaagccccgtctcccgggcagcacgtgggaaaccccgcctttctgccgggacgccaaggtccgtgggagcagcacgctggggcccttgtgctccggggatgcgaggacagtcattagttctgcagtaatcacagcgtccttcactttccacagcacgtgtgggttccccagccagtgctttcccaggaagcagagttaattaagtgtgacgcacaattagcacaggtcccttggggcagggccatccccagggcttcttggctccactccttaatttccgtcaagggcctcaccccacccccacagctgggctcatggtcaacttcatgaatgaaccctttgctggccatgggcgtgtgcacagctcatgaccttggcaaatggcaaccttgacccagtgaagcgcagaggatgagggttgccagggcaagacggttcccagaggacgagggttcccagaggacgagggttcccgagggatgagggttccaggaggatgagggttgccgggggacaagggttcccagaggacaccaggccatccagtcccccagcccaaatttgccctgaacttgcgggcacagagcctccatccgacccacccagttgcctctgctgaagtctcaggcgaagtcctcacaaggaacctattttggggatttgtccaggatgccagcctccaggtgtaaaaataaccatcacagccaccaatttacgatgcgccaggtgccttcgagtggcacacacgccataccagcacgcttcacaaacccacccagatgggaaaactgaggcctgcaaaggacgttggcaacaatccgatgagggagctggctccgagcctggcggcctgtgctgggactctgcactcagacacacactgtggtaccagctgaggacccaggaagccctcccacatcccagggccgctgtgctgcaaccccatactcagacactcaccctcctacgtcccagggccgctgtgcagcaacactacactcagacactcactgcggtcccagctgaggacccaggaagccctcctgtgtcccagggacgctgtgcagcaaccctacactcagacactcactgcggtcccaactgaggacccaggaagccctcccgcgtcccaagggcgctgtgccacaaccctacactcagacgctcactgcggtcccagctgaggacccaggaagccgtccggtgtcccagggaccctgtgccgcaaccctacactcagacacttactgtggtcccagctgaggacccacttgggaaaccctcccacgtcccagggttgggccacggtgcctcttgcttgtggcctttgcagctgctctgtgtcacagaccagggctcagggtgaccccacaggagctggtgcaggcttgggctccggtggactgacccccactgctccctctgttacaggcaagcctggagcagctgttgccgggcagctgggcaccgtgcgtccgtgagcagctgtgaacacaagggtctgggacatgggccccagcactggagcccccggtcttgcgtggggaggtgggacaagctccccccactggacaggaccggggtgagccccagtcagcacacagtcccggcaagccagggtgagcccctggccactttcgacaatggacacgggagaccagaacgctctttcagctcagacccttcttggtgccgcgtgccaggcaacagcccgcccagccaaccgtggggaagtgagggtccctgagggctgaccctggctcggcccttccccacccatgttttctcttgggcctcaatgacgcgtgcctgtcctttcccaccgtgtttgttttcacagcttcctcagttgtgcatgacaaagggcggcagtaggcaaagggaaaacccaaaatccatgcacggagcccaggctcactccgagcacaagtgggcgaacagacacaatgcaaaatccatgacagagcctgcgctcactccgaccacaagcgggtgaacacgcccaacccaaaatccatggcagagaccgcgctcactccgagcacaagcgggcgaacacgcacaacccaaaatccatggcagagaccgcgctcactccgagcacaagcgggcgaacacgcacaacccaaaatccatggcagagaccgcgctcactccgagcacaagcgggcgaacacgcacaacccaaaatccatggcagagaccgcgctcactccgagcacaagcgggcgaacacgcacaacccaaaatccatggcggagcccgcgctcactccgagcacaagcgggcgaacacgcacaacccaaaatccatggcggagcccgcgctcactccgagcacaagcgggcgaacacgcacaacccaaaatccatggcagagcctgcgctcactccgagcacaagcaggcaaacacgcacaacccaaaatccacacgcggagcccgcgctcactccgagcacaagcgggcgaacatgcacaacccaaaatccatggcagagcctgcgctcactccgagcacaagcaggcgaacacgcacaacccaaaatccatggcggagcccgcgctcactccgagcacaagtgggcgaacacgcaatctgctcatcgttattcccagtcaaggccgaagcccgatctacgtctttagccacagtcggagccgggcccgtctcgaagccccatggtgtcccagggctctggtttccggggctgcgccgagagtctcacctgcacttccgagtcagcgtccacgtgctgcagctggaaccaggtgtccctgttgtggtacttctgcaagtcctccttctggatggccaccttccctgcaacacaagcagagaagacttcaccacgggcacaggccccagagccaggacgcctgtgagcagaagccagcccatcatcaccgcagcttatttccaacagtttaattcagaatggggcaccggccgggtgcggggctcatgcctggaacccccacgcttgggaggcccaggggggagggtcgcttgagaccagcctgagcgatatggtgaaaacttgtctctacaaaaaataaaggaatgagccgggcatggtggcactgtatctctaaaaattgatattaaaaagtcaaaataatcaggtgcagcggtaagtctccactgtgtcccttccagtaaggcgttccagaggcttcgctgtgaaggcgcgaacgtccgctccatcggcaatgtgcgcctcactttcactgtggtccgtggccagttctcacagcaggaggtgcctcggagctggctgcaccagagctctgatctcacaaatgaacaccccgtgcctcacacaccaccaaggcagcagcatcacgccacaagagacacgtgtgcacccgtgcgagcgacagcctgaaacacacgtgtgcctagggtgctttccgtgtgtgtggacacgcacgtgtgtgcatgcatgtgggtgctcaggttattcacaggcaggactgagagccagaatgagctgccaccttcccacgcgacgtgggttggtctgaatctgtgcctctaaagtgtaatgaatgagccgccttctgggacccctggagagcctgaaagtgtagattcctggccttctccagacggaggagaacagaggctctggtgtgggctggaatctgcaccaccacaggtccctgggcacttgtgtgggccccaaagtctgggaacgtccactctaaacagtttcccgtgccttaaacaggcttagtactttggggctacgcttccagtgaaaatacgtatcagaatatatttgtacaatatacgtttacctagtatggatttatatgtgtaaattcgcatctgcaaccattattatctgcttatacgttcacctcattccagaaacattcccgaggcgcggcaaacgtgtgcccatcccatccccggcaggacagggcttgtcaggcgctgggcaccgagccatctcccatcctgcgtcccttcatggcaccaccatgtcaaccctgccagtggcctccgcacactgcggaccacgccacccaccacggtgagcacccacggcagcacatgcacctctgttgaccgatgcacgtgaactcctagggagtcgcacacacatgtgaagtctgagcccatcacagagcacacacgagagcaggagtgaggaaggaaatgttggcagactcctcacgtcttcgttctgcacccagagacacacacgccctccttaaggatcttggtccagtcactgaagtgagaaactctgggtccccgcagacccggttcaccgcagcgtccgcagccacagggtctgagcacattgtgcatgacctgggctcccgggagcggcctgggcctcctacccggccaccctgcctcacgccaggacagcgcagcccagccccggttctctcttccaaggaagatccttttatatttccgtgtctcaaaaaacttccgcaggctcccatcggaacaaccctggcctggcatccagcagccacatgcttgggcctgattctctgtccagcctcagtaaattcgggaacactccactgccagcctctcacaggtgccatctcagtcggtcctgcggtgaccctggaggagcaggtaccactctgcacaccccacagacgagcaggccggggctgcagggagagggagcttccgtccctgccttcctgccagcgttccttcctatgttggcgtccccaccctgcgaggtcccaggacgcatcttccctcaggagctcctctgcctcgcgggctcatgcgagcgagacctctcagcctgactggtccattccgtgactaatctcagagcccgtgggcctgggccaccaggcccctcctttgtctgcaaactcagagggtctgagacacgcccagctcagcaccagctccagaccctatgggacagcgcaaggtcggccacatgatggagcaccacatggccacaggacatggtgggaggtgcggaaggtggaaagaggcacaaagacgctttccaagtgcccaaaggagagagacggaatcaggacagtttgcctccagtgctgctgacacctgccatgcacgtcagcatcttcatctgatgtcctcaggggagccggctgcacctcacaccatccactctgcaaagcaaagcagccctgggaacagccctggaaaaagccccttcccagctccgggacccccgctcacagccagggccggccagttccacagctacccggacgtagatacagcacacaggcactcatgggttcctaagatcagcctggtgacctcatcggctcagctcttgccacacagacatacacaggccatctggagctgcacgggacgctgaaaccaccactgagggcaggcgagagccaaatcaagaaccaagggggccggcacaggaaacaggccccagcacatgtgggagaaggaacaccagggaggctcagagagaaatccagtgacacaccacgtggactccctccaatggcctctaatggcgcagaccacgagggtggacgacagccaggacacctccgcctggcccacctcactcgctgagccccccgccccgcctcactcgctgagcccccccgccccgcctcactcgctgagcccccccgccccgcctcactctctgagcccccccgccccgcctcactcgctgagctcccccccgcctcactcgctgagcccccccgccccgcctcactcgctgagccccccccgcctcactcgctgagccccccgccccgcctcactcgctgagctcccccccccgcctcactcgctgagctccccccccgcctcactcgctgagcccccccgccccgcctcactcgctgagccccccgccccgcctcactcgctgagcccccccgccccgcctcactcgctgagccccccccgcctcactcgctgagccccccgccccgcctcactcgctgagctcccccccccgcctcactcgctgagctcccccccccgcctcactcgctgagcccccccgccccgcctcactcgctgagccccccgccccgcctcactcgctgagctccccccccgcctcactcgctgagccccccccgccccgcctcactcgctgagccccccccgccccccccgccccgcctcactcgctgagcccccccgccccccccccgccccgcctcactcgctgagctccccccccgcctcactcgctgagccccccgccccgcctcactcgctgagctcccccgccgcctcactcgctgagccccccgccctcccaccggcagccctgggcgggcgcctttgacttcaagggtccggagtgggggctctgtcctctcctctgacgaccgctgcgtggctcttgcataacctcccctttcccccacaacacgaacctcagttttgagtctcacaggaataaagccacatgaaagcaaaaacttcttaaaactgagttgggcaatatatttcagtgaaaagggataaatcttcagactccaagacgccttcagctggacaggagggtcagttttgaagtctgaagttttaaatacttgcaatgtcactgtgtcttcacatttttatgagctgaaactgggacgggagaagtcacatatttacgtggataaaaatcttgtaactggcacatgattacaagtctttaattttagaagtacttcacttaattttttaataggtaacacagaaacagaacaaaatccacaacattcaaaaggatttaaaatcccttcgagaagggatccctgcccctgccacctcattcccgacgtggggtcacttctgtcaccagcccccaacctttccttctagaagccagccacattcaacaatggggaccgtggacatttgaagcatgcgtgttcgtatctccagatgctgacctgagagaatgcctgatctaaaagccacggcgtctacttaaatttctctgatgtgcctaatccacagggttgtccccatctatttgagtcacaccgaaaagtttaccgaacactctgggcctccctttctcacttgggcaaaggcggctgccttctcaccacgagaggccggaagggtcactttcttctgctgcatctgtgctggccaggcccgttcagaaaggaggagccaggggtctggagggcatcagacgggggaccagctgcagagggaccagaaaaaggggaaacagccacaggacacaactgagcaagagctgcccgagacagggaatgcggctgaaatgcgcgcgcctccctctgaccccacctgtgtcccagccagggccacgaggaaaaaacaaaggccatacagatcccaaaggaagaaataaaagcctttattcatagaatgtacaaaaaaaaatctacaggcaaagctaatagaactaattggtgtgttcagcaagaacagagaacacaaagtcagtgtggagacgtcgactgcgtttgtacatacaagcaatgaccatgaaaattacacaaaaacagcacctttcacaaaattatgcttttaggtttgtgcttttggtggactacctcagaaatctttaaccactccactaaacacataaaacacagggaaataaatgtttttaaatgtgcaaaatgtgtaggctgaaaacacatcacaaaacactgatgagagaaattggaaagacccaagcgtgtaaagatataccatgtccatggatttgaagactcagttttgttaagatattaattctccccaaattaatctatagatcaatgtaatcccagtcaaaattcctgtgggactattttggaaattgagaagctcattcaaaagtatatatggcaattcaaagcatctagaatagaaaaacaagtttaagaacaaatttgatgatcttacactacaatgtaagacctgctatgaagctatagtgatcaagactgcgtggtattggcatgaggacaggtggatcaatatgacacacagcaggcgagccccaaattggggcttagcctcagagggtctgtagcttcactcaggaaagaattcgagaatgaggtggtggtggaagaaaacagttttatggaggcggcagtggcagctctgaaactgctcctgcacagcaggactccccacgggcggggtgttgacagtctcagccgttcctgcagagaagggttccccataggcagggtgttgagagtggcacctccgggcactgctgcagtcttatttatcctcacttttaactatatgtcaattaaaagattatgcagacatttctagaaaaagggtggtaatttccgagtcacggggttgttcctatggaaaggggtggtaacctccaggcgttgccatggcaatggtaaggtgacatggtacactggcaggcgtgtccgatggaaagctgcttccacccatccctgtctcagctagtcctcaatttggttcggtgtccgagccctgccttcagagtccagtcccgcctcctacctcagatggaagagaatacagaggccacaaacagacccacacaatgcagccaactaagctgtaaatgtgccaaagtcatcaacggaggaagggtcgtctttcagccaagggtgccggaacaaagggatgtctacatggaaaaaacagaatcccgacccttttctttgtgctataagtgaaaattagcttgaaacagatcatggaactaaatgtgaacgctgaaagcacatgctttccaggagaaaaccgccacaaccgtggaataggcaagactttcttagacatgacaccacaggtacaaatcatacaagaaaaaaatgtgataaactggaccatcgaaattaaaaacttctgttcttcaaagccaatggtaagaaaatgaaatacaagccacaaactggaagaaaatatttgcaaagcacacttgtgatagactcgtatccagaatatacagggaactttaaaaagtaacaagaaaacaacccaattaaaagggcaaaagatttgaacaatgtactaaagaaggaatggagctgtcactaagcccaagaaaaggtcctcgacgccactcttcacggacacgcaataaaagccacagtgagacagtacacacctatgggagtgcaaacggtaactagagaataaaaactcacagtcctaagggccgggcaggatgcgaaatacctgctgctctcacccgctgctggagagaaggcagactgggtgaccacttggagacacggttgggtagttttaatgaaagtaaacacacaccctacagtgacccagcaacctcgctcccacgcatttatctcagagtaagaaacagaaacattgtccacacaaagacctatccgagaatgtttacggtgactttattcataattcctgaggattagacacaatccagagggtggatgaggcggctgagctgtgtctgtatgatggaaacccacgggcagtggaagggggcggcctggctcacagccgcacagcgcgggaccagcgcagtggcagagggcacggcccctccagggtttgagtcacgtggcctcctggaaaaggcaactgtgggaacaggcctcagagcagtggctgcccggggctgtgggccagggtaggaaatccaccccaaaggggcccaaaggagtgttccgggctgtgggaacatatcttagctgtgctgctgtctacacaactgcatacactggtgaaggctacacctaacagtgaactttaccatatgtcagttgcagaccacctgatttatacacaaagaacggaggtctcggccgggcgcggtggctcacgcctgtaatcccagcactttgggaggccgaggtgggcggatcacgaggtcaggagatagagaccaccttggctaacacggtgaaaccccgtctctactgaaaatacaaaaaattagccgggcgtggtggcgggcgcctgtagtcccagctactcgggaagctgaggcaggagaatggcgtgaacccgggaggtggaggttgcagtgagccgagatcgcgccactgccctccagcctgggcgacagaaagagactccgtctcaaaaaaaaaaaaaaagaagaagaaaagaatggaggtctcactgcacccccaccccattgggaagcctcagagagtctctaggggctggaggggcaaatggagggggacatggtgctaccagagccggggcccagaggaaggtggaggcctagcgggaaaaggagggaggcgccaggatcgggggcggagaccccaatgctcctgacagcaccgagccgggcctcgcgcatttccgtggttcccgcatcccagctgcggggagccatagtttccggtctgtgctctgtgagggcagcgcccggcagccgagtccaggcagaggccgcctccctgcgcctggaatcccgaaggagcctgcgccccgtgtgtcccgcaggtcacggccctgcagctgggagcccggcttgactgacagttcccgccggcagcagcgctctgtgggccatggacccagggacagaggaggctacggtcacgccgcccgggacccgccgacactggacacttctcctgctcctgctgtggcgggagctgactgcagccggtggaggtgccggggtgggctggggagggctgagggcaggcctttatttccccaagtctcacttgccggggcgccgtatcccggcacggcttcagctgcctttctcggtttctgtcgccaccgccctccccctccaggctgaagatgccctcccgtccccaacccacacccccgaccccataggaatgcacccccacttccttctggcacctgccagtgcacctctcactcctggacctgaacttgcaactgagcacagctgtggctgccccaagggaaacttgctggcaggtggggtttcctcagggcgtgggcggctgctagaaacgagaaccaggagaaccacgcagccaggaagccagtggccaccgcgcacttccacccagaaacgcattccccagaacctggtgtttcatgcccggtaacaacataattaccatcataaagataaatcgttaccggagatccagacagccacccattttcatagctgcgaaagccacagtgaaacatctaagtccagtcaccataatcgtaaagccaccaagaactactagcagacgacgtcaacagaatgattaataaacatcttatttggttattttcagagcatataactccagaactaacttgatcagcttctcttactaaaatgtgcaaaaattttttaaatttctttttccttagggttgtcgctcaaaaaatgtctcatacaccttcgagaacgaatcaagtccctgtggattctcgagtataaacggagctggtgacgaggcctgacacacggtcacacctcaattcgcgcgtggcgcccggcacaggctgagccccgccagatacaccattagcctccgctgaataatctggattccatgcctccctttcttctgagaacacccttggaggcccctggcaggggctgagaacacaggagcgagacacaggcctgccctgcaggaccatgggctccaggaagctctgtccagtggacacagcacaacaggcaagagaaccacaaccaacgagtggggcaggggaggcaggtcacggagggcagcccacccatgccgcggggtcggaggccatctcctgcagcaggccccagtcccagaggtgggcatggcaggacatggggatggagaaggaggtgcctcaggagtggggtgcacagcggctgagcccggaggcaggagggagaactgccagccactagccctggagccgatgccctggtcagagggagagaggaagagggaacccttccgcagcacccagcttgaacgcgacataaagctatgggcctgaacctgagggcctcccaggcagacactgagcaagggggtgcaggggtcacgctggaccctcaagaccatctcaccgacaaggctccatgaagcccagcacagcaagaccctgaaggggggtcaggtgcccgctgcactcagacaccttctgcagccgcatttcagggccagggtgtccgctgcggaagcacccagcacagtgttcccgctcaaaatgaagtcaaatgtcaattatctgagatccatgtgacccattccatgtattttctaaacaaactctggagacttctatgaaaaacacagcagtttctaagaataatcacttgggtacagtgaacaacagtcccaaaaatgtccgggtcccgacccctgcaatggtgagggggcactggccttatcaatgccaggtgaggccctgcccggccccgagggcctctcacccagccaagcccctctcaatgccaggcagagagcaagactggtcaggataggcatctcatctctgtcaggggacttgctgtggaggcccgggacatggcagagtgcagacagcctacgcgttacctactagcccgtttctctcatgccccctctctctctcaacgtcgtgctgacacacactagctgccggccgcccagtggggacaggctgggttttaggacactcaagctctgaggtggacctttggccgtgcctctcacttctgtgtgccaagcactgggaatggatcagatcacagatcctggtccatggctcacaaacagaggaacagggacgatgaagaaagcccacagctgagggacacaggtgagcgctggggaaagggggcagccggcgtggggtggagcggccgtgacacggtgtgaggagccagtgtgagcagcgagcgtcagatggaccgggaccccgcccacgcacagcaccctcgtggcctcgctggcctcctgcacccccgggccctcaggctgcctggggccaagctgggggtcccctgggggactcctcctctcgccctgtcccactcagcatcccggcagccatgaagacgaggagcctgcaccacctggggtctgggttcaggctgtggcagccagtacacactggctccccggccgcccgtcctgggcgtgagctcaggcgccacaggacccctcctcccttcctggctctcccagcgtcacggcgggaattagcctgatccctcagcctcccacgcctgctgcgtgaggtctgctcctgacggggtcctctggctgcatttaggaacaaggagctccccgagtaacctgaagtccactctgcccagaggccccacaacttacaggatgccgccttcctgtgataccaggcagggctgcccatgagctttctccaagagcagccccacccctgctccaaacacaccatctcctggaagtaacagtattgccccaaaaaccagggggaaactgaggcaacatgcccccacccccacccgcccttcctgtgcccacactgtggggactaaagttgggacagggacagccaagacgtggtgaggagggaggccccacatccatgcaaaggtccccccacagatgccccggggaacagccctgggaagttgtctgaagagggccagagatgctgtgctcttgccttgaggggccatggaagcctcgactggcagtgctcactgacctgagcctggtgtgatgctctagcagggaccacagatgccaggccagatcccaagagcagatcaggaggaacacccagggctgctgtgacctcaagccctgcagcgacccctcagcaccatccagccaggctctggactgaaatgctaatactcgcctggtacagaacaggcagaaaaggggaagtaaatgctcattcatcacctacctatgatggaatccctccggaaaacgtctctatcgaaaatgtagaaggacaggtgacgaaagctccgaggaatttcacagtaaaagtcttctccgtaaaacgggctagtgagacaaagaaaagcgccagttagaacacaggccacgcttgcgcctcacccccggggcacacacgtgtggtcttagttttaaacatgccataagaatgccctgcactgtgtggcacgcatgagacatgaacctgcagctccctgtggggtgaagggcctcgtagctgctccccggcctccacctcgagcctttgcactgcacagatgaacttctgtactgggctgcctggcggcccggaagctgagacctccacagagaccacggccactgccagaatgacttccatgctacgtgctcaggtctaggtgcagcctcagggccatcgtgatgtttcgaaggtacctggtttggggcaggcagtggctccctttatgcattaaacataaaacacagcactccagtgccttggaccgctccttttatccagagatccagtacaaagtcctgactgcccagccgccctcactcctcggggagagacccccgctgctgactgtacttagagtcctcgctcctgggggagaggcccccgctgctgactgtgcttagagtcctcgctcctgggggagagatccccgctgctgactgtgcttagagtcctggctcctgggggagagacccccgctgctgactgtacttagagtcctcgctcctgggggagaaatccccactgctgactgtgcgtagagtcctcgctcctgggggagagacccccgctgctgactgtgcttagagtcctggctcctgggggagagacccccgctgctgactgtacttagagtcctcgctcctgggggagaaatcgccactgctgactgtgcgtagagtcctcgctcctgggggagagacccccgctgctgactgtgcttagagtcctggctcctggggaagagacccccactgctgactgtgcttagagtcctcgctcctgggggagaggcccccgccgctgactgtacttaaagtccttgctcccggaggagaggcccctgctgctgactgcccagccgccctagctcctgggggagaggaccccgctgctgactgtgcttacagagtgcatggctcaggccgcccatgcgtgagtcaccaggagatgcagccgccccacagaggagacttgaaataaccacaaccccaataaagaagcagaagccagtgggctttgccattcagcaaaccttcctgttgtcctgggctggcacaggtggggttagtttcctccccacgccggacctgttggcgattactgcggtgcacgcacagctaccaccaactcagaacttaaaacaagcccactttcatgcacattgatgctaaggtccaaaataggaaagatgtaagttattcaaggaggaaccattctgatagaaagcaaaggaaggtcaacgtgctgggccagggggcgtccacacagtcaccaacggcacaggccccaccccagccacacacagaaatgagctcagaccccgcacccatctgtaagggtgtaagggttggagctactagcctctcagaagaaaatgagaatgaacctgcaccctaaagtcaggtaaagatgtcttagatctgtcaccaaaagcacaagtgccaaaagaaaaataaatggaaaatcaaacttcatcaaaattaaaaacattaaaaacttttttgcattaaaagcattatttaaaaagtgaaaagggccagtgctgtggctcacgcctgtaatcccaacactttgggaggctgagactaacgaatcacctaagatcaggagttcgagaccagcctggccaacatggcaaatccccatctctactaaaaatacaaaaattagcagggcatggtggtgggcgcctgtagtcccagctactcgggaggctgaggcaggagaatcgcttgaacctgggaggcagaggttgcagtgagccaagattgcaccactgcactccagcctgggtgacaagagcaaaactcagtctcaaaaaaataataaaaattaaaaaaataaaaagtgaaaagacagactagaaaaaatattagtaagtcagttatctgataaaagacttatatacagaatatataaagaactcttatgactcaataaatgatgacaaataattcagtttaaaaaggggcaaaagatttgaacacacatatcaccaaagacaaatggccaacaatgtattaaaaatgctccatgtcattagcccttgagaaaatgcaaattaaaccaggagatacggcacaggcataagcccaaacctggggcgggcgactgttgctgcccggagcccaggtgggaggggcccagagtccaggtgggaggggcccagagtccaggtgggaggggtccagagtccaggccccaccccttctccctgcagcggccttaatgacaggcatttcatttggatttcactgatttcagtatttttataactgggtcagagactgggtaacatttactcagaaaaccattttttgtcataaaacaatcttccaagggaagcctaaaatgcctaggttgttttaagcattttggaaacacagcagtatccatttacacacaaaagaaacatcactttatctttcaatgaaggcagaatgctcagggacttccaccgactccattgtagcagcatcctggttaatgaaggcccattagaaagtcacgtttcctttaaacacattctcgcgttggtcgttgacgcagcgagccatcctctgatctcctgcgtctgcgtgggcaccgccgagatctgatgtcagggacccccaggggtgtgtgtgcccacaggcatgtgtgtgtgggtgtgtgcacgtgtgtgcccatgggtgtgtgcacgtgtgtgcccatgggtgcgtgtgcccacaggcatgtgtgtgggtgtgtgcatgcatgtgcctgtacgtgtgtgcccacaggcacgtgtttgtgtgtgcatgtgtgtgcccgtatgtgtgtccccacaggcaggtgtgcatgttcatgtgcatgtgtgtgcccacaggcacgtgtgcatgggtgtgtgcatgcatgtgccatgcatgtgcccatacatgtgtgctcacaggcatgtgtgcatgttcatgcgtgcatgcatgtgccctggagcacttgggtgcacatgtacacaaaggcaccacagatgcgccccacacaatgcgctgctttcataacaaggcgcaggggtcgtgaccctgcctccaccctgtgtaaagtcacagctgcaggatctcggggcaggacgcacactccccaggcagcgccctgtggcctccctggagaagcttggtgctctgcggacagcgtccccactggcaggaaaaaccactatcaacctcgaagccaaaagggacaccagacgtgcattttaatattcacgacaaggcctcaggtgacgagctactcacaggacaagcgttaacaattaatagtaatccacaaaacatttgggatttttacaacgacaaaacggcctcttctgtacgtcctagagcaactttcagggccactgaggcctaagtgatggcaggaagccgtggtgtttgaatgtgtgaaagcagcctggacttggcgtttccagccccgttcgctcccggcagagccccaagaaccaagggctggaggcttcacttcctgctccagagtggcaggtgcccaggctgtcctggctgcggtgcatctcacacaagaagcccagcgggagcacgcacagctctgggccttgcggcaaatgcgtaaccaaaaggcgtaaatcaagcttcgttcaccatggaggaacctcagaaccaccggcaccgatagccaagctgccagagaatggaacggacgccctccattggcacaaactccagcagccggcttgtcaggaagctgcagcagcttcagagcaacccaggcctcggggttcacctggcgcgtcaccgtttcccgagagccccccgcccccgcacaggcactgaggaccccaccacatgggcctgtgcctgcctggcaggaaggcagggaggaggaagtgggtcgggctggattgcatgtctgatgtgtgtccgatgaatgtccagtgcgtgtccaatgcgtgtctggtgagtggtgagtgtctggtgtgtgtctgatgtgtgtctgatgcatatttggtgcgtgtccggtgcgtggtgaggggcggtgagatgaggatgccagcgctaagcacaccccacaaacgggcgccgcgcacctggcatttaaccctgcacacttcctcaccaccctgatgcacagggtgggaaaccgaggcactccaacatctgatgaaacgaaactaaccccagggcttgggcagcagggctgagagtgcggcgtccctgggcgctgcccggtagcggggtgttcagttgctctgccaaaggctctgcacaagtggctcctctctctgtaactctgcttggcagtggggggctcggtggggggaggcccgtgctggctgggcacctgggagggtcccgtgaggcttctggtggtgctgacagctgtccgtggaaattgaggtgcttaaaattcataaataaaccagaaatccattcaataaaaagagataaaaatagcagaaagaggaagctacaagaaaacatacgaactccataaaattatcaccacagactggacgtgcccctttctaaatgtaaaagcggtttatagcaacacagcatggccctgctgcactacccctggggagcaagacctcctccagcctccacccaggaatttctccagcaatggctttagaaccttgctcctgaatcgcagcaggggaggcagcgctttggggccctctgtcaggctgccccccctgctaagaggagctgttgtccttgggaaccacgggtcccccctcctgaagaaggggaacgtcacactcacagttccattttacacatttgcagctgagaaccctggagccagaacaggctccagcacaggcgatgggtgagtgttttgcatgtctgatgtcgtttattctagtggttccaattgcctattttaatgtttttcttcttatttcatataactttttaaacttaaagtaataaagttattactaactttgtttcctgcgggtcacctcaagtctttcaggaaaccaggcaggacatctgcaggcggccggccagccttatcaacggagctctgagccaccaaccactgtgaccaagcttcattcccacgagctggacgagcagaaggcattgcagggcagtggggtccggagaggcggccgtgctacaggccttgcactcattttaatgaaggctctgcaggatttcaaggaaagctggagccagtctctgtgccagaatagagggttcgttcagcttcttagaccgatgatttatttagggaataagaagggcgattccagggacagtggaggcccccacaggaaggaaacctctccccacaatgactgtgcacagagccagcctgacacccaaggccacgatgccatagccagggagccctgaagaaactcctggaagaatgtaaaacccccagctcaaggaggagagtggaggcggttccccaccttctgggggcagttaacctctgagaatgaacccacagctaaaacccataaaacctccgccaaccacacccagacctggaaggggcacctctggccagggcgctcagcacgaggggacccagaacaatggcttccctggggtgcgggctcggcctgcaggatggaggctggagagctgccatcctagcgcacactgggtagatgcaggtgtttccaatgtgctgaagagggcagggcctggctgaggccctgggaggtcggagtcccggaggtgggtgggggtggtgagttcccaggtcacttccccaggtgtgcgttttcctcactgtcctgtcctattcattcattttagcacggaggccagaaccagccgagtgaagcccctgcctgaccactcaggggtgtgaggacaggggcgaggaccgggatcatcagtcagctcctagaatggcaggtttgtacctgcaaacggagcaccagagtgacatccccccaagacccccgagatgccatgagccccatggagaccacccacccggcaggggccagctccaggtgctgctgctgcggcgaggccgtcaccaccatccacgcgtccagcaggaagagcggattcctcgggcgtgaggctcaccactcacgttgtctgcacacctgcctgacgacctctcccgaacctggattcccaccacagaattcagctcctcgggtgctcaccagcccgtgacttgtggtcaccagaccggacggaaaacacagagaccatttcctgttttgcagaaaatcctgttgggccatgccagtcctagagccaaaacacggtgtccacttgagggtccagacctgaggccacccttgctgggacagcatctccttccctctcagagcaatgccactgatgcccagaccagcaaccatgcccgtcctcgcctgcccgacaatgcccttcccaggccctgctcctcggaggactggtcatgggcaccctggactatgccgacccgcagtccccagggaccaagtcctgctgctgtggacacaggtgaccctgcccctcgcaggggagctgctcttctcctgagcccaggagtgctctgaaacttatatcccaatgagaaccaaaatcaggagtagaagtgggagttgaaggccagagcctttttcgaagaacttccctaagctcttttaaatacctgcatccaggccagatgcagtggctcacgcctgtaatcccagcactttgggaggccatgccagaagcgccacttgagcccaggagttagagatcaacctgggcaacatagcaagaccccaactcaacagaaaatttaaaaattagatgggtttggtggcgcacgtctgcagcgaagcggaggattgcttgagcccggggttccaggctgcagtgagctgtgatcacagcactgcactcctgcctgagtgacagggcgagatcctgtctcaaaaaaccaaacacctgcatctcctgcatcttcagagcacagtcccgcctggaggagccgccgtcaggccctcctgcatcttcacagcacagtccccaggtgcagctgctccccccaacctaattcaggccctggtaagcttcacaaggccaaggggacgttggtctccaccaggaagactatatggcacgtctaaatgtaagaatctgtgacagacgtcgctgaagccaatgcgaggaggcgcaggtacccaggaggcacaggtacccaggaggcacaggtgcccacacgggccttgccgggggaagcacgactttgaagatggggacgtccacgtttcaacgctgccttgccagaggccagttccctcatctctcagcctcaggacaccgccctctccacagtgcagcctgcgggcacagagggcgctcggctggggaagggcagtggctctgcccccaaagcggcctccccaggacacaccactgcctggcttggaggtttcttcctctgccctgcacagtgagacaagcacatggcagggcctcccacacaccaggaccaaacaacggggagcactttcgatgtctttggcccccgccaggcgtggctcactggacccagaaaccacagcgctctctctctccatgactgtttcagctgcccatccccgttctagactgtgggaatagcagccaatgaagcaaagtcctggccccatggagccagccaaagagcacacagaaccacgaatgtccaacgcgggcaaggctggcgggggcagcactgtggcctcgctcgggggacagggaggcttacggacgagtgagcgcttgaacagcgctgtggacggtgaggagacccgcaggaggacaagggaacgcatgaatgaggccatggacggcgcggagagcgcaggaggggtctaggcagagggacaccaggtgcgaaggcctcgaggcagcagggcttgtgtgtggtaaagacgtaggagcaaggagaaggctgacgtggcctgggcagggcacggcaggaccggagcatgctgggagccgaggtcagaggtcagggtgcagccgaggtcacgtggtgcagagcagacatttcaccacagcagctgggaatatgcaggcccgtgcaagacactggatggacggatgcacggatggggcagtgggcatgcagggaggaatcacctgtctcaggtcagcagccaggagctgcccagacctggcacagtggaccaggaagggaaggtcacccaagcctccacaggtggggctttctgcaagcaaggtgcagcggtcagcccgagaggccacggtgccgagcaaatcctggttgtcctcatggggacgacaggaattcagttctggcagagccaagactgccgggaagccagaggggctcctgcaggaggtgacgggcctgcggggacgcgaagggccaggaccggacacgccccgttccgctctgcttccagtgaggcgagaggcgggcaggacgcagctggagccgcgcacgcccggagctcaggccaggactgtcccccagcgctgcgctcgcccgcggtggagctgcagtgttatcagtggtcagctcaagtccagtggcttgaaagggaggcagaggcctcaccttccctgaggctccctgtgaagagcaggaggctgggccctcgggaagaccccagccaggctctgccacctccacagccgggagacggggcctccaaagccggcagacggagcccccacagccggcagacggagccccccacagccggcagatggagccccccacagccggcagacggagccccccacagccggcagacggagcccccacagccggcagatggagcctgggcactgcacacagagacatttcttcttcccgagacctcgcacagaaattactcacttaaaagcacttagagttttttcattttttcagtggcaaatatttcgagggaataccacagaaatagccacaccaaaacccaactcagttctcccttctccacccccgccacggccggggacgctgcctcgatgcgcggggctccctccgccatggccggggacgctgccttgatgcgtggggcttgggttcttcaggtctcttgatgtttttcctcttagaaccgcaaactacggttgcctgaaaaggtttctaaaaaccccaggcgcccaggcccacctcagagaacggctctttaagggtgatgggttatgaaacaggagccctttgggaggccaaggtgggtggatcatgaggtcaagagattgagagcatcctggccaacatggtgaaacgccgtctctactaaaaatacaaaaaaaaaaaaaattactgggcatggcggcaggcgcctgtaatcccagctactcaggaggctgaggcaggagaatcacttgaacctgggaggcggaggttgcagtgaaccgagatcgcaccactgcactccagcctgggcgacaaagcaagactctgtctcaaaaaaaaaaaaaaaagaaaaagaaagaaagaaatacgagctttgaaatctatactagccatggagtctaacacgatccttaagcgaactgctcattacaaagcgtggcaggctgccttctctccagagggtttctggtgccctatccacggaggcggcagtgggattcagccgtcacctgtgcttgcggtggtaactccatctcagactcaacaggggacgtgtctgcacagagcacacggcgcaggggttgggcggggaggacggcaaggtcaagccagctcaggggacatggtgggcagggggctccagatcccacggtgggcagaaaaggcgggggtcggactgacgccgtcctggaccatgtccacgtctggggtctgcaggttccatctccctttccactgtgcctaaccttacatctataacctacatccagcaagacacgattttccacgatgagttgattcgtaattccatttatgtgcaagtttttagaattttcctgtgggttttttttttacttacttatgattttaattttgtttgctttaaaaaaaacacatgcataggaaagaatgcttcctttcatttcaattaaaaacaacaaattgcttttttttaagcaaaaattcattgagggggggctcgcattgtacaaagaaaatcagacccaccgggatggctgtgatcaaagagacagtaacaagggtagggaggtggagatgcgaatccaaacacacaacttgtgcaaaggtcaagtggccacagccgccacggaaaacaggctggcggttcctccgacgttcaacacacagtcgccacgggacacagtggttccacccccaggtgtgcagcaatagacatcacagcccacgtccgcacgcagactcggacacgcgtgctcacagcccacgtccgcacgcagactcagacacgcgtgctcacagcccacgtccgcatgcagactcggacacgcgtgctcacagcccacgtccgcatgcagactcggacacgcgtgctcacagcccacgttcgcacgcagactcagacatgcgtgctcacagcctcagtcatgacagccagacagtggaaacaaggcaggtgggcctcggctgctgagggagcaacagcagaacggtgctcagccctggagaggaaggacgcctggaccctggccccacaccacagcatccacaatgtggtgccaaccaacaggccacgcacacagaggccatgggccagacgcttccactgacacgaaatgcccaagagaggcacagccggcgacagaacggggacccgtgtctgccgccccaggagaggctgcaggccggaaactggaggattacagggcgcgagtgtcgttttagggagatgaaaatgttctaaaattggctgtggcaattgttgcacaactctgcaaatatactaaaaaccactgaattgtacatttcaaaatgggtgaattgtacggtgcttgaattatacctcaataaagctatttttaaagaaacaaaattttaaatacgtaaaaaaatcagaaagtgaaatctggaattaacattccaggaaacatcctcctggagttttttctccaaaaatataaaatagaataaaatatataaatgttataggtttaaaatatacaaaatataaatatatttgtattacatttataacataaatacaatatttataatacaaatataagtatattcatactataatgactcattatattataatacaaatatattaacaataatagtaaatatttatgttataaatatagaagatacgaatggaaatacggataaattttttaaataaaagtgaggttatgttccctgtgacagagtcagctttttcctttcacatcaggccatgggccactttccaaagagctgataaaacgctggggtcagacggcacgtgtgtgcgtggacagcagtgccaggtccccctgccatgtgcacgctgtgtggtgggagcagcaggggtgagcaccctgggaacgcagatctgtgcagtggctgattgtccccgtgggataaattcctccaaggatgtgcactgtcctgaggcctttgaaacacaaagccacagaaccctccagggagtctggaccagtgtccacccccagcatacgccgtcttataaatatttctacagtttgctaaaccggtggcaaaaacctgcttaaattttaaatgtctggctcattggtgaggtggaatgtccatctttttatgagcagttttaaatctcattttttcttgaaatgctctgggcctgttttctattagaatgaccatcttttcatgctcaggatttaaccctccgggaacttctgaatgtgtgttgcaacttaaaagacatattatttcacaacatttaaggaggatcttttttgaactaaaaaaacccccacaaatttgttaaatttgtcaccagtgggtgactatggacctgtgatcagccaactctgaaatgagctccagcagatggacacagcgtcccaggacctgcaggagcagaggctgcgaggccagccacgtccacctcgatcacgtcacctcgtgggcagaatggcctacgccccatgtcctcccagccccacccagaacccacggtgagcacccggcaggaagtggccacagcaccatcactggaggccacgcggagtctgaggacagcagctttcccccctatgctgttgtggggactccaggctcagcctgaggacagggtcagttccctccacacagcaccaacactcccaggtgcaaagcccaggcccacggacagccccccgctgtccgtgggtctcatggtgggggcacccattttctttcatcagcaggaaggtttgtgctttctccttcctgggcagcagagtttgaagcgtattccaaaagaaaaatgaaaccggctgaacgctagggcattcctcccatcccccatcctgttcggtggcctgtgccggacaatctcttctttctgatggactcaaaggggccacacagccaccaggtgccccccttcccatcagcagcttaacctcggggtatctcttggacaggccggctttgtctccagccgaggtcagcagcagtcagatgcgggatgaatgcctggcccaggcggcccccactcaccgcccgagggctctggaactctctttccaaataaagaaaaagtgcggcctgagaggaccaggctcgcctgaaatcctgccatgtggcctaaggaaattaacgcacgcagcagcctctccctctgaggcagagaccctggcaaagtctcctttccctcagtcatttctggaagaagtgcaaatgaagtttcacagaatcaagcaaactttcacggggaaaaaagaaaaaacctcttgcagaaaacagagttgacctttaagtagtggctctgatgaggggaaaccatctgaactgaattcctcctcctcctggagcctggagcaggggctcagctgggaccagcagagaaacccccgccttctcctccctgagtcacttcccagcatctgcgcaaggctggcgctgccccatcccgcctgcggctgctcccatcacgtgatcataagaaaataaacctggtttcccagctctgtgctctgccgcaggctcggggcccatttcccaaacgctggggggagccgggagctgccagggctgccccagcctcggggtagagggtaaaggctgcgtgaagaggaaccaaaccccaaaccgggtctgcgaagcagccctggggctcccaagccagcctctgggctgagctctgcggtcctgagtcactgcctgactcatcctcagaggcgccccacagagaaggggcaacttggccagggaaaatgctccatctccgcaaaggacaggaggcaaaacacacccatcagaagcacatggccagtgcagggccacacagccctggctcccacagaccgcaggctggagaatgggggtccgcggtcagctcatagcccacccgccacccagcactgcagggtcacacagccctggctcccagaggtcagaggctggagggcaggggtccgtggtcagctcacagcccactcaccacccagcacggcaggtctcagcggaagccccacacacactgggttgcagcctcctgtggttcaagatgggtggggttattttgaaatgttggcaaatagagctgtgagtcttcaaacggaacccaaagactcagtgaggaaagcaggcgggctgggctgagactcacagctgcagcggccgtggtgagccacctcacctccccgagcctcagtctccccatctgttcaggggcaccgaggagctgcccctcggctcatgggctctgtggtcgccaggcacgccacacaccacacgccacacaccactgcacgcagcaccccgggacactgtggcctcggctcccgcctctcctgcacatgaggctctttcctctctcccaccccataccccccaaaaaagaaccaccatccttacaaacaaatgaaaatcggctgggtctttagggcccggccacgatgtgtgactgcagcagtgactctcaggaggaggcacaaccagacaccgggtcccctgcagcagctgagacacctcaaaccccaaaccctcagtgaggccctggtgggaaaaggggctctccagggaggtgccaggggcaggagagagggccagcggccgaggagcgggaggcggccgggcgagaggaggcccgggcaggagggagaaggggggacctggcctttgctcctcatgggatcctcggtgcggccccctcgtgacaggcccagcctctccctgcagtggcccagccacagctcagggccaggaggctcctgcaggcacaggcggccgatgagtcccttccaggcctgggcctggggcagcctgccatgtgcagtagacactcagtactcacagaatacgagcaacctcatgctctccgccggctgagttcctgtgcggctgagagaaccccctgcatcattctgacacaggtgcgctcctgtgagccagcatgacacggaaggacacacacatgcaggtggagatggagatgctgggccgggcttgggggtcatacagacaggaccaggggctctgacctgctgggagatttggggccagcattccaggactgagagaacagatccctggcctggggtgctctggggctgaggatgggcccccacctgggctgaggatgggcccaacctgggctgaggacgggcctccccacctgggctgaggacaggcccccctacctgggctgaggacgggccccccaacctgggctgaggacgggccccctgacctgggctgaggactggccccctgacctgggctgaggacaggccccccaacctgggctgaggatgggccccccagctggggcactctggggctgaggacgggccccccacctggggcactctggagctgaggatgggcccccacctgcggtactctggggctgaggacgggccccccacctggggcacttctggggctgaggatgggcccccacctgcggacaccccggggctgaggatgggcccccacctggggtactctggggctgaggatgggtcccctactccagcagttctgggatattctgggcttcaagaagcctccagtcgtgtcaagcaggtttttgtttaagctctaacttgagagtgaaaataaatgttcatgggaaatgtgacttttcatgagtcgcctaatgtcaaagtcggtgtttcctaagtcagcaacttggtttttattaaaagcatctgagagaatgaaccgtctgtctcccaaaccaccaacttcctcctgcccctttcagtttctaaccccaaataacttctcccctcccgaaaaactttggagctgtggagacatttcttggtttagtcatttctactacacaaaagtactattttgggggtgatttacatcttgcagtatgaacagaaagaaacctccctgtctttaacaaacacccactgcgtgcacacaggacgggacgggcttccacccagaagagctcagagcctgcccctcagggctgccaagtgagggtccctggtgatgtctgatgtcctcgtctgcctgggaagacccagctctcctcgctcagctctagaagatctatctgttccttgacttgtaacttctaattgtacataaaacacacaaacaaaagaacaagaactcccccataattccacttctcagaaatcacatcacattgacgtttttgtctgcgtatccagatcattttgggggtgctcatgattttttaaacaaaagaacttttcctacagacacagctttgtaacctaacgcataaccagctttcggagcaggagttcaggccgtggcacctctgggtggagggggcacagaaaccagccacgcctgcagtttcttcctgttgtggccacggccccttctccccgagatgggcatgcaaatgaaccctgcaaaggacgcaggagcaactccacagaaagggggggccagggctccgcgtggggcagagggctttgcccagcctcaaccccagtggcagggggtagggtcagacccagaaccctgaggcagagcctccctgagccaggactgtctgcgtggatgagggtttggggagaggtcagccacgtgggcgcagaggaagcaggcagggacagacaccattccacgtccttacgtggatggaaggaaatgaggacacgacacttactgaatattcttgcaaatgactggactaacccagcaaggagagatttaggttctgttgtgtgtgacgccagctgttcctttctgctggacaagacggtgatttccactgcagcgcagccttggggagcggggtcatctccttgttttagggtcgtgggtgccggcccaggggaggtccagggcgggaagctggttcccaagccccagccctgccaacccaatttcagggagccttttagtttaagtaaataaggaaacaaatagtggctgccctttaaatgattaaaaatgattgctctaaaaggtatggattgtgaacacagttcactctcaacctcagaaaattatttttctagtaggacagaaactgccaaaatcacttccttggagaagggccaaggccagagagaaagggcttgttctctgaaatgtgtccacttcgatgcgttctgaagttaaacctgtgacagacactgcccttcaacctccaccttgaaaaatacagaaaaaagggaagacagaggacgctctccccagacgtcggctcagcactcgataaagaggccccacagactccagggcctcggacgcgcggcccaggggcccgggccacacgcagggaggaggcgtgggggacacaggcctgaggtggagctgggtcggtgacctccttagtgggaaagagggaagaagagaagctgagttccgcctttccttcctcacacattccatttgcagcttcctgctaagtcagacggcgatattgggcaacagcaaatcaaacttgacccaagtgcttctccccagggaatgtgagaaggggctcctgcccggctgcagacccagcggccagagagcaccctggggcccttctgagctcagagatgcagacgtgggcttttttctttccacagcgactttgccaaatgaaccatcagaccttaaaggtgacactgaccttggaggaagcacacggggggctgggagactcagggaccgggagacttggggggctgggagactcgggggccgggagactcgggggaccaggagactcagggggccaggagacacaggggccaggagactcaggggtcgggagactcgggggttgggagacttgggggtcgggagactggggggtgggagactgggggaatgggagattcggggaccgggagactcggggagccgggagactcggggagccgggaaactgagggggccgggaaactggggggccaggagactcggggggccaggagacttggggggctgggaggctcgggggctgggagacttggggggctgggagactcgggggccgggagacttggggggccgggagactcgggggctgagagactcaggggaccacttggggggccaggagactcgggggccgggagacttggggggccaggagactcaggggccgggagactcaggggtcaggagactggggggtgggagactgggggggtgggagactcggggactgggagactcagggagccgggagacttgggggaaccgggaaactggggggccgggagactcgggggccgggagactggggggtgggagactggggggtgggagacttggggactgggagactcggggagccgggagacttggggggaccgggaaactggggggccaggagactcgggggctgggagactcaggcggccgggagactcgggggttgggagactcggggggccgggagacttgggggctgggagactggggggtgggagactcgggggatgggagactcggggaccaggagacttgggggaccggccccaaagtgggtgccaccatggagcaaggagggggcggtggccaggactaaactccccagcatgtggggcagccctgcctgacacctgcctctcaggtggatgtcgaccaatgactaatacaggactctgttaatgcatgtgcaccgatggagggcttccgaccacagatgtagcgtggattccagctgcaagtttatgagagagccagcttttgggttcaagtacctttcctgccaactttttgtatggggtgggttgatttgcgttttgccctcacactacaggggcggccagcccgcacagccctccaaatggacagggctgccagcgtccacactaaacggcgccagtgttacacgtgggcagggctgccggcgtccacgctaaacggctccacagtcttacacgtgggcagggctgccggcgtccacgctaaacggcgccacagtcttacacgtgggcagggctgccggcgtccacgctaaacggctccacagtcttacacgtgggcagggctgccggcgtccacgctaaacggcgccacagtcttacacgtgggcagggctgccggcgtccacgctaaacggcgccacagttttacacgtgggcagggctgccggcgtccacgctaaacggcgccacagttttacacgtgggcagggctgccggcgtccacgctaaacggcgccacagtgttacacgtgggcagggctgccggcgtccacgctaaacggcgccacagtgttacacgtgggcagggctgccggcgtccacgctaaacggtgccacagttttactctcttggaactgtcccacatgggtttctctttctttgctatcagtcttttgttgtgtgtgttttgggtttttttgagacaaggtcttgctctgtcgcccaggctgaagtgcagtgatgtaatcatggctcactgcggcctcaacctcctggcctcaagcaatcctcacacctcagcctcccaaagtgctgggattacaggtgtgagccaccacacccggccagaaccatgatttctatttctaaattcttctgaaatatctgaaagacaacaggcccccatttctcaacctcacctgaaagagaggttcccaaacagattctcctcccactggctctgattcagcgggtctgagaggatcccggcctgagaaagactgccagtaattctccaggcccacaatccataggcctctaacaacagaccatttaaacacagaatggacttttatccagggaagctccaaaggcacttctgaagggctcggtctcttcccattttcttcagaagaatggctgtgcccagtcatcgccatggcaaccccaagacactctcataaagccagactgggcgcctgacaatgcccctcagcctgcagttctttttgacgagttatttcaaagaacccggagcgtgcattaacataacacaaatgactctcactcctcggcctggagggcagctgcgccaaagccttttggaagcactgtcagtgacggagtgatatgagccccagtctctccagggcaggagacccctcacagttttctagtaagtaaactcacccagtcatcagcatgggttgttcattcccacttggaagtagccagatgcaaggatataattctttagctaaacatgttctcaaaatcaaaatagctgttttgatcaaagcacacgacccatgcttctgaactgaacggtgcagtcacagctgcaaggatgtcttctctgatccccaagccgctccttataacccggtggagtcacagctacacggacatcttctctgatccccaagccgctcccttataacccagccgccccatgcttcccccgaggccgcagcactgaggccctgcctggcacactctccctggcttctctcttcccacccccgacataaatcgccatggcttcctgtccctgtgcatcccaccccgtgccatgtcctggtgttcaactgcagtggtcctccgagtacggcctggccacttagctggagcttttcagaaacacaagttctggttgtgctctggacatcctggggtcggcacccacatcttcacacgctcaagttgagggggaaacttgttgattttaagagtttgtttttcttggctgactcctctcttcctcaaatcatatcaataaacactttctaggcctcttacctcagttaacacccatcttctgtatagctattttagaaaattttacaggaagagaaaagctttctcagtatttccccctctcgaaatccttaatttgtactcttttgtggagtgcgagcttcccggttcatctctaattaaaaagcactcgtgcgagtccacgcagggggaccgccgcctacatgcacttcctggacagcgggagcatttagccaacaccagttcacatccacgcaccaccaaggacagaagctcagctgcctgcacaccagagccccagggagcatctcctcctcaaactaagcaggaggaaaatgggaaggtgatgtacatgctcaggacataatctacatacagaaaaattctctacacgcgggaaaataggatggtgacgtacacgctcgggacactgtctacacacagaaaaattctctacacgcgggaaaatgggacagtgatgtacacgctcaggacattctctacacatgggaaaatgggacggtgatatacacacttgggacattgtctacacatagaaaaattccctacacgcgggaaaatgggacggtgatgtccacgctcgggacattgtctacacacagaaaaattctctacacgcgggaaaatgggacagtgatgtacacgctcaggacattctctacacatgggaaaatgggacggtgatgtacatgcttgggacactgtctacacacagaaaaattccctacacgcaggaaaacgggacggtgacgtacacgctcgggacattgtctacgcacagaaaaattccctacacgcgggaaaacgggacggtgatgtacacgctcgggacattgtctacgcacagaaaaattccctacacatgggaaaatgggacggtgatgtacatgcttgggacactgtctacacacagaaaaattccctacacgcgggaaaatgggacggtgacgtacacgctcgggacattgtctacgcacagaaaaattccctacacatgggaaaatgggacggtgatgtacatgcttgggacactgtctacacacagaaaaattccctacacgcaggaaaacgggacggtgacgtacacgctcgggacattgtctacgcacagaaaaattccctacatgcgggaaaacgggatggtgacgtacacgctcgggacgttctccacacatgggaaaatgggaaggtgacgtacacccttgggacattctctacaccaaagaaaacacatcagtgccaagtaaagcaacagaagacattaccagagtgacttttccacaattttggtcctgaaaacctcctcctggtccaggttcaccgtgcagtagcaatccctcatcttgctcggccccgggtaagagggaaggtttttggcttcacctaaaaagtaaaagcgacatacatcatcagcagcgtagaaatgtttgttccctgctacatcgcagacacgtttccagcctttgcttgtgtgcattcactagctctctataaagccttggtttttttgccaccacaagtcaaaatgtggatgtgcaccccatgtgtactgccgaaaggcgagggacatgcacgccaccctctaatgcaagtcccgcaagcagggacctgccagcctgggactcaggattgctgtgtcttgtttacctgcattagtccctttattttaatttttaacatacaattttccatctctgacctgctcgcgtgcacagttctgtggcattaaccacgttcaccgagttgtgcaaccatcaccaccgtcctctctggaacactctcgtcttcccaaacggagactcggtccccattcaacactcactcccatccccctcctgctgtctcccagtggccctcaccccactttctgtctctgtggatctgactactctggggcctcacgtcggcgggatccacaggacgtgtcctttcagcccggctcactctactcagcaaatgtcctccagggtggcccctgctgtggccgctgactggattcccttctattttaaggttgaataacttccatgatgcaaagggacctcgtcttgcttattcatttatccactgagtccctttttattttgaattttattttatattaggtcaaagttggagccagaattaaaggaaagagctctttcttgtggacgtgagttaactgtaaactccagctgttcgaattgccagtaaagagaagcgtcccagagggacctaagctaggtccacctctccctccttcaagcccacagagacgccacctggacgtgcttgaaggaagtggggccagttcctggctggccctgcagaaaacgcccgtgatcccggactccttgtttgccaggggtcagtctggaggtcataactgaaccccagctgcgacttctctgctggaagctcggagcatgccccagcggcaagcctaacggcccagtttactggagaatagggagtgagcaggaagggatgagtgacagctgtcaatccagacagcggatgcccagtttaagtccattctgtaaaaaaaacgcctcaaacacactcgcgcctccccagggccttttctgcctccgtcatttggctctaaagacgcctggcagtggcgtctccacgacgcaggatgagaggacagatgcaggcacaggcaccacgctgagaccacaccaaggctcctgctggcgccactcagggccacatcaccttattcttgttgaaacaaacaaaatcaaaaacgggagcagagtagaagtttctcagaaccccacttccgccactccgcgctgaatgtttcgcgtcaactcagcaagcgcacacgtcatggctcacatggggcagtcggctcatttcaaagatgccagtttgcaaactggcatgccagcaactccaaagggcagagataaactcagtttgaagctttttaaagacttttcatccacaatattaacctgaggcactgtgagaaggagcagaagccccagggtctggacaacgcctcccgtgtccgcgccgcgtatctctgcgtgtggaggcaccggcaggacgaagcctcccgtgtcggcgccgcgtatctctgggtgtggaggcgccggcaggacgaagcctcccgtgtccgcgccgcgtatctctgcgtgtggaggcgccggcaggacgaagcctcccgtgtccgcaccgcgtatctctgcgtgtggaggcgccggcaggacgaagcctcccgtgtccgcaccgcgtatctctgcgtgtggaggcgccggcaggacgaagccgcccgtgtcggcgccgcgtatctctgggtgtggaggcgccggcaggacgaagcctcccgtgtccgcgccgcgtatctctgcgtgtggaggcgccggcaggacgaagcctcccgtgtcggcgccgcgtatctctacgtgtggaggcgccggcaggacgaagcctcccgtgtccgcgccgcgtatctctgcgtgtggaggcgccggcaggacgaagcctcccgtgtcggcgccgcgtatctctgggtgtggaggcgccggcaggacgaagcctcccgtgtcggcgccgcgtatctctgcgtgtggaggcgccggcaggcgttcccagcagcacccgctgctgcccacacggagcagctctcagggtctcactgcttgcggccgtttcccgccagtgcccccaacacacagtctacctctctgggcctcaaagtcctgaactgcaaaagcaagagacacagcagctctcgaaggctcctccggctctgagacgcctctaattcaaaaggttctggaaatttttattttgggaatcattaaggaagcatcaatgataatcggttggtgggaaaaaatgagtatttcctgataggcactggaccctcagaacacctcaacacggcgactctcccgggatgcgccttcttcacccgctgcatgggagaacacagctaggctgctacgaggcacctggctccaggccaggcctcaggtcggtcatcccatgtcagaagacaggctttccgaaggctcccaccgatgtgaagatcccacacgcagcacacgcacacacgcagcgcacacacgcagcacacgcacgcaggcagcaccgcacacacacgcagcacacgcaggcagcacacgcacacacacgcggcacacgcaggcagggtgtgtgatgagttcacaggcacgaaggggagaacatggccggcgagcttctccagagagggaagggagcctgggggatggcagttgaggttcccggagcagacgcagccttcctggtggccgcggctgcccctgaatttgagggcagccgcagcacacccagcaagtcggacaggggcccctccagcctcccggccctgttttggaactgacggcttctgcagcagatagaagtccttaccctcaaacacagcttgactttgctgactttccttctgacacctttacagtgtgacctgacgctgaccatatttcccttgggattttactgggttttttgtttttgtctttgggagttttttgtttttgttttgttttctgggatttctttgttttttgcaacaaatgagtgtagatatttagctgtaagttcctgtgtttcttaaaaggagagagaaaaaagcttttgaaagtcctgtgggagatggtgtttgtggataatacggaactgagatttgttcccacagggcctcaaatcacagcagtaacagctgggtcttccgaaggcggacactgcaggacggaaacacacaagctttctgtggagtccctgtaagacagacgccgtacgacatgaaaaggccggatccccctgcgctggcgccaacacaccagattcatccctccctgcctgatgatgcccagtcccaccgcactggcaccaacgcaccaggttcctccatccctgcctgacgatgcccagtcctaccgcactggcaccaacgcacccaattcatccctccgtccctgcctgacgatgcccagtccccccacactggcaccaacacaccggattcatcccttcctccctccccactcaatgatgcccagtccccccacactggcaccaacgcaccggattcatccctccctccctgcccgacgatgcccagtcccaccgcactggcaccaatgcaccggattcatccttcctccctgcccgacaatgcccagtccccccacactggcaccaacgcaccggattcatccctccctccctccctgcccaacgatgcccagttcccccgcactggcaccaaggcaccgggttcctccctccctgcccgatgatgcccagtcccctggccccaaaacacaccaggttcctccctccccgcccgatggccccgtctttacctccttctccttgctcactgtcatctggggctgagactctttctttttaatctacttttgctatgatgcatttaataaaaaaaaaagtggggggacaaaatgcaagcccatttccctgcctcaggcttctgatgccatcacctccaaggcactggttttgtttccaactgttaataaagcattgaaacagaaaaaaaaaaaaaaaactcctgagaaacatcctggttgctatgacgacagcaacaccagggagcctgctggacgcaccaacatccaatgagctgctcagaccaggagggctggggctgctgcagcacggcctggccacgtcgccccggggcctcgccgtgtgtgccacatgcaccaggaccgagcctctccctgcagccccacagctgagcgggacgggggctgccccagctcccaagcaactgtttcttctccaccgcaccccaaacagttcattcagttaccttcaccaaaggtgcctgttctgtctctcttagaggaaacacgttttctcttttttttctggtgcacagagacgttcatataaaaagacaaagctgtctgtggtatacagtaagtacctaattatctgttgcatgcatggatgaataaatgaattaaaagaaaagtaaactggtttcatcctaacagccaaataagtaacagttctcatgaccacttttcccacagaccatgcctctaaaacatatgcggtgtgttcaccagccggcagactgatgaagacagccaacacagcacctcgcatcggctctgaaaactcaactaacaggagtaaaaggcagcacttaaacacatttaatgtaaacagcataacaccgcaaaacctgatttccaactccagggatcaggcagtgagtaacaaaaacaaaggccctgatccaaagcgtcatgactcccacgcccacggcagcccttctgggccatggagggaagctgcaccctcagggtgagcacaggcccagccctgaccgagggttaggatgcccaggcttccctggaggcccacacagggtctccaagtgctgacagcgagctgtcggggctgcccgcagcacccggagccacacccctgtacccaggaggagctgtgagggcatggggaggtctccacagaccccacccagcactgctcctccctgcaggcatcctggggagggccctcaggcggggctggcctcatgtactgctcaacacagcagcgggcgtctcccaggcgctcagcagctcagctcagcgcccagtgaagagggcggaggaaggaatgaaggcagccacgggtgaggacgagggcccagggctccactgagcaaagctcctggcaccaacccagacagaagacgtcctggagaggccagggctgtgctggtactggccgcgtccacccaggctgggcgctcttctctttcccacgtcatcacggcgttttactcaactacaggtcggcctcactgaaataacgtggaacaggtgatggcgacagccccggtgcatggtccagcgaaagcaaccccgtcccagcaataaagcccagggcctgttggggaaggagaccctgcgggagaattggaggaagtgcggctctcaaggctcccaacctcagccttttagtcgtcccaacgcaaaacattcaaaggggcctaaaaattttgctaggcacacagcgtcttctaacaacataaagtatttaccggaacaatagtcttgtgactaaaatatctgaataaaggatgaagagccccgtctactttgggctatttagaagcctggaacagcgatcccagccctggcccctgggatcctcactcgaacaggtcctcctccaggccctggcagggtctcagtgaggcacagaagcctctgtgccatgcgtgggtagagacccctctccgggctctgagctgctgactgcaaggcccatgtgccccctggctcctgttcgcctctggacacgggggctccgtgactggcctctgagtgggcctgagtgcccgtccgcactggcctccccacccggcaccctccgtgggacgaggctgcacatctcggtgggctgactgcggtgcagaggccataagaggaagaggcgggggggccccgaggcaggggacacagcgtcttgaggacacagcatgaccctgacccccacgacccctggcaacacaagtgccttcccgaagggcctgcgaagctgccagaaataggcagaactcggcgaggccgtgggagtggggtttcctctgggccgagtcgagggcagacggcacctgctctatcctcacgctcaggaggggcagaggccgctgggcttggatggagccaggcccaggtcttgtccagggctctccagggcaccatgctcctccctcaagaggactcctgtgggttatgaatgacagaagcccaggctgccatcctcaagcaaggcaccccccaatcctcctggccgggaggggctgctgggagcccctggcaccagcgggcttctgtgggcggtggaaggaggagagggctgtgcgggctgattccaaaactcactgggtgacaccacctgcccagggagggcccagcactgccgtccagggggtctgcctgtcgtccagtctccttgagagcacctccagctccctccagtctccacggctcttcagagggcacgggaggttctgctgaggggcgggtgaccaggcccagatgttaaaccctcccaaataacgggcatattcaatgtaattgaaacttccaccacagggagaatgagtctatggtgacggggtggcaggaggggtcctagaaggcgcccactgtgcttactggaggcctgaccccgacaacggctgaaacaggggtctcccccaggggccactgaaacaggggtctcccccaggggccacctcccagggcacgcttggatttcactatgggctgtgcaaatggcatctggtgggcagagtgcagggtgtcttctgttcagtgtcctgctgcacacggtgccccagggcacagggccgtccacctagaacaccaatagtgccgtgtggcagagggccgtccacccaaaacaccaatagtgcccctcggcagagggccgtccacctagaacaccaatagtgcccctcggcagagggccgtccacctagaacaccaagagtgcccctcggcagagggccgtccacctagaacaccaagagtgccccacggcagagggccgtccacctagaacaccaagagtgtcccacggcagagggccgtccacctagaacaccaatagtgctgcgtggcagagggccgtccacccaaaacgcaacagtaccccagttacacgctcctggtgcaaatgaccctcctctcgtgcttggtgcaaaggctgttagcaacgggccacacaggagatgctgccacgtcactccagagactcacgcgtcccgagacccaagtgatccctaaacgtctaggaggagacctggccttggagccaggtcagccagaaggttgtccaggccgggcctccccagggctgcccagtctcccgatgcagtataactctcaaggcgcgggggccgcatcacccagcactctggaaatgctgtccgcagaccacggccaccagcacatgcactctcgtggttctgactgcctgtgaatccagctggtctacaatgagccgctggggaaaatacttcaagtcctgagatgaatggagcaggaatgcctctggaatatcctgagaaacacgactccaaaccctgtcagctggttctaactgtgctcactcttataaacaggtaataaaatatgggaaagaaggcgattgcagacaggggacctctcctccacagagacgtgtccaccaggagactgaggcaaatcctatgggttcaaaaccgaagtttcactggcggctgaaaacacccagggaataacgaggaaagagaaggcaaaggtgggctgaaatgaagccgcccttctgagttcacaaaggagcagagacacaccggtgctgcacaggaacccccagggcccccgtgttcctagcgcagcagagcctgccccgcatccaggctgcatctcctggggctgtgactcctctcctgagtccacacacaggacctcacacctgcactcaccggctgcagctgcacacacaggagagcttctcacaggacaaatgcctggaccccacccagagattgccattctttgactaggacgggctccaggcagtaagaacagacattcgtcttgattagaaagcctgcaggtggttctgggtgcagccaggactgagaggcattacttactgctgagaactgagaaggtgtgaagatgcccctacctcctcgccccactcaccggggagctgcgggtctcacaggggcaggcaggaggccagagacgtccacgtctgagacaaaggacatcaccgcaacagcagagccagagctgcagcgtctgcaggtgccctggtttgcctcacgcagtaccaaattgggattgggaacccagtgatgcctgcacacatatcggctgcaccttgggagcagggcctgagcctggggaaccctagtctcttataacgggcagtggcaacaatgctgacatctgcctcggagagagatgctttcttcctgatcacggacagtgggcaaacctccctgtgctccgaggctccgaggctgctccccgggtggacacacgcgcttgaatggagagtgaggaacaaagggaactgggtctttctcccttgatgcgccgcactgagataaaaccatgaagaacgtctcccagctgcgtcccgtctgggggcagccccagagaaggaatggggggcagggaaaacaactttccttaacccaagcaacgtttagttcacacccagcctgtacgcaagaggggaagggacaggcctggggctgcacccccaggtgggtggtcccaacagaggtttaacaacctggttctctaggggaaaaatgcatgcacgagctcaactaggttaagtcatacattgcactagtgtaaaagatgtgtagcacacaactcacaaaaaataatgagatacacagtcctctacttcaaactcacagagctaattgattctcacagcaaactcttgtctctaagccaatcctgggctgcatttaaccaggatttgacaaacagaggcaacgcaccctctgctagctggttctcaaaaagtgcgtcatcactgagtgtgatatgtgtcgaccattaaaacatttctcccactcatacaaattatattaagctgacatctcttctggctttcacactgggaatgctggcgcttcactcattcatcaatgtcacaagcaactttgttgaatcaggtgaagttttaaatgccagaaaaacattgtcttaatttttttgtgctattgcagtgtaaccgctatatacaagattatttaattcagggtagcaagattagatgatcaacaaaacctttgttcaaacgtgagctcaatttcctccgatgtgtggcccatcctgatttctgtggtgtgaacattcctggccgatttcaagcgaccagtgtggccccaaagccagagagaggagagcagggccccgttcagaggcacccacacctccagaagcacccagccagacagcctggagcccagcagcaatggcgtgccgtgaaatcacaggaagtgctgagtctggagtatcgactcccttcgtcctcgcggggaaatcacggggaagtggtgagtctggagtatcgactcccttcgtcctcgcggggaaatcacggggaagtggtgagtctggagtatcgactcccttcctcctcgcggggaaatcacggggaagtggtgagtctggagtatcgactcccttcgtcctcgcggggaaatcacggggaagtggtgagtctggagtatcgactcccttcgtcctcgcggggaaatcacggggaagtggtgagtctggagtatcgactcccttcctcctcgcggggaaatcacggggaagtgctgagtctggagtatcgactcccttcgtcctcgcggggaaatcccggggaagtgctgagtctggagtatcgactcccttcctcctcgcggggaaatcccggggaagtgctgagtctggagtatcgactcccttcgtcctcgcggggaaatcccggggaagtgctgagtctggagtatcgactcccttcgtcctcgcggggaaatcccggggaagtgctgagtctggagtatcgactcccttcctcctcgcggggaaatcacggggaagtgctgagtctggagtatcgactcccttcctcctcgcggggaaatcccggggaagtgctgagtctggagtatcgactcccttcctcctcgcggggaaatcccggggaagtggtgagtctggagtatcgactcccttcctcctcgcggggaaatcccggggaagtgctgagtctggagtatcgactcccttcctcctcgcggggaaatcccggggaagtgctgagtctggagtatcgactcccttcctcctcgcggggaaatcccggggaagtgctgagtctggagtatcgactcccttcctcctcgcggggaaatcccggggaagtgctgagtctggagtatcgactcccttcctcctcgcggggaaatcacggggaagtgctgagtctggagtatcgactcccttcctcctcgcggggaaatcccggggaagtgctgagtctggagtatcgactcccttcctcctcgcggggaaatcccggggaagtgctgagtctggagtatcgactcccttcgtcctcgcggggaaatcccggggaagtgctgagtctggagtatcgactcccttcgtcctcgcggggaaatcccggggaagtgctgagtctggagtatcgactcccttcgtcctcgcggggaaatcccggggaagtgctgagtctggagtatcgactcccttcgtcctcgcggggaaatcccggggaagtgctgagtctggagtatcgactcccttcctcctcgcggggaaatcccggggaagtgctgagtctggagtatcgactcccttcctcctcgcggggaaatcccggggaagtgctgagtctggagtatcgactcccttcgtcctcgcggggaaatcccggggaagtgctgagtctggagtatcgactcccttcgtcctcgcggggaaatcccggggaagtgctgagtctggagtatcgactcccttcgtcctcgcggggaaatcccggggaagtgctgagtctggagtatcgactcccttcgtcctcgcggggaaatcccggggaagtgctgagtctggagtatcgactcccttcgtcctcgcggggaaatcccggggaagtgctgagtctggagtatcgactcccttcgtcctcgcggggaaatcccggggaagtgctgagtctggagtatcgactcccttcgtcctcgcggggaaatcccggggaagtgctgagtctggagtatcgactcccttcgtcctcgcggggaaatcccggggaagtgctgagtctggagtatcgactcccttcctcctcgcggggaaatcccggggaagtgctgagtctggagtatcgactcccttcctcctcgcggggaaatcccggggaagtgctgagtctggagtatcgactcccttcgtcctcgcggggaaatcccggggaagtgctgagtctggagtatcgactcccttcgtcctcgcggggaaatcccggggaagtgctgagtctggagtatcgactcccttcgtcctcgcggggaaatcccggggaagtgctgagtctggagtatcgactcccttcgtcctcgcggggaaatcccggggaagtgctgagtctggagtatcgactcccttcgtcctcgcggggaaatcccggggaagtgctgagtctggagtatcgactcccttcgtcctcgcggggaaatcccggggaagtgctgagtctggagtatcgactcccttcgtcctcgcggggaaatcccggggaagtgctgagtctggagtatcgactcccttcgtcctcgcggggaaatcccggggaagtgctgagtctggagtatcgactcccttcgtcctcgcggggaaatcccggggaagtgctgagtctggagtatcgactcccttcgtcctcgcggggaaatcccggggaagtgctgagtctggagtatcgactcccttcgtcctcgcggggaaatcccggggaagtgctgagtctggagtatcgactcccttcgtcctcgcggggaaatcccggggaagtgctgagtctggagtatcgactcccttcgtcctcgcggggaaatcccggggaagtgctgagtctggagtatcgactcccttcgtcctcgcggggaaatcccggggaagtgctgagtctggagtatcgactcccttcgtcctcgcggggaaatcccggggaagtgctgagtctggagtatcgactcccttcgtcctcgcggggaaatcccggggaagtgctgagtctggagtatcgactcccttcctcctcgcggggaaatcccggggaagtgctgagtctggagtatcgactcccttcgtcctcgcggggaaatcccggggaagtgctgagtctggagtatcgactcccttcctcctcgcggggaaatcccggggaagtgctgagtctggagtatcgactcccttcctcctcgcggggaaatcccggggaagtgctgagtctggagtatcgactcccttcctcctcgcggggaaatcccggggaagtgctgagtctggagtatcgactcccttcctcctcgcggggaaatcccggggaagtgctgagtctggagtatcgactcccttcgtcctcgcggggaaatcccggggaagtgctgagtctggagtatcgactcccttcgtcctcgcggggaaatcccggggaagtgctgagtctggagtatcgactcccttcctcctcgcggggaaatcacggggaagtgctgagtctggagtatcgactcccttcgtcctcgcggggaaatcccggggaagtgctgagtctggagtatcgactcccttcgtcctcgcggggaaatcccggggaagtgctgagtctggagtatcgactcccttcctcctcgcggggaaatcacggggaagtgctgagtctggagtatcgactcccttcgtcctcgcggggaaatcccggggaagtgctgagtctggagtatcgactcccttcgtcctcgcggggaaatcccggggaagtgctgagtctggagtatcgactcccttcctcctcgcggggaaatcccggggaagtgctgagtctggagtatcgactcccttcgtcctcgcggggaaatcccggggaagtgctgagtctggagtatcgactcccttcgtcctcgcggggaaatcacggggaagtgctgagtctggagtatttattcccttcgtcctcgcggggaaatcacaggaagtggtgagtttggagtatcgattcccttcgtccttgtggggaaatcacggggaagtggtgagtctggagtatttattcccttcgtcctcagcgtatgtgatgggattctgaatgggggctgtgtttatctgggcataaaactcctgaagattggcagcaggagtccacgcagagacctcctggagatgggcgcgctacacgagcttttgaaatgagcaagtttccagagccggcgggattgcgggggcacctgggaaggcaaagtcacctgcacccgctctgcagccccggcctgcgcctctggagggagggccccgggcagtgccagcaggaacgagcctgcctcagagccccaagtctcagtggagctccttccaggctgacatggggctgacggctcccggggccagcagggcgcccgcccgacaccaccacaacccatttcagtgacagataacttcagacaacttatcagagggccttggagggccggaggcagcaacacacacagcctgattctgggagcagcatttccttccaaaaaccttaaatcggataatgagccgggcgcggtggctcttgcctttaataccagaattttgagaggctgaggctgacggatggctcgagcccaggagttggagaccagcctggccaacatagcgaaacctcatctctactaaaaatacaaaaaattagctgggcgtggtggcgcacgcctgtagtcccagctatttgtgaggctgaggtgggaggatcacttgatcccaggaggtggaggttgcagtgagccatgatcacaccactgcactccagcctggatgacagagtgaggccctgtctcaaaaaaaaataaaaggaaagagagacacatcagtcacagatacacacacaacaaatctaaaatagacatgtgaaggcctacacaattaaggaataatattttggaaatgtcaatgattaacgtgcctttagacttaaaaaattctgctgtgtgacttattttctaacacctcagctgcacacccttgagccacagttctgctcactctcagggccacataaggaaggttctcagtcttccccgccctggagctcccagccatttgctctgatcccttctacagcaattctcttgggctccttcaagtgtaagcctcttgccccctagggaaaggaatgcctgaagaatcacacttcgacttccttatctgaaggccatacttgatggatttgaacagatttgcacatttaaattcccaaattaattttttttttttttgagacggagtttcacttttattgcccaggctggagtgcgatggtgcaatcttggctcacggcaacctccgcctcccaggttcaaacagtctcctgcctcagcctcctgagaagttgggattacaagcgtgcgccaccatgcccagctaattttgtatttctattagagacaaggtttctccatgttggtcaggctggtcttgaactcccgacctcaggtgatccaaccgccttggcctcccaaagtgctgggattacaggcgtgagccactgtgcctggccctaaaattcccaaattaattttcacatggtaaaatgttccctggttactaataacaataaataagattatggaaacaaagtagagacgatccgtaagaaataaatagggattaaaaactccaccatatatgaagttcataattaccagcacagcggtgcagggacagcccccagctcctcctcccagggcagcagagcctggcgagtcccgaatccctggtggagctcccctcaagcctcccagcagggctctgtcccctaagccttctgctccttcgctccttcctgctgcactttctgctacttgcacagcaatttctaatagttctcattagaggggcagagcagctgaaaagggtgaagaaaataagagaccaagatggcagggatgttcggaggaggagagaggaggggagacgaggggagacgaggggagacgagcggggaggagggggggaggaggggggagggggaaggggaaagctgcagagaatgaaggtgaggacctggtggaaacctcacagagggtgatttgaatacaacctgatcttccctggcatggagggcaggaggcggccacctgagccccgcacaggtgcccggcaagcccaggcagaggaccaagcagaaggtgctgtctgatccagccgcagaactaaggaacgcctttagcccctgctcccagctgcagaagagttgcccggtgacccaggaagcaggaggaaagggcaggcctgggccagccctgcacggacatcagccctgcacagacatcagccgcgcacggccgccccacagcctgcacacaggtgttcacggcacgtgtgtgggtgtcttgattgacaccacacaactccctgcttttaaagggcacgatcccgtggtttttagtgtattccgagttgagcaaccgttatcacgattgacgcgagcatttccgtccccctgaacgaaacccaccctcctcccccagcccccggcaaccacgagtccactctgtgtctctgtgggtctgcttgtcctggacatttcatggaatgggaccacacggtccttccccttctgtgcctggctgctttcactgaacgtcctgtcttcaaggttcgcccgtgcttagcccgtcacagctctgcccatcttcctggccagatgatatttcatgtcacggatggaacgcattctgtgtatttgttaatcactgatggatgtttgggctgttcccagctttcagttgttgtgaatggtgccgctgtgaagtgtgcacaagttcccatgtgaacacggacagctttgggattctcttgattatttaccaacgggtggggccgcacggcaacaggtttaattaccctaggagccacccggctgcctgcccagggccgtgccttcacacctgcctgcaaagcgcaagcgttaccatgtctctacaccctcgtcagcacttgttactgtctttttggttatatatttgctttgagtcagagaaatatctgtctttaattttgttttgttttgttttatgatggcaaaatgggggtacatgattgtggcaacagttttgagacagttaatatttttggtgtaagaccagacagatgaagaaactgtctctgaagagaagggaccgaggctcctccctgcgtggcagcaaaaggtccacaacacatcactttgggtctcctgtcccaggagattccgcttccgaccaggcaggcttgccccctgagctcatcacagcgtgagtctgggttcacattgcccacactggagcatgggctgtgaaactacaagagaaaaacacctcacagcagagagcccacgtgacaagcacacatgcctgacgggcacgggcgtctctgcagcaggctcaggcagtgaacacgcagacccttgcttcctctaaattcacagggctggccctcaggtatgcgtaacaaaaagaacgccagttcccttttcctggagaaaatacaagaggttccagagccttaatctacaactccagttcaaagtttcaagtagaaggtggagagaggtgggaacattctatttttgaaggtttccctataaaatctgttacatacatatatatgtatgttttttggtggtgttattgttcagtaataccagaaatgcatggtagaaaactttcaactataggagtccaagattaaaaattaagagtagccctaaagccccatgcccatctgtagacgcactctctagaaataaccacagttactaatttcttagttttttgagctagcatttcaactttaaataacagtcccattgctatttcttagatcaacttaaaatcagctgctggctccctgctgtgaaagatgaagggtctggggccacatgggtccccctccactgtcatgtcccacatttcagtggaaaggcttccgagatttccccatttggtgtgaggtcgtgtcccagatttcagtggaaaggtttctgagctttccccattcggtatgaggttagctatggttttgtcatcaacaggctctaccattttgaggtatgttcctctatacccaatctgttgagtttttgtcatgagggatgctgaattgtatcaaatgcttttccagcactgactgaaataatcatggtttttgttctgggttatatccatgtgaccgatcacatttattgatgagcaggtattaaaccatccctgcattcctggatgagtcccacctgtcatgctgaatggtctttctaatgtgctgctggcatctgcttgctggtgtcttgctgaggacttttgtgtctgtgttcatcagagacattggcctttagttttctttttgtgttgtgtccttgtctggtttgggtatcaggtaacactaacctcactgcttgagtttggaagtatccccttctctccatttgtttggattagtttgaatataattggtattagttctttaaatgtttgaatgatccatcagggcctgggctttttctttgctgggagattttttgttctgatttctacgtctgttcaggttctgtttctttatggccccaccttggtaggttgtatgtgtccaggaatttataaaatttctctaggttttctaatgtattggtgtatagctgttcataatagtctctagtgagcctttgtatttctgtgctatcagttataatgtttctttttccatccttgattttatttattggggtcttatcttttttttttcttagtctagctagagctttgtcaattttatcttttcaaaaaaatcagcttttcattgtgttgatcttttgtctcttttgtctcaatttcattcatttctgctcggatctttgttatttctttccttctactaatttgggggttggcttcttgattttccagttccttgtggtgcatcactaggttgtttacttgaagtctttctacttctatgacataggcattcattgctataaatgtccctcttagcactgcttttgctgtatcccataggttttggtatgttatgtttccattttcatttgtttcaagaaattttaaattttccctcttaatttcttccctgacccactggtcattcgggagcatgttgtttaatttccatgtgtttgcatagtttccaaagttcctcttgctatggtttctagtttttttgattgtgttgagaaaagagacttgatataattttgacgttttttaattttttgagattgttttgtgagctaacctatagtctatcctggagaatgttccacttgccaatgagaataatgtgtattctgcagctgttggatgaaatattctgttaatgtttgtcaggctcttttggcctagagtatagtttaactccaatgcttcttgttgatttttctgcctggatgaccttcccgttgctgaaagtggggtgtgaagtcccctactattattgtattacagtctgtctctctctttagatatattaatatttgctttatatatatcggggtgctctggtactgggtgcatatatatttactattgttatatcaccttgctgaattgacctccttttgtagccctcataaggcttatgaaaaacattcagtagttataacaagttattaaaactgataccaacttacctttgattgtaaaaaaaagagacaaaaccatgtacatgttaactctcttctcctcccatattttgaatttttggtgtcacaatttatattttgatattgcctatctcctaactaattgttgtggttattattttattaattgtgtctttcattcttcttacaaaagatagaagtggtttacacaccataattacagtattagtatgacaatcacattagcatccttttcctttggtttgaagaactccctttagggcttcttgtaggacaggtgtggtagtgatgagtctcctcagcttttgtttgtctgagaaagctgccatctctccttcatttctgaatgatagctttgctgggtacactatttttagttgacaattgttttcctttagcactctgaatatatcatcccactccctcctggcctataaggtttctgctgagaagttgctgctaggtatattggatctccccaaaatgttgtttgcttcttttctcttgctgcttttgacatcatctctttgatctttgagagttttttgattatagtatgtcttattcttatttgggttgaatctgattggtgacctttgaccttcctgtacctgaatatttctatctttctccaggttggaaagtttgctgttacttatttgaataggtcttcttctgccttgtttttctcaattccctttttaactctgatagcttgaatatttgttcttttgatgttgtcccatagatcttgtaagctttcttcatttcttttcattttttttcttttttcttctctgtgtattttcaaatactctgtctttgagctcactgattcctccttctatttgatcagttctgctactaatgctctctctttcatttttgcatttcattcactgtatttttctgctctaagatttccatttgattttttctattacttcaatctgttaactttctctgataaatttgtaaattcagtctctgttttcttgaagttcattgagcttcctgaaaacagctattttgaatcctttgtctgagagatcacacatctccatcatcatgttagggcccgtctctcgcaccttattttatccatttcgtaaggtcacatttgcctgaatgttcttggtgcttgtggatgtatgataatgtctgaatcccaagagtcccacagagagacttttgactgtgcataggtacagaattcttgttgttgtgggaaatatgagcaggttaccttcaattccaccactcaataaactaaacatagcattaccatatgatccaccaatttcactcctaggtatatacttaaaagaattgaaaactggtgtgcaaatcaaaacaaacacgaatgttcatagcagcactattcacaatagtccaaaaaggtgaaaacaacccaaatgtccatcaacacatgaacggataaacaaaatgtgatatgtcatttgtggctgccaggagatgggaagtgattacttaaaggatgttcttctggggtgattacaaagtgttgaaactagagagggatgatggctgcacagcattgtaaatgtgctaaatgccactgaatcgtacactttaaaattcttaaaatgctgaatttcatgttatgtgtattttgcaacttaaaaaaaacatgtttacctaagtattgatagaggcaacattggcaaatgtgaatgtgtttagtacacatgcatcacattctacctgacatccttttttggagcaagaaagggtataaataaatacttcttttagagcttatatttaattgtattatttttatttatgcattttgttgggctataatatacactcagtaaatagagctcacacgtttagatatgtgcacagccacacagtcagtaccgagaccgaggcgcgggctcccccgctccagaatctcctctcatatcccgccccacctaaagcttagcactcttcagagttctagagtcaccctattcttacatctcagctcaacagaaccatgcagtatgtacttcatctgctgctctagtagggggttaaaggtgatgctattattctacctttcattttaattcatgaaatgaaataattttataagcggaatttactatttagtaacccatcagtgaagttcacacaggaaagtcaggataaatgcttgattattcccttttatttactgggttttcaaataatgacttggctacctatcatcctccattggtgaataatttggggcttttcagtaattttctgcaattattttttattgagatgtaattcacatatcatacaattcaccctttaagtgtaaacacagtggtttttagtatattcacagagctataaaaccatcaccactaactccagagaattttcatgacccgaaaaagaaaccccatacccattcccactcccatctcccctccctacagtccctggcatccattaatccaccttctatcactacagatttgcctgtcctgaacatctcacagaaatggaatcacacatgtggcctcctgcacctggcttccttgatgcagcctcatgttttctagatttttccatgctgtagtctcagggcttcactccttcctgcggctgattaatggagacttgtttatgtcatgcacacaccttcacatgcgtccactcacactcacaagtcatcaaagagctcaagcagcaggcaaggctcaggagaggcactctgagggacaggatgatgggcccggctgtttccaaaaccaggtggcttggggcgactcatccaacctctccaggcctcagtttccccatctgtaagctgagtggctgggcctcaggtgaccctgggtctctttccaactccacaattctgtgatttgagcaaataagtccaatcctgagttttgtctcactttctaatccagtaaaagttaagctattgtgtttacttgactcagcagagtgtgtgggggcagagcaattatgacataaaaccacgatcctctttggtactacaagctaatcaacgttaatttttcacacaacgactgggaaaatctgcctacaggaagatgccaccctgggtggcactggtgtgccgggagggggtgctctccaggtggccctggcggcatcggtgtgctgggaagggggtgctctctgggtggcctgggtggcatcggtgtgccggaaaaggggtgctctccaggtggccctggcggcatcggtgtgctgggaagggagtgcgcaggcccaccccggcgtgctgcctgggagtccacgttctcgaaaatgcagggtgaccctggcgcaggatcgggtctgagagctgctcaccgacccatgcctcctctagcaaatcgcctctctcacagtcacctcaacagcatctcagccgttgtccgacactgggtgattctgcacgcccggctcggaaccctgtgcattgcccatctgtgagccgacctcctgcctgaagccaccttctcatagcgctcagtactggggaccctggccgggaagtttgcacagagtatgagctctggctgaccatccatgtcctgggtacaactcaccctcctccgtgattcaaactgttccagcctggaataacccgattgctcctatgggaacaactgctcctttccagccaaatgacccatttcccaaacgccttccctttccattctctaaatactgtagcaccacactgactagcgtgcgggtctccaccacagttatgaccacccttccctcctcgtcccccaaagcactcaacagctctccagcacccaccgaatgaagcactgacccttcagccaggctctggagcccctacaagcaacgtccgtctgtgtccaggccgatctcgctgctccctcggacgtactcgccctacaccccagccaaacgcactccgtgtttgccaacatgtgcgcctttgaacatgcgttctctccgcctgcagtgccctcctctgtgtctcaatccttcccgtgcaccaggccactctgagtctgctcctccacgaggctcccagatcacccccaaagccaccacacctgtccctgagtgttcatggcgtcacagttgtcactgaggctgtggcacttccccttccaccaggcacagcagctatagttgtgtgcacacatcccctcctgaaccgagcagttctccgcagatatgggctgaccaaatgagcatctttagagctaactgggaactgtccaggggcgagaggcctgggtggtcttagtactgtcactcatctctgcttcagttaacttgagcaataaaataccctgcagataaggtcagacggcaggtgccagtgtgtcctgaaaagccgcaagtctacaagcagccggcaacctgcccggctatgctgtgtgcatccccacagggcgccaggagcaaacacccaaacacccatcctattcccgattcagggcaatggtccaaaagacgccatcgctgctacatgagacagaacgtcacagcgaagaggcaggcagcaaatagatgcctcagggcgtttctcaaagaaaggcatgatgcagcctgaaaaccccaccagaagtgtcttcctgaagcatctaaacgccctctgagttccttctcccagaagagagcagttacatgaagcagcaatcacagaacggaagtgcccggccacaaaggctgccgtccttctcctcgtcccagtccatcttacagaatggctcccctctgcagggccacacagttgcccgggatgcagacgctgagacgggagctgatgtgcaggtttctagggcaagaggcgggagagagtgggcagccgacaggacgggggacgcagcctatgcggagtggatgcctcaggaaggccctgcctgggtctcaaggccccaccatggggtcttgtctcattcgtgaccctgtgcacgccgtgcagcagtgcagacggccggggccccaccacagggggtccagggagaccaccagcgagagagtggatacccctgggaacaaagcgggcccagatggagacctcagacaaaggcagctctcagccctcagctgagcacgccgaggggctacagcccccatccaggcccaggccggctgccagcacagagaggcccaagtggaccccagggccaaaaccccaagtctgggggctgcaggggagcacggcacctggctaaagacacagcacacagggctacagcgggcagcctgtggtcaacagctcatcagcgacgagccaggcccagccaagacagcaggaaaaaaaatcaaacgggaggccatgccctctaccctgggggcagagctgagaggacagagaacaggcggacaaggcaacagggacccaggtgcgggtcagcaggcgctaaggatcccagggtctgcgtgcccagccaggcctcacaccagcgacatccaggggtctgcaccagagccatgggggaacagagacacgaacaggtgaaagttcagcagggctgcaggcgcccaggccagccctgaggcagagacgtgaacaggcgaaagtgcagcagggctgcagccctgagacctggtgggctggggtcaggacgttaagggtgtgtgtgtgtggaatggggctggccggccccctcccaacaagatgtaggaaaccccatggccgggatgaggggaggcaggaagggcaaggggcatggaggccggctgagagtccagaggagagaccagcccagacccagggaagaaggaaccccgtgggatgtcccagacagcaaggagagaggcagtggaaggcacaagggcgggagaaagacctcagaagggatttaaagaatgaagaaataaaagctctgaaatttattttaacagagctttgggctacactctaacctttgcttcagcagcacaagaaaaagaggctgcacagagtggccccgcaggccagaaggcagcaacgcccactgatgccggaccacagcagtcggggcccggccacccgagccccccagaccacagcagtcggggcccggccacccgagccccccagaccacagcagtcggggcccggccacccgagccccccagaccacagcagtcggggcccggccacccgagccccccagaccacagcagtcggggcccggccacccgagccccccagaccacagcagtcggggcccggccacccgagccccccagaccacagcagtcggggcccggccacccgagccccccagaccacccctccttttctcaaggtcagaacagcagtgaaggtcagagccagaagcacagcagacgctcccaagccacaggcagctgctgaggcctgagccggggacgaagctcctccctgcatggggacacgcggggctgcagccactcccaggcctccatcacacagggacggtacagaaatagcgtgtcttgtgggtgggtgctgggtcggggagggagggcgactgcctctccctttccaggcacatttggattccccggggtgtccgggaatgactcaggcctctggtcagcgcttctcagacctgtgttcacacagcgcgtctccctcctttccctccctgcctgggacctaagtacggctctgtttaaaactggcccaaatgcagggtcagcgcctgagatgcagcccccacagcagcccccccacagcccccccacagcccccccagcccccccacagccccccacagcagcccccccacagcccccacagcagcccccccacagcccccacagcagcccccccacagccccccacagcagcccccccacagccccccacagcagcccccccacagccccccacagcagcccccccacagccccccacagcagcccccccacagcccccccacagcagcccccccacagccccccacagcagcccccccacagccccccacagcagccccccgtagcccccaccccacagcccccccacagcccccctgcagccccccacagcccccacatgctccactcgatgctcacacgcacagttttatctccttaactctaatgctgtttaaaaactattgtcctaatcaagcaagaaaaactgcaggtttgcaaagcgtctgctctggaagagcggcaggccagggtggagagaccacactgccacacctgaacacagcaaggctttccaaactctgcgcaataggaagacgccgaatggtaaatggaggagctcgcaggagacgcagctctgactctgccccgccccggcccgcggtgctgagggcgcgccgatgtggatgcctctgtgccagcaccagcggctgcccctcggccccgaccctccccactgcgtcctggggcaccctcagagcttcggccatggggtgcacagcaccctccaagcattctgaaaggagattttagactcttgtgcgcaacacccaggagccgcccgcctgcaaagcacttggtcagcgtggcctggaaaggggaggaaggtcctggaggcagggctctgtcaggcggaggacgtgatgctcagagcagccagggacccccgtctgggcccagtccccctgcgctgcgccccacggctggctggaagtttgttctggaaaccacctccaagacaagtgcagcagccggccctagcagttgggaagaaggcggctgacgtggcttccatggaaaatgccagaaagcacatcccacaccaggacacctgggcaaacagcctcaactcggaaaatcccaggctggttcggtctctctgctgcccggacctgtttaaatgtccagccgtttgggaactgtgtacccttcgagaaacactccaaggccccagggacaccggaagccgtggagcccgggccccatgcgtctgtgttctcgccacctggagaggctgctagtgactgacaggtggactgcggggcctcaactgctactgagaatgccacacaattttaaaaactcagaaattgcttatttttagaattttccatttaacatttttggaccacggctgaccacatgtgactgaaaccgcaggtgagggggtgagcgtcagcctgtgtcaggctggacacacctgggggcctgaggagcagccgggggtgtagggacaggggctccccacacccacatggatggcctgtgcagtcaccagcaaggcgggttctgcaggcctgtgtcccggccaacggcagccaccaaacctctctgcacttctgttacagacaagtcagagaggcccagaaaaagggaccaaaattgaagaaccagggaatttcagagggaagggaagggaaaatccaactggcaagcagacccctgggccatgtgctaggaaggggttctgcccagcgaggtctacccccaaccaggacgggtaggcagtggccccagcaccccctgcacccccacggcccaccaggggactgcacctctacaggaaggacagaggcaggaggaacccctcagggctggagagttgccagccactgcccgtgctgggccccgccctgagacagtgtctaagcaccaccccatggacaatccgaacctggaggggcctgatcccggccctgacccatgccaggggccccagccggcactgcacgccggagatccgggctttccttggcaaacacgcttggctgtcctcgtttccaagtcagccctgttggtaaaacagtgaagccagcagtgaaatacacgaaacccgaacagccccggagttggaactggaagcttccagggaagacggcagtgtctaagtgtctcccttaactgctgtggctgcacccggggtcctgggggtgagaggcttgtgggccctgaagtcacctgctggattccaaagtgggccatgccaatgccgtctggaaaacatacggaaaatgtcattcccaggaaatgtggcacatcattcaccctggaccacggcacaaggaaatcaactcaccctggaccatggcataaagacagacggggccctctcatcagaaagtggggagcgggggtctcagtttccaaggaccccacaagcgacgtctacagggtgaaagaccccgtgcccagcaccgaaggacctgcccgacacacagtccccagccttgagcggagacccccagactgcatacaactgtgcaaatgcacttgacctccctttggttgtgagtcacaggactgtcttaaaaagagtgtcttcttccagtgccagaaaacagagagacgggggctgtgaagcacaggatccacagcgggcgggtggtaggcgggcagcaggtgggcggtaggcgggcagtgggcaggcagcgggctgagaagcagagcagagccccagccaggagcccagagggcggcagagcagcgggcaccgaaccagactgtcggacctgtgctgggggagagcgagagtgaaggaggaagagagacggagacagagagacggtgagagggagagggacagagagggagtgagagcgcttcccacaagaagaaccaagctcaggtcccaccctcccccagagcctggtgcagctgcgtgggacgggcaggaggtgcgaggggccctgtctctgacgttttgtgccagcactgccctctacacacaaactctcaggaaccatcacgaccccattttgcaggagaagatgctgaggcccagggcggtgagcaggccacatggccggtggcaggggcagaagtgggactgcagcccaccaggtggtgtcacagccaaggctgcggcgtcactgcctgtcctgcctcacctacccccagggcgacgctcccgactaaaccacctctgtcctatggtctccggggcttcctgacccctggggagggcggcaaagcctgtggaggctggagtcctgtgggctggggacgacgggaagaccaagtcgtctgtataatcgccgtgggcgcagccggcagtgccacccacccacccacaaggcaacacggggcctgagtccagccccaggcaggtgggctcccagagttggggtccctgaaccaaaccacccctgctgctcgctcacccctaagagtgaggctgcgatgctgtcagccaaggacactcacgtgggcagctccggtgcagccggccccagggggagaaatgcagctgtggctgtcgtggaggtggctgtggccaatggccgtgactgttgctgtgtctggcagagaagccaggtgcactggctctgtgcttcaaggagacctagagggtctcccccaagtccaccggaaatgtgtgcacattcgccctaccccactgtgtacctggcccaagtcgggagagatgcccaagagaccacagccagcctcagcacagtgaaggctgccctggcccttcggggtgtctgggaagagcctggcattctctctggggtagctctcacccttgcaaagcacagagaacaccaagagccccagacacacactacatccaaagggaaggtcgggcggctcccagacgggggacggggggacgggggacacagaaccaagccgccgaggagcacctgacaccggagcccgagtctcggctcagcaccaccacccccgatgcgtccacactgccacggccacagacacccacccccgatgcgtccatgctgccacagccacggacacccacccccgatgcgtccacactgccgccgaccacagacacccacccctgatgcgttcacactgcccccggccacagacacccacccctgatgacaccggagcccgagtctcggctcagcaccaccacccccgatgcgtccacactgccacggccacagacacccacccccgatgcgtccatgctgccacagccacggacacccacccccgatgcgtccacactgccgccgaccacagacacccacccctgatgcgttcacactgcccccggccacagacacccacccctgatgcgtccacactgccccggccacggacacccacccccgatgcgtccacgctgccacagccacggacacccacccccgatgcgtccacactgccgccggccacagacacccacccctgatgcgttcacactgcccccggccacagacacccacccccgatgcgtccatgctgccacggccacggacacccacccccgatgcgtccacgctgtcacggccacggacacccacccctgatgcgtccacactgccacggccacggacacccacccctgatgcgtccacactgccctggccacagacacccacccccgatgcgtccacgctgccacggccacggacacccacccctgatgcgtccacactgccacggccacggacacccacccctgatgcgtccacgctgtccccggccacggacacccacccccgatgcgtccacactgccgccggccacggacacccacccccgatgcgtccacactgccccagccacagacacccactggtgatgcggcctgagatgccaccacaccctggccagaggctcagtccacagcccataccccatgacctgtacccacaaaacctgcagctagcaagaaccggcctctgcctgaccctgtcatcaggggcgggaactccggtggcgggcacacccagcgcaattacagggcgagcatccgatgccctcctagtgggccggccacaaagcctctcatcagccaccccgtggagaaccacagccaaaagcctgaaccgcacaagatttggcgtctcaatggcaccttcagaataggagaaaatagcaaatcgaaactttggttttccgttccttatttacgactcaggacaagactgcctgagagagcagcagactccaagtgcaggctgcagtgcagtgtctgttctggagggggggctaccgcctccccagcccacacatgctcacccctccctccccacacacacgttcacaccctccccacacacgctacccactcccctccccacacacgttcgccccctcccctccccacacacgttcacctgagcattgcccacaccagcgtcagcagccctcacaggaagggtggcccccaggctctcggccccccgagcccagcttccatctcgggccataaacaccctttggccaattggcgcaccctcctccaacagactatgacctccccaagccccagaatccctggagatggagagcacgcctggcccccagtcagggcaggtagtctccagggccaagccgtcacctcagaagggtgggtggggctctccccaggaggagggcaggtccgggactgggaggacgacccccacgcaagcccccaccctgcccttgggctccagcctcatccccagcagccgccagccctctgagatgccagggtgccatggaccctgcactgaggggtgctcactgggcagccgtgtgaccagcaagcagaggcaggttcacagcagcagtggagctctccagaggcaactccaccaaggggtgccgcagagctctgtacccccaaatttatgaggagcccggctttgggaggggacacctaggggaaaagggctcaggaggcctcagccaaggaggagcagcactggcagcccccctcctccagcacggggacagggaccaccggcatcgaagctcctcacctgcctcctgcctgacaaggccacaggcacatccggggccagcactgaccagacgctccctccgcctcgcttcacccagcctgaggctggacgggaggcactggcgtctgcagcacatccacagcattccagaaacgacagaaaccaggccaggctctgagcagcccgtccgttgtcctgacacctgaccatgacggcatatttacggtgtcttctcaatctttgaaaaatatttttaagagaacatgagaacaaatcaatattccagtggcctaaggaagtcagctagctgtgaaactattacggtaagctacacagtgggggaatcagcgtgggggaaaggaagcgggcattccacagtgcaagactctgacacacagagcgtcttgcacccgccctgagctgagcagtcctgaccctaaagagctgccattcctctggggccacggcaggaaatcgcaggcactgagtgggaggaagaggatgaccgggtgttgggatgggtgcacatcgcagagcggcacacggcagcctccggatgggcgcatggcagagcggcacacggcctctgctgtcttttccgatgaactttcaataatacatagaaacatatgggtttaatgtttcctgtgtgtgtttacagatgtgtgtttaatattgaatatgtgtgcgcgcaccgtatctccacggagcaaaataagaatggagagaaactaacgcaaagaaagacgctaacgtgccaggctttcagtggggacaacttctcattcttgaaaacttaaaattagcttttccaaaacatctataaagcaacagaaatgcttacaaatttaacagcatttgagattattgtaaataaaaatgataggtctaatttttcttttgccaacatttccttcgtttatattgacagtcaactcattacgtgtaacaataatggcaatttttcctaatgaagtttaaacataaaatataaaacaatgtaattcggagctttgtaaataaatgcccattttacttagcgtaggtgtagaaattcacacccaagtcccacttagaacacgcttcccgctccggagcataagcccctggcgtggggaggggttgggctctgtctgaactgatcaccaccactgctttattaattgtttttggcttaacacctgaaccagctgggtgcaaactatgacacacattacaaaaccacctgtccatcctccaggcacatggaaggcacacggcccacagaaaccaaactatatgctgcgtcccatttagaaagctctgcgtatgtttaaaattaaaagtcttataaggaaactatttttctgtattttaaaatgttcttaattacaaagaaatagatattcattctagccagttaagtctccaggtagaaaaagttaactcttttccctccctcagccaggcccccccagagccacatctggcaaggacggcttggtgtgcacgcccacacctcctctctcgtgcacggccacatctggatcagatgtgcaggcatttcaacatggcagtctccatccagccacggtctgcggacagcgttcaggctccagccttgaccctgggcaccttgaccctcacggggtacgtggcctgtgtgtctgcctttgtgtcctggtcctcgcaggggacaggcctgtgtgtcccacgttcgtgtcctggtcttcgcaggggatgtggcctgtgtgtccctccttcgtatcctgacccttgcgggggacgggcctgtgtgtccctccttcgtgtcctgaccctcgcgggggacgggcctgtgtgtcctgccttcgtgcaccctgacaccatgggtctgattttcccacgctggaggtctgcttctgaacagctgcatctcctcctgcaggggaagctgtctgttcacccaggtgcctgtcctgtctgagggctgggctcttcctacccaagggttgggggctggcctgtccctcatgacccaggcaggcggccagggctccccggaactccaggctgctgcgggtgtctgctctgccctgggtgaggctctagaagattcctgtggaagcgactgtgtctaggggagcccattccccagtttaaaggacgtccccccccatggctatccacatgcccagtcctctcaggaagttccaggctgccaggatcagaggaagcagaagccgctgtccttcagcaggaccctgcaaaagcaggatgaatcagcggggccattcagaacaaggttcaaattactgctgcacttttcagaatggagccaggctcagtgtttcagaaccagaggctgacgcggatcagctcgcacccagcctgggacctgagccagcccctgagtgccactctccacggccgcctcagagggtaagcctctccaagcctgcttcctcgccggcatggtgggggtggccctgccatcccctaggggctctgcgggatcccctgaacactacgaaaaacctgagccccactcctggccactgggtaaggacctctccgagcctttctccttcccattcactcccacccccaggcaggagcgaccagtgctgagaagtcctatcatcccacaacccatcatcctccgtcatcccctgtccgtcaccccgcagctgtcatcccccatcaccccgtgtctgtcaccccgcgtctgtcaccccatgtctgtcaccctgcatccgtcaccccgtgtctgtcatccccgtccgtcaccccatgtctgtcaccctgaaaccatcaccccatctgtcaccccacatccgtcatcccgtgtccatcaccccgcgtccatcacccccatccgtcaccccatgtccgtcaccccatccatcaccccgcgtccatcatcccccatccatcaccccccgtccgtcatcctccgtccatcaccccacgtccatgatcccccgtccgtcaccccgcatccatcaccccatgtccatcaccccacgtccatcaccccatgtccattatcccctgtctgtcaccccgcgtccgccatccacatcccatcaccaggtgctgttttcttggtgctagagcaaggtgggattcacaccttgtgtgcacagcttctgagtcactgggcggctgggcacagcctaactcaggagcagggacccacggagggtgtggcgacgacacagccctcagcttgctctccaggagttcttctgatacctcgaggacactctggaccctgtgtctgggtcccagcccttccgtaacaacgtggctcctctgaatcagtcacaaggaagatccaacttaacacagagagtttttcccaaacagcagaactggcagcaacacaggcatcctgcagttcagtccactgcatgcagcgtgcaggtgtcggagggcgaggctgccgtgggctcccggcggacggtggcagggcaggcccaggtctctatcacagcaaggcctctccactcggccccctccacctgtttacaacctcaagctgggtcaaaaccccaggggtactcagagggagtgtttctccccaactggattccttaagccagagggcaggcggcagggtcctggcctgacaaacacacacgggcccccgaacacgaccggctccgtgaccgtcacaggacgttcaggtggcttcattttcagtccacgcctctggtgccagggtcttgcttggcacttgtgtgaacggcgaccacgtgaagcctctgtcttgagaaaagtgtaaacagcagctgcctttcaaggcactgaggccttcctcgaactcagctcgtttgtgctgcgtggttcccagtccaaaccctcctgttcacagcctcctcttgcctcaagcatcttagagctccactccaatccacaccccagctgccttttacaaaatcccaagccaatgacagcttgaaaataaagtgagaaaaacaccgaccaacatttactcagcacctacggtgggctgcggacgttgacacagggtcctctctaatcttccatacagatcagccatgagggccgcggagaggagaaaagcacagctgagctgttttctcttaaagcaacataaacgtcaaagcaaaactggagcccaggactctctgacttaagctcatcctccttctgctccatcccggctgtgcacacctggagaccaggccctcgagcctccaaacgccgtgagcagcctcctcctgctgtggcttccaaagagacgtcaccagaggcggggctggcgcagggccacgaggcaggcgactgggtctctttgaccgggggtggcctcgcggcggcacgagactcagcatcgtgtgggtctagctctgggaatcgaggcagcccccagaacacccttggggcgcaacttcccggtgaacgtcccgtctcctcagccacccacagatgctgccacagctgcaccctcagggcaacgagcgtctggcggagcccagtgagagccgtgaaacacagacctcagggccaggccctctccccatcacagaaacctgaccagtcacaggtggctgcagcctgggtggttggtaaaagaaaaattattccttctataaccagaaaaaaatagtgaatcaacagacacagaaatgctcagaataaaacaaaaaatctaagtcagtgggacagaattcagcagtccccaggggggcctggaagctggacccctgctctgggtctacgggcttacatggctgccaggaccagggagagacagacccgggcccctgaccataccctgtgctgtaacgcctgcaaggtagattttaagtaatttaaaaattatcaaaaggataacatttcatgcctgtgaacattacgtgcaactcaaatctcagtgtctgaaataaggtgaaatggatacagtccggctcactggacggcaccgtgcctgcggctgcttccctgcacagctgcatgacccctggccctacacaggacaggttctgcgcactcggccgccaccttccttacacggcttctcaggaaagcagcaggcagctgtggcccagcgtgagccggcaaagcacttccctcccagagccccgtttcctcatcagcaacaaacacaacaagcttcctcccctggctgctgtgaggaccgacagcccctcctggcacctgcacagggcatgacacgcacatcacagccgccttcacccgctcagcctcccgcgtccccacagcccggaccggagcctcagagcaccaggacacacccatccggacaccggcaggtttgacaccacagactgtgcttggctggggagtgagaatcctcctgagagagccacggtgtcccaggtcgggggcagcagagtgagggtctggccgtgggccccggtcgggggctgagccacgctctggtcaggaaagacatcgccagacacctgtcataatccagggctgctcaaagtaaaaaaaaaaaaaacctaaaactgcaacatggaacggcacaaacgagctgcaggccgagttctaacgggctgagcctcaaaccagctgcaggccgagttctaacgggctgagccacaaagagctgcaggccgagttctaacgggctgagcctcaaaccagctgcaggccgagttctaacgggctgagccacaaacgagctgcaggccgagttctaacgggctgagcctcaaaccagctgcaggccgagttctaacgggctgagccacaaacgagctgcaggcggagttctaaggagctgagcctcaaaccagctgcagaccgagttctaacgggctgagccacaaacgagctgcaggccgagttctaacgggctgagcctcaaaccagctgcaggccgagttctaacgggctgagccacaaacgagctgcaggcggagttctaaggagctgagcctcaaaccagctgcagaccgagttctaacgggctgagcctcaaacgagctgcaggccgagttctaacgggctgagcctcaaacgagctgcaggccgagttctaacgggctgagcctcaaacgagctgcaggccgagttctaacgggctgagcctcaaacgagctgcaggccgagttctaacgggctgagcctctaaggagggaaacgtcacttcctgcctcacacagagcccagcgtctccatgtccactgatagccttggtatttgcaactatgtccatgaccatctctgtttctccaaaacagcctctagctacataaactgtttagaaaacctcatgcgtaaagcagagtatgtcaaacctccatctgtggtcaggagttaggacatccccagctgcaatttgagcaaagacggcgcttccagaggatcatcggatcctgtgtcttggttggggttggggcccatcaacttaaaatagcttctgtttatgctggtgaaggaggcacagacttcaccctatctaattccaaggaacaggcgagggtgggagctgtagcggaagagacaaaagcaaaaggcagattcgcccctttgtgtggtcccgtaagtgacactgtccctccctctccctggaaacagcagcccccaggcaccccccccagcaactgggacaagggcacaccaggctaatttttaatcagatggatttagtgatagcaaataaagagaaggagaacaaaaccctcagccaggctattgtgaatgggtgttaccaaaaaatggcattagcagggcaccaggggccaggccagctccaggcagccccgcatctgctcagcaatccccggagtcttctagggggcctggggcagccggaacctggccgggtggaggatttctaccacgagaaagtcagggccctccccgaaggagcagaagctctgcgggtgactgtttgggaagctggtctgctcctgatactctgcaggaagagaatcacactctttagaccggggtctcagatttcagccggacgggaactctctgcagggccggtggaaagagatcgccagccccagctctgtaggggtgcggcctgcctcgagcacttcacacgcgtgcccggggatgctggtgctgcaggtatggggaccccgctaggagagccccgggttaagggttggtaactggagaatggggtgggggtatgccagctctccctgcttgccctggtcccacacactcaggcctgtgtggccagcgtggtcctcctttcccacagccaaggtgccccgactgccagcgtccactccccgtggggccgcagggtacaccaacatctgaggcagaggcaccgctgtgggctcatctctcagctcaaagggtttccaagagaatcctcagcaaaaaagcaacactcgccgttcagagagtgaatgagaggccagcagggggctgggaaggtgcttagctcagggagggctggagggtgggactaggaggcactaaaggcctgggggctcagagaaaggcccagcccatcccagcagaggccgaccaggactccagagcccgtggaggccctgccatgcacgggaagcctttcccgacttgggggcaggagctggagggctgggatgatcctaaggggatgctcggccataagccacatgccaagtccagagcccaacagctgctgtacctcctgggctgtttccacggatgaggcttctctgaatgtaagtttgtctgctcagccacaccggcctcctcctggcacatcgtctctcacaggcacctccttccatggagactgggggcctcagacggctcttcccgacagggccctgcacttgggcagatgcacctgtggcttgagctcagcacagcacatagtggctggcaaggaacggaaggagaattggagaaatgtatctaaaatgtcaagcagacctctgctacactcactgggaagaaccatgttgcttctgacgaatttcttaaaaagagagaaagatgccaatgagaaaaccagaggggacaaatgctacccgggaatgtaaaacagttgccatcagagactggctggctcacattgtgtccaccaatccacccaccacggcgagtgatgtccgtacagctcacaccgcatccatcaatccacccaccacggcgagtgatgtccgtacagctcacaccgcgtccatcagtccacccaccatggcgagtgatgtccgtacagctcacaccgcgtccatcagtccacccaccatggcgagtgatgtccgtacagctcacaccgcgtccatcagtccacccaccatggcgagtgatgtccgtacagctcacaccgcgtccatcagtccacccaccatggcgagtgatgtccgtacagctcacaccgcgtccatcagtccacccaccatggcgagtgatgtccgtacagctcacaccgcgtccatcagtccacccaccatggcgagtgatgtccgtacagctcacaccgcgtccatcagtccacccaccatggcgagtgatgtccgtacagctcacaccgcgtccatcagtccacccaccatggcgagtgatgtccgtatagctcacaccgcatccatcaatccacccaccacagcaagtgtctgcgatgtctgtagtgtctgcgatgtctgtagtatctgcaatgtccatgcagctctcaccatgtccatcaatccaccccaccacggtgagcgtctgcgatgtccgtgcaggggagagagacctggcctatcctcagcacagcccatgtgacgttagaaaggcaaccgcaaattcagctgcggagtgcaaaacgaatttcctcctgtcacacgctaactttctgttctggatttcctggggtttcctttattagacttgagtccagaactcctctagaaacattctctgggatatcttgacctggcacgcagaggggtgaaggaacggggacacggatggatggagggagatgaactaatcagcaaatgctccttgcacatttcctagctctgtcagccaaagtgaggtctgaccacaaaagctacccattcacttgctaaatggtgcaaaatgggcccagaccctcattttacctttacttaaataacagcatattctcgtctggtctttaaaccacacaggccaaaatgagttgagcactatcacatatttaattgactcgtaaaagcaacttgtttttcttcatccttcgccgacctttgtttatgggtaacccttgataacatgtgggcagggtttcagtgtaaacccgagggcaggttaaacacgctccctccaaagcttacttggctttgatttttcaaccacccgccctcatgtgcagggacagggcagagtcgtgaccaacagtggaaagacccatagctcccagctccagggacgacgcgggggtgctaagctggtaagctgggaaattcccgggcacgacccctggccgtgggtgaaagcacccccagccccacccccagctgtgagatgctgcaggttccccagccccacccccagctgtgagatgctgcaggttccccagccccacccccagctgtgagatgctgcaggttccccagccccacccccagctgtgagatgctgcaggtcccggcaggagaaggcttctccacagagaggccgctgaacaaggcacagggccaggtctggccgtgtaaaaatacttggaacccatggggggctttgtgtgtggtgtcatcggcagcttccattatgtccagcggtaacatgtttacggtccctgtgccgccgtgcggtagcagttttcccgagtgtctcctggctgggacggctggtgaggatgtgagttcaatagatgaacaccccaccttggtgacacagaggctggacagtcacaccgacccttggcccgggcgaggccacgtgtcccacaaaacataaggcttgggttagtgtcgggcacgcgggggaggtgcctgcctgcgtgaagactggtcacaagacaacttcccagtttagaaaatggttaactgattcattaatactcacttcctgtcgcaagagactcatgccctagagataaagccgtcggaggcagagtgcaggcctcgaagcagctggtcatgtccacgccctctgcaggcctcgtgtccccctcgctgtcgcctgccgatttggtggctcctctcataacacacagcctcctgtgtatgtttttaccctacaaacgctctctaaccggtccagaggtcagaaacagccgcagtctcctacctctattgcttctcaagggaaaagcacagcctggaatgatgaggagcccccacgccttctcagtctcctgtaacgacgttgctacagatgtatgtgtttgtgtgaagctgtatttaaatgtgagattattcttcttggttaatattttactttctgtcataaccagcaggcttaaagaagaaacccaaacgctctgtgaatgggacatgtgctcagaggcgtctgcagttgaggcgggtgacgttctggggtccctgggaagttgtcatcaccctgctgacatgagtgtggatgttgaggcctggagggtgacaggtcacacagccagagcctggcagcagcgcaggggcggaaccccgggtcccctgtgggcctgtgccctctcggccagccttgcaacgcgcagctaacgctcttcaagaaaacattctctggaggaatcctgctggtcctgaagtttttggccttgagaaggtcatcacagacacccctcccctcgggccaggcctgctgtcttgtctaaggggccctattttatctgaggtgatttgcaactctgaaacacacatacataaaatagaaataccgtcctcactattaacctagagacccccatccctacccctccctatgaatgctttttcataaacatgccgcattctgaggaatccgaaagactccagcgtaggacagaccgctgttccaagccactgggaaaggggaaactggtgactgagcggcgcccgtcagagccattaaaacgtgagggaaaactgcaccttacggcacacgaacccttagaagaggcaaaacactactgagttaatgcttaatttatttgtaatgataaaagtttttatcactttaaataaagttatttgaaaaaagttattcaatggcagcctaataattttgcttaatgaaaaattaactctgcaaatacagtttccactattcacatggagcctgcaggtttggagaatcctctgcatcagtgtgggtgagcacgtgtgtgaggggtgcacgtgtgtgaggggtgcacgtgtgtgaagggtgcacgtgtgtgaggggtgcatgtgtgtgaagagagcacgtgtgtgaggggtgcatcagtgtgggtgtgcacgtgtgtgaggggtgcacatgtatgaggggtgcacgtgtgtgaggggtgcacgtgtgtgaggggtgagcacgtgtgtgaggggagcacgtgtgtgaggggtgcacgtgtgtgaggggagcacgtgtgtgagggatgcacatgtgtgaggggtgcacgtgtgtgaggggtgcacgtgtgagaggggtgcacgtgtgtgaggggtgcatgtgtgtgggggtgcacgtgtgtgagggatgcatgtgtgtgaggagagcacgtgtgtgagggatgcatgtgtgtgaggagagcacgtgtgtgaggggtgcacgtgtgtgacagatgcatgtgtgtgaggagagcacgtgtgtgaggggtgcacgtgtgtgaggggtgcatgtgtgtgaggggtgcacgtgtgtgagggatgcacgtgtgtgaggggtgcatgtgtgtgaggagagcacgtgtgtgaggggtgcacgtgtgtgacagatgcatgtgtgtgaggagagcacgtgtgtgaggggtgcacgtgtgtgaggggagcacgtgtgtgaggggagcacgtctgtgaggggtgcatgcaatgctcctgtatgcacatctgtgggtgagcacgtgcgtgaggggtgcacatctgtgggtgagcacgtgcgtgaggggtgcacatctgtgggtgagcatgtgcgtgaggggtgcacatgtgtgaggggagcacgtgtgtgaggggtgcatgcaatgcttctgtatgcacatctgtgggtgagcacgtgtgtgaggggtgcacgtgtctgaggggtgcatgtgtgtgaggggtgcacgtgtgtgagggatgcacgtgtgtgaggggtgcatgtgtgtgaggggtgcacgtgtgtgagggatgcatgtgtgtgaggagagcacgtgtgtgagggatgcacgtgtgtgagagcacgtgtgtgaggagagcacgtgtgtgaggggtgcatgtgtgtgaggggtgcacgtgtgtgaggggtgcatgcaatgctcctgtatgcacatctgtgggtgagcacgtgtgtgaggggtgcacgtgtgtgaggggtgcatgcacacacacctgtaagcatgtgtgtgaggggtgcacgtgtgaggggtgcatgcacacgcacctgtgtgcacatgtggatgttgccgtgtgcacgtgtgcacaccaagtgtccgtgagtgcacgggaacagccgtttagaagtgccttaatcttcccgagcacaatagtagctcacctctgcaaggaggctgaaaattctcattatgagtctcataaatacgtggccacgttcatgggtttgtcttatttatcccttactctataataacttggaaggcacagccaatatttcccttatatcctgggacagccccagttcatggctcccgacgactgcagctgcctcctgggaaccccaggggggcaaactcaggcccacccccgcctgtgtgactcaaaccccccagccaagtgcctgtgggaggacattttagtgggtggggaagcttctgaaaaatcactttactctaactaatatttgtaattaacacatcaagtaaaactaaaagcttttgccttgccgttgttgccttttggtgggtgacctcaaaaagtcatccatctcacactgactctatcacatcccaactctagccccaaatcctaataaacacaccagttaagaatgcatggcacatttttacaagcctcacaactttctgattagatgcatagaaatgtcccaaatatttctgaaatattttatttgaaaaccgatgtcaccgccacttttaagccacaggcattacactaaaatctggactagcgtctaagcaagtggcagcttttgagctccgcacactccgtgtgaccatccacaaatctatgatgaattattaaccagaccaggctagcccactgcctggccttctctgctgaaagtcagcagctgtatcctgcctgaaaaacaccagcattcttgtgttcataaaacccgctggttccagtgcagctacccagagggaagccttgggtgtgggcagcgacaggggtgtgggtgccaccgtggggtcccccagaaggaaaccaggggagcacagaactaaatggtcacccatgacaatgaatcgtgatctggtgggaagaaatcaaagtgcttttatttggagatgaaattggctgcctgcccctccctctccaccccccgctttcctcctgacccacccaccccagctcttttccccggcctgggaagggcacatggagggcagaaagggcttccctaaagaaaacacagaaatacactttataaagcaaaataaacttaaaaaaaggcacttagcaaaaatgtagtgagaagtgttttttcctttccagtctttcattttcactcagcatttccataaacacattcttgggtccaaatgctgagaaactctttctctaaatactggaggagcgctaaatggagcaggaaatgatggagagagaaaggaatgccactgattccagacggatgggaccagctggggaattcaggaagcggtacggaggtcccggagacaactgctcacgcctctgaggggccgatcgctcaggatcccccagcagcagcgagagaaccagcagggcccccctcccctctccagccaggcgtcgatcagtgcccccctcccctctccagccaggcgtcgatcagggcccctccctctctccagccaggtgtcgatcaagtcctcaccttctctccagccaggcgtcgatcagggcccctccctctctccagccaggcgtcgatcaagtcccccccttctctccagccaggcgtcgatcagggccccccctccctctctccagccaggcgtcgatcagggccccccctccctctctccagccaggcgtcgatcagcgcccccctcccctctccagccaggcgtcgatcagggcccctccctctctccagccaggcgtcgatcaagtcccccccttctctccagccaggcgtcgatcagggcccctccctctctccagccaggcgtcgatcagggcccccctcccctctccagccaggcgtcgatcagggccctccctcctctctccagccaggcgtccatcagggcccctccctctctccagccaggcgtcgatcagggccccccctcctctctccagccagacgtcggtcagggcccctccctctctccagccaggcgtcgatcagggcccctccctctctccagccaggcgtcgatcagggcccccctcccctctccagccaggcgtcgatcagggcccccctcccctctccagccaggcgtcgatcagggccctccctcctctctccagccaggcgtcgatcagggcccctccctctctccagccaggcgtcgatcagggccccccctcctctctccagccagacgtcggtcagggcccctccctctctccagccaggcgtcgatcagggccctccctcctctctccagccagccaggcgtcgatcagggcccccctcccctctccagccaggcgtcgatcagggcccccctcccctctccagccaggcgtcgatcagggccctccctcctctctccagccaggcgtcgatcagggcccctccctctctccagccaggcgtcgatcagggccccccctcctctctccagccagacgtcggtcagggcccctccctctctccagccaggcgtcgatcagggccctccctcctctctccagccagacgtcggtcagggcccctccctctctccagccaggcatcaatgccgttcaaggggtctggaccaacaagccctggtggagaacaatccccacagagaaactccgtgtgaccctgccccacagataacacggaaagggacttttcatggtcagaacctactgatctagaagtgatcaaacactctcttctcctgacttcctgtcaccaggcacgggtgaggaggaacaccagcaatttcttactaattacggctcaagcaccaatgtttgtccaccgttttcttctcacacagatctaagaggatcaagatgattcccagagtaacatctgtctcatttgaattccagtgtgcttccccgagtggcacagccgagctagtcttgggctctggaacagtccaaagactggggactcccctgtaacatgcagccacctaagagaacaggtcagtgacaagtagggggaaaagctattaggaaaaagaacaagttgtgggcctaaaaacaagatgtttcttatacaaatacaaaatactagaaaattgcacagcagttgccagaaaagatcccaagttgtggaaagtagaaaggcaggtgcatcccagcactgcggccgggggcaggaggccacccgcggggcattcggacccccgtgccccaaacacatcccgccgagcctcctgggaccaggcccctgagagccacggggctgtctggagagtgtccccagcctcagccatgtggggtagaataaaaatgattaagaactgcttgagaagttttaaactgcatgcagcctactcagcacagattggcccgtgtcttctgccacggatctcggctaaaggaaaagccaacagaagcccaccggagcctcccttacctccacccaacactgcacatcaagccgtgcaaccctgccccaaacggtcccagggtcatgggtgtgcatacatgtgcatgtgtgcaagcatgtcacaagaggagacctccgaggaacataaggatgcggactcctccctcagcctgaacctctgtctctcaggcacagctcgacctttgaccttcggcttccccagagaaagactttgaacgcttcactcctctgtagccctgaggacgcgggcggccagaccagtccctgagtgcggcaccatggccgtgtgagtttatggcccattgcgctagccctgtacagtgaatgagatactagttgtttacagctgtgagcatacacaggccccccgccacacgctcaggaaggagcttctcggaatctctctcctgcctcgcaccatgcagccgggctagcaggtttgtgggccgagtgcaggagcctgctcccactgtcactgcaggtgactggctgaggggcacacagggcccagaggctcctacctccagccaccgcccctaaactaatgaagattccagtccgtggggcccaccgcaaatcccagaatctcagcagtcagtcttggacattagttgtcggggagggagaggatctgggaggccaggcgtcccttccaggctgcgcagccggccacggcggcagagcttccccaggctgctccagccttcagggcccctccgcggtcagccccacccccggccagcaaggcttcctgagaaggctgagcttggcacctacagactgggggggatctggaattccccagaaaagccctcatcccaaagcccatgggaaaaccagccctgttggagcatcccacccggacctcggaggagagtccggcatggccagtcccctgggctctgcatgcagatggttttcccagaaccggttcctcttcctgaatctctgctaatggccctgtccatcagtctgaccccagccttggaaacccccatgcagcctgggccagaatgaagtaggcaaccagaggctcagggtgcttggggccgaaccacccccagctccaccacctccttcctgcccccgagccgtgccttcccccgctgggtgggcttgctctgcatctgggagcacctgggcccgggggtgcaggtgggttcgcccctgcccattggagggaaatgttctgacatggaagcagagggcacagcattcaggagaaccagtggggcctccacacagggggacgcagctaggaagggggtctccggccggtcggccccgagtgagggacgcagctaggaagggggtctccggcaggtcggccccagccctgactccaggcctgtgcatctcactgctgcccaaagcaaggaccactggctgccatgacagctgccacagtgctgagcaggcccagccaacgctgcatgagaaagggctctaggaaggaaaaggccgcggcagcacccagcctcctttctgaggaagcgattccacgagccacaaaagcgcctgggctgtggtcatcagagtccaccacaagacaaccttcctgggtccctacaccctggacacaccttcggtgcgtgcccggcatggagacgctcctgctgccggcatggctttggggacagcactttgctcctggagcctcagaggaggggggccggaaacatgtgtcctgcacagtcaccaccggacgccgaggtggccgccccagcaggggccatgggctgaggctggtcctcaggctcccagagcaatggctgctctggggaagagaaaacacagaagtgacaagatcaaggcaaactagctgctccagcacctcgagggtttggaaccaaaacaagaaatctccagagctgaaaagaagagtgaaaccttttccttcagaaggaacacagctaaagagaagatttaggggtgcacgcaagggccctcaggtactctgtgcagcccctcaaagcagggaaaaggccaggaatgaaacctaacgcagaaatgggaactggctccaacgccacacgaacagccagcctgggtctatcgcgcccagttcagacccgggctgcagcttggagacgatgacgtccaaaaaccaagctccaggaagacacaacaacaatcacccttaggctttgtcaggcatcccagagaatcctccgtcctaccctgggcacgccatgcgcaccaggcagggagggtggctctcagcaaggggctgaggactctggcccatcctggggcgagggaggcacccacggggtgggccatgcggggctgggagccacggcccccatgcaggtcctaagtggacatctgtctggtcggtggtcagaaaaaggatccccacggtgtctaggaaagactcagacctcttaccaacctctggaattttatcctatgggcagtcagggccaagacagatgattctttacaggttggaaattattcggataacataaaagaaacaatgtaaagaggaaagaacaggtgcaggagtcgttcctcgatcaattccaggtcaaggcaccggtttcggtccccagtgcggctcctgtctcctgacccagccccccggcccagcccccagaagcccggcacggtgtctctcgggacccaggacacgcaggtcagcgctgcagccgttactggctgtgttgtgataccagcagggcactgactgtccccagaaggaacaaaactgagacttaaatttgggtgattgttccaaatgtgggattcaagcttatttgaaaacgaaaactaagaatgccaaatttcagggtggctagagctacagccccaggaatccagccctgtctgcagaaacacacctaatattttcagacactcatagaacaaggaactactatttttgagaaaatactcacagaaaaacaaaatctcccagacactctgatgccgtttgaccaataacccatggggaaactcacttccggggatccaggcccgacgagggcgttcccgggcacctcggtgactctgaaactcatatctacagcaaagcttgaacgtttgtaactgttcactttggactctgcgtcacacccagagagaccctgaaccatctgtcacaggtgacgtaaccctcagttccccttcacctgtgccagagcctcccagacacaaaggctggagccccaaaacctgtcaggggcctctcaggggccagccacaactcactccgcctgtcactgctggacgcccgctgcggcctgacggagccgctccttcacctgtccacatgcatttcccacacagcacattgtcttgaatgaaggcaagttattttctttctcggccttggcgtcctccacagccgacactgttcttgcaatctgtgaagggatgatttctaagctccgcctttgttcttcactcactcacccaccgtatacatagttgcacattgatgcataatagacatatacttgctgctacggaaggccttgtattcctgtctctcttcctaccacagcactcctgccatcccacaggtaatccaattagcaggctgtgtgggtcttatccctgatctgcgcacactcatctgatctgtgtttatcattcttctagggggtggtgttgggcgctctcattttgcttcttttgaatcttatgccgtggaacttcctgcgagtcatgtggtttggcctgggcttaatatgttccttgaaagccacagagcagcccacatgtggatgcacatgacataatcaccgtttcagttggcgattactcattgggctgttcttgcattgctataaagaaacacctgagactgggtaattcaaaataaacgaggtttattggtcacggtgctgcaagccgtacaggaagtatggaggcatctgcttctggggaggcctcgggaagcttccagtcatggcagaaggtgaagggggagcaggtgtctcacacggcgagagcgggggcaagagcgcgaggtgggaggtgtgccaccggatctcacgagaactcactcactatcgtgagaacagcaccaaggggatagcgctgagctgttcatataaatccaccctcaagatccagtcgcttcccaccaggccccacttccaacgacggggtgacagttcgacaggagattggtggggagaccccaactcctcaacattgcttctactgtttgctatttgctcactcagccactggccacaggtgctgctgcagtagacacgtctgttcatcgccttcacctatggttcaaagctagaagctctggttgcacggcaagcccctcctttcctgcgtgaacacagacccctgctctgacccgcggctgcgtaagacgagacgcgctcagtgagctgcctccccgacccccaccacagttccacaacggctgtccaacctcgcaccctccagaggtaccggcacctgctgcccaacctcgcaccctccagaggtaccggcacctgctgcccaacctcgcaccctccagaggtaccggcacctgctgcccaacctcgcaccctccagaggtaccggcacctgctgcccaacctcgcaccctccagaggtaccggcacctgctgcccaacctcgcaccctccagaggtaccggcacctgctgtccaacctcgcaccctccagaggtaccggcacctgctgtccaacctcgcaccctccagaggtaccggcacctgctgtccaacctcgcaccctccagaggtaccggcacctgctgtccaacctcgcaccctccagaggtaccggcacctgcggggcatgacaccacatccccacgggaccccgtgtggccccttctgtcaacccatcggccagaggcccatccacacgtcccactggcccctccagctaacttatctgggcccctcaaaggccaggccgtgcatctcataacaccagcccaacccaaatgattccttcccttcctgagacctcactctctcttcaggggcaagttcaaagctacccctcccagaccccctccaagatgacagccaaaaccaaagccacctctctcttcaggagcaagttgaaagccatccctcccagacacccagatgacagccaaaaccaaaaacaaaagccacctctccagagtgtgagctctcccggatctcaacaccctcctacttattaaagtgtagctctttttcaaattatatatttgcttacatagaagtccagttcattacagacgaacagatagcttcaaattctgctagaataatacctcccatctatgaagatctgagcgggggaagtgcctggtgcatctaagtcccattaatctctgcaaaagaaggccttggcctccactttcacaaaccaagaaaccaaggcagagagaggttaggggtcatctaaaatcaaagaattgtcaagaaacgtggccagcacgcagtctcgggtgtctgattccaagtgggttcgctacgtccacgtctcccccgagggcccccaggagctctcctcctcaccaagcccctcccaccatcgctcagcagccttcactttcaaaaccttagcagccatcactttgcttgtggctgtttccagccaatacgtccacctcctttctaaacacacacacgtctatgtttaaaacatgacgcgccacctgcaaacacggtgccacagcctcagggagacgccgctcatccactctgcgcctgcgcggttcacacgctccttagctccaaatgcctcatttgcttccattagctccaaagaagcaagtcaaagtgttttccaccaatgccagattcccttccaggaatgacgcccccagggctgcctccggggtccacactctgcccaccagtccagcaccctggctgagtccacctgccaggcaccatttgctcacacacctgaaggctggatgggtggctgtggccctgcttaaaggatcacctctgcatctccaaactgtcttcccagcacaccctgtgtcttgggcctcccaggccactgtccacccacacagaccagcagccccttccttccttccctgcctgaacactgcctgcctcgtgtccctaaggtcaccaacaagtctctctgttctccagccctccatgattccccccattccaatccaagatcacagagaagaaacagctctccaaactgacaggcaggctgcagtggtgagcacctgtgtcccagctactcaggaagttgaagcaggaagatcccttgagtcctggagttggagagttggagaccagcctgggcaacacagtgaggcccagtctcaaagaaaaaaaaattaatggacaatactaagtggtgaggagaagaactcggatcccaggagcccgtggagctggggtgcttgggcccagataaatccgtgggtctccctttctccacctcagtgccgtggagtttccagagtttagataaaatgagataatacatggaaacgacgcccttagcatctgcatccagcctccacacccacacacgcacaagaaacccactcccctttccaggcaaggcccgggccccaggctgaacctgcccctgccggagcccctgctgtttcccaggtgcagccaggccctgcaccttcgtcctcaggggttaaaaatagcacaggcagcttagctgagctcggttaataaaatatccaagttaattttagcattaggggaatctaggatctctgatgccaaggcccatgtgtggccacacagcccctccttacactgtcagacagacacggggaaagccacggcgtggccagtatccctccctcaccttcacaaaacacttctcttacctgagtgagccctagccctctgaagacactgttgctactttctcttattaaacagaccatcacctaatttgatgcctgtaacagccctgtgaccagcggcctccacctcccgtgagggagtccatcaggctgagagtgtcagctgccacttctagcagagctgggcccggagcccttaccttctagcccaggagctggggccagggaggcacagtccaggggaccctccaggcaccccacttgtcattctccctattctcacccggtgccacctcctcctgcttcaggtgggattctgtttgtgatcaggagagggatagctggggctggaggccggcagcccctggccctcactgccccacaggcctgcaggcaccagcggttcaatgttgggccagaccggccgtgggtcttcttcacggacaagctccagcctcacaggaagggagcaagagcccagcggagccacaggcactgagcccagaggagaaagaagggagcgaccagagagccacaggaagccccagcggggagcccacggcaggcccggcctcccacggacggcattcccggacgctgaccgcctccagctcgacggcagggtcaccgcggtgcgagagcctttcccgccctggaccgcggggctggctttttttttttctgtaacagattgagagaaacaccttgtgtgttgctctttattgaacacatgtatcaagataaggcgccacatttaaaaacaagcagtaagtattgtggaaacggaagacatcactgcgaggggaggaggcactgcacgccttgggggcgggggccccaaaacaacgccgtggccgtggcggaagtgccctccctgtgggtccctgactcatggaaagtccgaagcacaggcttcctcaaagcagcgatcgcataggaagtgtggctcagtcatgcatgatacacagactctactgtgaaaggttaatgactgtttcaaaagacacagtgtttaagatgtttaagtgcacagaaggacatatccaaaatgattccacaaaactgaaatgcagaaagccagattcttcaagacaaagactccaaattgttaccaccaaagcacctcacttctacgtggcgctctcctcttattacctcacctgcaagagctggaaggacaaagaaagaggaagggggaaaggaggaagagattctttccatttttcccaatgtcaacgtctgaatgaggccacacaccaccacacatttcaaagctatttaagaatttaaatggccaatgcccctataccttaaaaaaagctcccaatccccccagaaatgtgctggctttttttcttagtaagagtagtagcagaattgcttatggtataactttagggacaattcttgttctgggagtgagggggcagggtgttaacttaaccctgaacaacactgccttgtacgttcccaccggatgtagtagacaataattgcctggcttttgcaaacggaaaaatgaggttatgaaggggaagacacgggccctgggtcatgcagcaagtcactggcagactcatgggcaaatccagcgctcctggagacaaggctcagaggtgaatgacagcgaggggccctcaaatcaaccacaggggcaccatcttgtctgagccttcaagaccagggactcaggcagggcaagtcagagccaaggttggccatgaatgtggattaaagaaagagcctgaggggctcagtggccccctggcaccagcgccgctcagggtcatcctccacttcgcttctacagatgggctttctgctggagccccggggtatcaggccagcagcacagttacatgagactaaccccaaaccagcgcacccacaggtcaccctcagggtctccagcccagactgcatctctgctcaaatgcaggaggtgccctgtctccccagctacttggggcacagatacccctcaggcagccagccctgcaggtgacctctggaggggagaggaaacggggacttcttgctggagccacatccagagagtcgggcagctggcatttgggcctctctacccgtcctcactgctgctgcccctgggagggtcaaaggttcagatgatatccaggccccacgtgggattagcagcctaagcctcagctgagccagggtttcactggcttgtttaaagtggagcacagagcctgaccaagttgtggcatctccaaacctccttctctccgagggatcctccagggtgcctgacccccacgcctgtcggaagtggggccgagtgcccgcaggccggtgaagctgccttctgggagactcagggtctgagtatctggtctgagactctggtcttccctcgccctcctgttctacttcccatgccttctgtaaagtcctgccgtggcctgaagtgtagcccttcctggagtacacagcgagcatgctgtgccggctgtgggccccccacccccgagccgcaaagccccaggccgcctctgcctgctgcctggagacctggcactgccccacaggggcacccacctccagccctcctgcccccgtgactgaggaagcccagtgcttctcacactcctcagactcgctggctgagccaagcagccttggctgaaggaaagagcagcaaactgacccccacgggccgcgacctttccccacccaggcaaggcgacctcaggcacttcagggagcgccagctctggctttcttgtatgaaagtgacagcggatttaaaccacattaacaaaagaaatccctcctctctggactactcaaagcggaagtgctgccacatcctagctgcagcgcttctgggccaaatatcaagacagtgtctcagcgatgatccgcaaaccaaaataaagccgacaggaaacagcccgctggtttaggggagctggaatgcctccggcagcatcaaatgtcatcaacaactgacactcagcccgttcccggaggcctcttcacacgggaagaggccggctgcgaagtgcggctcagtgggggagaaggaccgtggggaccgcgacactgcaggccctggaagcctctccagcctgaaccgcgctgtggtccagcacactcatggcatgaatatggaacagtcactccaggaaacggtcttgctctgggggagggggaggacttccacatcactctcccaagataaaacaaccagggaaaagcagatccctccagataaaccagaagtccagacacagcctcctctccggaaacgcctccgggagcccacttcagaagctgctgaagcccagagaaaaaccgcagcctcgcaggccctggtcgccaccagctcgcccgccacttctcagtggaaagggacgtggtgccgatgggtccggggtctccccgccccgcgggagccctcagccagaacgccccaccagcacacacgcacacatgcacacacacaaacgcgcgcacacacacgcgcccacacacaaatacacacgcgcgcacacatgcatccacacacaaatacgcacccacacatgcacccacaaacgcacgcgcacacacaccgcccacacatggacacacaaacacaagcacacacaaacacgcgcgcacgcaggcacagacgcgcgcgcacagcagcagcagcgcgccggggcctcacgcccctggggagaagcgtgaaggagcctccacattccccggaaaggaagtttctgggcgcagcggagaaagggagatgccgagaccccgacgtcagtggatttgacacctgaagtgcaggcgcccagacagcctcaggcgcgcgcactcctgcaaacacgcggggcacacgctcgggcgcacacgcggacagacgtccctcggcgcagggaccccacctcctccgccgctaccagggaccggggccgctccgggcgcagaggaggcgcagggagccgcgttaccccggagccgactcgacccagcccgaggcccggggaggcggggaggtggggaggggccgcggagccggaccagccgttctccggggagcgcgccgcgcctggagggcgtctccgccggggtccccagcaaggatctgcggaggggaggcgggcgcgggagaggacagggtcgggccggggggtcggacgcgtggctgccggcggacactcaccgatcttgatcttcacgctctggaagacccggagcccctcgtcctccaccgccatgctgcgcgtccgcgcccgccgagcctcgccccaagcgcgcgccgagcccgggcagctcaggccgagcaggaggagcggcggcgccggagccccgagcgcggccgagggtccgcccgcctgcaagaccgcca

SEQ ID NO: 596 - DNA, 85623 bp, Homo sapiens
tgggttagttcctgttaggccccggccgggggagtaggttgaagtctcctaagatgcccggtgggctggggcaccgggagctgtgaagggaacgtgagggggcggcgtagtggagacccacggcaggcctgaagaagagcggcggccgagcccgccttccctgcaccatgctcatagaggatgtggatgccctcaagtcctggctggccaagttactggagccgatgtgagtgagccgggctgggccggggccggcgaacgtgggcgttgggggctcgcgggggcgtgggggaggggaggtggcgtggggggcggcgctgaggggccgcggccgggaggtcccggcgacgccttccctgtagtactatcaccattgtggtgggggtgagggtgggagaggagcgctggggacggagaggcgccgtgaatatggggactgggggggcaggcaaggacagcgaaggcttttcaaacgcaaatatcggggtgctggaaggggtagcaggggccgtgagggaatttaaaacattgctgtttgagaactgagagagaggtaacggggctcttgagggatttttaaaatgtgaatattgagatgtcgaagggaatagcagaatatcaagggtttgataaacattattattccgggactgaaaggtctagaagcaaaatatcgagggcattttcgaaatatgagggcagaagcggatagcagggacattgaaactgtatagcgattattggtaagttctgagggatcaagaatattgaaggatttgaaaaatactatggagtagatgaaaaggatgtgtgggcattgaagggttttagaaattattggggaggtgataagtgtgatagcaaggatattaagggattttaaagtattattgagggcttgatagtgctaggggaactgatgacttttagatacatagaggttggaaaaaagaggtttctgtaagtttagttgaaggttgaaagggctacactggtatgcagcattaattggtggaggagtatacctaacagtatgtagggatttttagatacaggtggtgttggaggaataaaaggagcggtagaaagaataagagatttgtaagtattcttgtgccattgagaggacagttttgtaaatgtttttgtaagattgagaggacacctgaagataattggggtgtagtatgagggaccgaaaagaatgagagacctgtcttttaaaaatattttgggtggtgttagtagaaatgttattgggaggcttgaaagaggtaacagatgtatcaacattttgttttataaccttttttttttgaaacaatgtctcgctgtgtctcccaggctggagtgcagtggctggatttcggctcactgcaacctccgcctcccgggttcaagcgattctcctgcctcagcctcccgagtagctggaactaccggcgcgcgccaccacgcccagctaatttttgtatttttagtagagatggggtttcgccttgttggcgaggctggtctcgaactcctgacttcaggtgatccgctcgccttggcctcccaaagtgctgggattacaggcgtgcgccactggacccggccatgtttgataaccattttaaagggtagagttgtggagtgcttatttgggggaatggggtatggctagttactggaagggaaagaatcatgttttgcctcctccttgcttctgctttattattctcttattgaaggttagagctttctgcttgaaagaaaggggtagaagaagagatgggcaggctttgattcattaggtcagattgcattagtggaaaatttgagtgtttttcggaggtgaaaatagggagtagtttgggaggtgtggaggcatggtaaaggaacttctgggggacagtgtcaagctacttccctgttgatctctttcagtgaaaatgactgaacacacttgaaggttttgtagaagaatataggtctcttgaataggggtttttttaactcctacaataaagttttgggcacaaagatggaaatggtttgtggtgaaggtgggaaataagatggatgtaatgaaattgaccatatatgggaaaaggttgaaaaaagaaaaatatctgtatgtttaaagtattcttcatgtggctgggcacggtggttcacgcctgtaatcccgacactttggggggcctaggcgggcggatcatgaggtcaggagttcaagaccagcctggccaatatggtgaaaccccgtctctactgaaagtataaaaattaaccggctgtggtggggcgtgcttgtagtcccaactactcgggaggctgaggcagaagaatcgcttgaatcccaggaagtgtaggtttcagtgagcctagatcaggccactgctctccagcctgggcaacagagccagactccgtctcaacaaaataaaaataaaaaaagtgttattcatgttatttaagattaaaaaagaaaaaatacatctctttattttgtatttctgctgctctgatgcctttagaaaaaacaacctactttccagacaagtttagttttgttggtagctatccttttaagaagaattaaacatacattttatgtcttggatagaaggtaacaacttttagccttatagttacttgctttttcttttttttaaagctccctaagatgttttactctgagtagtgcttttcgttttttgtttttttttttttccccttaatgttgaaggttagtctgggtgggagcttcttcttgcttaggcttttttttttttccttcttttttttaaagctacttagactcataagtatgatcattctgtaattttcatgagtaaaaattatctttcaaaatgattacttgagtttagtttctccttttgagttatatattcaacttaaagttcacatgcttattttttttaattttgttgctcatttagggtaaaaaaaaaaaggctaaaatactttatttgtttgtttatttatttattgagatggagtttcgctcttgttgtccaggctggaatgtggtggtgcaatctcaggtcactgaaacctctgcctcctgggttcaagcgattctcctgccccagcatcacgagtagctgggattacaggcacttgccaccatgcccggctaattttttgtatttttagtagagacgggggtgtcactgtgttggccaggttggtctccagttcttgacctcaggtgatccacccacctcggcctcccaaagtgctgggattacaggcataagcctttgtgcctggtctagaatacttatttttaactcacctaagtaacagttttgaatggagatattaataataaaaaagtaaatgcagataccacatatatttttattcttagtatgtcatcatgggagattattttttgtttgtttagatatcctaaaatgtaataaatgatatgctaaagtgggttgtgtttgtaaatttacttttttgcatattccagattcaagaaaattttcatggcagattggcatgttgctacaacatagcatttcagagcagttgctaggctttgagatagtatagttgcaccggctaggttggaatcaaactatgactgtgcacatgattttctttctttttctttctttttttgaggtggaatctctcactgttgcccaggctggagtgcagtggcactcactgcaacctctgcctcctgggttcaagcgattctcctgctttagcctcccgagtagctgggattacaggcgcccgccaccatgcccggctaattttttgtattttttagtagagagggggtttcactttgttggccaggctggtcttgaactcctgaccttgtgatccacctgcttggccttccaaagtgctgggattacaggcatgagccactgcgcccagcctgtgtgcacatgattttctattacattttcttatttagcttagtttacagtaaattaaatttatgaaagcttccaattcccgggggatttttaaaatgttacatcttgtccctagtgaaacatatgcatgtaacgggagatatttcttttttttttttttttttgagacagggtctctgtcgcccaggctggagtgcagtggcacgatcttggctcactgcaacctccgtcttcggggttcaagcgattctcctgcctcagcctcccaagtagctgggattacaggcgtgtgccaccatgcctggctaatttttgtatttttggtagagatggggtttcaccgtgttggtcaggctggtcttgaactcctgacctcaggtgatccgcctcccaaagtgctgggattacaggcatgagccaccacacctggcctaacaggtttttttttttttttttttttttaagacggagtcttgctctgttgcccaggctggagtgcagtggcgtgatcttggctcactgcaacttctgcctcccgggttcaagcaattctcctgcctcagcctcctgagtagctgggattacaggtgcccgccactacgcccagctaatttttgtatttttagtagagatggagtttcaccacgttggtcaggctggtctcaaacccctgacctcgtgatccacctgcctcggcctccaaagtgctgggattacaggcgtgagccactgcgcccggccaacaggaggtatttctaaaccaatctagtttacagttgattattccctatggacaagttaggaatgtcatgggctattagagcttatctgttaccttccattccctttgtaggtggcgaacatgtctattacttttattagaggaaggacaggagggagacaggaagaaatgactccttaactggctggaatagactagtaccaccatttttgttggcaatgcagtaaaagggagggaaaccaatatctcagtcgagaagtttgtctctttccctacagctgcatgaatagactagactcagttcttgtttggggacttcatctttcctcagtttcaaaatatcctggatatcctagtcatagagactgtagggattatgcacaatttagagatgtcatggtttctttctgtcagaaataactgctcattgtaagaatgtgaacccctttaaagtaaggttctgctaaattcaggaaataagtgcatcactaaagaaatttctgcaagtttaaaaaaagatcaggcaagcatttttcagtaacctgcatttctatcaaaacatgttgtatttaatggggaatgttttatttatattatataaaatgtataaatatgtattattcactgctgcttgtttggcttagtgtaaaactttctcttggtgtgtgttttaaaaagcatggtgggatttgtaaactctggacaatttgtctgtcttactttaatagacattgttgtgtgaatcggcatttaatttctagttccgtatctatctctaattcactctgtgacttaggataagttgtctaacctttttctattaaacagaactaaattttatttgccttttacctacgtcaccaagtctgttatgagtattaatgatgtagactttaagtggtttgtgtacctctgaatcattctataaatgtaaacaacattttatggtttttggaatatgaaaatacatgaaactttctgcaaaagtattttgcttattaatgttaaacaccactgccacttaaaaaataataatcagtctattacaagacagactagagtctcattgcaggtcctataggtaggaacaggaattgctagtcaaagtcatagacttgatgtgcagtttttgtgatttctggccatatcagtgtcttttaaagtgccctaggagattgaatatgttgtcagcttggagagtgatagaaaaggcagcaataaggttaatagactaagtttattttattggttcatatttatgggttcagtgatcatgatgcatatactttggttgaactctagagtttacatgttgctgtatgttggcagtccttatcaaattgaactctggatagtaatctctgcagttgcccaaatgggaggaaaaataattatctagcaatttttggagctgaccacctggtaaataaactaccagcgttaaataagtattttggaggtatattcttaagtttgggaagtactggtaattttcgaagtgtacttagttgcttcagagaattagtgtgtctctaaagtgctgtgggacttaaggataccattcactatttcatagaaaagaactttggccagaagacttcttggcaagttttagtctactaacttaagaacatatttgttcttatgtcctttggtctgccttttaaagatgtctgacttcatccttcctggcccaataactataggctaaagccagaagttgcctttttagccctgtgtttcttgccactgtcttctcttatcctcttacagtgttgctacttacttccttattaatctctttttatacaatgtattattttgtactgtaattatttgttttcgtatccacctcttggccatgggcgtgcagggcaaggtctgttttgtttaaagtaattccattaccaagcaatatgcttggcacttagtaaacactcagtatatgtttaaatgaatgaacattctcatatgtatatacaggtaattgacaattagaaaagtaagaattttttagtagtctaattttgtgcatgtatttagctagtggctactatactaggagctatggtccaaatatccaaatggtatttgcaactgatgaatgtatgtatatattttcctcccaaataaatctagggttatttcttccacatgatactcattcatgaaagcccctaattacttaaggggaagatgaaagtactatggtctgaatgttggtgtcccctcaaaattcatgttggacatctcaaaaaaaaaaatatgtgaaaggagcctgcttgttaccatgagaggacacagaaggtaccatctgtgaagaatgggccctcactagactccaagtttgctgatgctttaatcttgaacttcccagcctgcagaactgtgagcaatacatttctgtttatagccgggcacggtggctcatgcctgtaatcccagcactttgggaggctgaggcgggcagatcacgaggtggggagatggagaccatcctggctaacacagtgaaaccccgtttctactaaaaatataaaaaattagccgggcgtggtggcgggcgcctgtagtcccagctactcaggtggctgaggcaggagaatgacgtgaacctgggaggcggaggttgcagtgagccgagattgcgccaccgcactccagcctgggcggcagagcgagactccgtctcaaaaaaaaaaaaaagaaaaattctgtttataaattgcctagttggctgggcattgtgggctcatgcctgtcatcccagcactttaggaggctgaggtgggtggagcacttgagtccaggagttcgagaccagcctggacaatggggcgaaactctgcctctacaaaaaaataaaaaaaatagccttagtcaggcatggtggttcacacctgtcgtcctacctacttgagaggctgaggtgggaggatcacttgagcctgggaggttgaggctgcagtgagctatgatcaagccactgtactccagcctgggcaacagaatgagaccctgtctcaaaaaataaataaatactaaattgcctagtctaaggtattttgttatagtagcccaaacagactaagagagaaagttttcatttgaaaaaaagtagaagtaccaatatatgtgtatctttaataaatattaacaaatgtgaaagtcaactccatttttacttactttgtccagtatggtcttatcttttttttttttttttttttttttttttttactttgagaggagtttcgctcttgttgccgaggctggagtgcaatggcatgatctcggctcaccacaacctccgcctcctgggttcaagctattatcctgcctcagcctcctgagtagctgggattacgggcatgtgccaccacacctggctaattttgtatttttggtagagacaaggttgctccatgttggtcaggctggtctcgaactcctgacctcaggtaatccgcccctgggattacaggtgtgagccgtcaggcctggcccagtatggtcttaccaaagggataatctgaacacagatctcagagtcagactttttttaaaattcactttcattcttttaaaataaaaataagcgtattattgcattatgacagtatagaaagtagagaaaagaaaattattagtatttattttgtttttcttatgtgtatgaatttttatatagctacagtcagactcattgtaaaattctgatttctttgacattacatcagaagcatttttcacatttatatattgcttttataaccatcactttggtttttttggtttttattgttcccgccacccccgagatggagtcttgctctgtcacccaggctggagtgcagtggcgcaatctcgactcactgcagcctccgcctcccgggttcaagtgattctcctgtgtcagcctcccaagtaactgggattacaggcacgcgccaccacgcctggctaatttttgtattcttagtagagatgggctttcaccatgttggccaggctggtcttgaactcttgaccttgtgatccacccgccttggcctcccaaagtgctgggattacaggcgtgagccaccccgcccggcccttgttttttattaagacagggttttgctctgtcacccaggctggagtgcagtggcatggtcatagctcactgtagcctcaaccttccaggatcagacaatcctcccacttcagcctcctgagtagctgggactataggtgcatgccaccacaccaggctaatttttttattttatttttttagagatggaggtctcactatgttgcccagactggtcttgaattcctgagctgaagcaatcctcccacctcagcctcctgaagtgctgggattacaggcatgagccactgtgcctggccataaccataattttttaaaaaacatttgtttattgtattatattgtattatagtatattacatatatattttttgagatggagtcttgctttattgcccaggctggagtgcagtggcgtgatctcagttcactgcaacctccgtctcctggatggattcaagcgattctcctgcctcagcctcctgaatacctgggattacaagcacccactaccgtgcccagctaataaccatcactttggatgcctaatatttcacaaacatccaacaataagagaatggttaccttggcactatttttttgttaaaaattaatgctgtttttatttaataaatatattttgtgtgtgtatagctttaggtactagtaatattttctatatatgcctttatttccttcgtctagtttatcataagtgtaactactggtcagagaatatggattttttttgttgttgttgttgttgatatggagttttgctcttgttgcccaggctggagtgcaatggcgtgatcttggctcactgcaaccaccgcctcccgggttcaagcaattctcctgcctcagcctcccgagtagctgggataacaggcatgcaccaccatgcccagctaattttgtatttttagtagagatggggtttctccatgttggtcaggctggtctcaaactcctgacctcaggtgatccacccttggcctcccaaagtgttgggattacagacgtgagccaccacgcccagccaagagtgtggatattttaatggctgttgatacacattgagatcaggagattttttttttttaagctgtggctcagaagcacatgtattagttgtttcacctctgaaagaaagagcacattaagatggaacttaaaattagatccatattcagaaacatgtaaatttttctgcaagtgggaaaggtctaagtagtcttggcttttttcctaaagcaagtaaatggtaatggtttttcagtagtgttttttggcttggggccaaaggtgtaggaccttactctttgatcttatgattgcatgtctgaaattttctatgaagcttatgtactggctcagcagttgtgtaatatacgtgcaatagagatttcattaaaaggggaaaaagataaatttgagatttttacagatgaggtatttttagggcaatgtttctattagcttactccgataaaaatttgttgacttttattttttaaataacttaaaacataattgaagcatgttcttaaaacgttattgtgcaaggtgtgaattttaaggagtcctatttgtaagttacattaagctttaggaaatttcttttgttgattctttaaaaggtaactgttggttgatacttaagatacattaatttttcctgcagatgtacattagaaaaagacatggttgtgaaacagattttacttgtgtggaattgcagctgagttttagttccacagatgtgctgtctgcctgatcttaaatcgatctcttaatttatctttacaaatttacaaatctatagtagaatggtaatttaagatggatattattaccttttctaatctccatgttataataaaagtccctttttgtctagagacatgtgtattttgcatagtcatggatcccaaattttacaatctctttcatccccaaatatgcttgtttttatagtcaagcagtaatggattcccataagctttagttgcaaataaagtggctaaaagattttaagtactcttcctgagtatgagaagaaagaagtgatgatttttcaggagagggaagtgatgctgcacttgtcttatattctcaagagtcttagttgtactcagatttttgtgacatacttctggaagtcttgttgagtagttagcattgatactgtagctacagtatcatggctgttttttagagattatatagtgaggggtcaatgggtgaaagaataagaataattgtaaaagtctagaaaattacagcacaaaacttcccaatgtatttaagtttcaccattcaattagtgtgaattattcaattagtctattattttagacttataattttcttcagagcgtactttatggatacatgttaggagctgttaaatgtaaatggtcctattcctttggctgtaaacatgctgttgtatttggtgcagatttctgtcagttattaacaatcatttgttccctcacattaaacaaatgtttagaatctgtgatcattctcttctcctggagtctaaccttttctactcttttactttcctgtatattcatcttgatttttagcactatcatatcaaaatgtgtttcatcagaagcagcctaacttggcatatggtttttagagtctgtatgctaaatatatgtaaaagatatctgggtttcttttctttttttttgagactgagtcgcgctctatcgcccaggctggagtgcactggcgtgatctcggcttgctgcaacctctgcctcccaggctcaagcagttctcctgcctcagccacccaagtagctgggattacaggtgcatgccacaacacctggctaatttctgtatttttagtagacatggggtttcaccatgttggccaggctgatcttgatctgctgacctcaggtgatcctcctgcctcagcctcccaaactgctgggattacaggcatgagccactgcacccagccgatatctgggtttcttaaacccatttcagttatccaatatctgaatgttttgcccattcctaacatatagaaactttattatccatacccagcactaaatctatcagatcattagactccttgaaggttcctataacgtcagagaaaataacattgccattttcttccattcttatttatttttctaagtccttttcttctgtgttagactacccttatccaagaactaaactttttaagtaaaggtggaaatgtaatttttttccccttctctcctccatatgaatgtagactagaactacactgataaaaattttctcattattctcaggggtgaaattaagttggcctacacatctgttttttaaggtgtttatagaatagccagggtaagcatggcatgtgtaatttttttttttttgagactgtctctctctgtcacccaggctggagtgcagtggtgtgatcttggctcactgcaacctctgcctcccgggttcaagtgattctcctgcctcagtctcccaagtagctgggattacaggtgcacaccaccacgcctggctaatttttgtatttttagtagagacgggatttcaccatttgggtcaggctggtcttgaactcctgacctcgtgatcctcctgcctcgacctcccaagtgctgggattgcaggcgtgagccaccgcgcccagctggcatgtgtaatttttattttattttattgagacagtcttgctctgttgcccatgctggagtgcagtggcacaatctcggctcactgcaaactccacctcttgggctcatgtgattctcccacctcagcctcctgggtagctgggaccacaggtgcatgccaccacacctggttaattttttgtagaagcaggttttcaccatggtctaaaacttctggactcaagcgattccccacactttggcctcccacaggtgtgagccaccacacccaaccataatattttttgaagatagaaaggctacatattcactattttggtttttaatttaaaattttattaataaaaattgtatgtatttaaggtgtgatgttttgatatatatgcacatgctgaaatgtgcatatatatcaaaagctagttaacataatcatctcatatagctgtctttttttgtgtggtgagaacacttaagatctactctcttagcaaattcaagtttacaatatatttatcaattttagaatttaacagttggccttactaaggttatctgttcataattctccaaaatgtaacattttttacttaagaaaaatctttactttcttttattttttattttttgagacagggtctcactgtgtatcccaggctggagggtagtggtgtggtcatggctcactgcagccttgacctcctaggctcaggcaatgctcctgtctcagcttccttagtagctgggagtacaggtgtgcgccaccatgcctggctaatttttatattatttgtagagaccggatctcgctatattgcccaagctgctcttgaacttctaggcttaagcagccagccttggcctcccaaagtgttgggattataggcatgagccaccaggcccagccttgagtgactctctgtctatttatttatttggagatggagtctcgctctgttgcccaggctggagtgcagtggtgcgatctcagctcactgcaacctctgcctcccgggttcaagcgattctcctgcctcagcctctggagtagatgggactacaggtgccagccaccttgcctggctaatttttgtatttttagtagagacggggtttcgtcatgttgtccaggctggtcttgaactcctgacctcaggtgatccccccgccttggcctcccaaagtgctaggattacagatgtgagccaccgtgcccggccaggtgaatggatgtttaaagaaccagcctttcccatgacagtgttaatattgacaacaaaaaaagttgtgttactgaattacgaactttaagcataaaaactagaaggaagtaaaggtactggtgcttggtttttattttgtttactaatctcataaagttattggaaatgtgattgatactcttgagctgaagcctgtttttttttttttttttttttttttttggagacaaggtctcactctgttgcctaggctggactgcagtggcatgatcatggcttgctgcaacctccaactcctgggctcaaggtgtccttttgcctcagcctcccaagtgagctgaaaccttttaactttctggctgctagtgaaggcccaaggattatagaacaagattagttagatttgaatagtgttttataggttatataatcactttgcttgcataatggttttacttactgttattctgaattttttgtttgtttgtttgtttgttttttgtttctttgagacagggtctcactctgtcacccaggctggagtgcagtggtgtgatcggctgactgcaatttctgcctcccagcctcaagcatcctcccgcctcagcctcccgagtagctgggattacagacgtgcaccaccacacctggctaatttttgtattttctatagcaacagagttttgccattttgcccaggctggtcttgaactcctgggctcaaatgatcctcctgcctcagcctctcaggatgttgggattacaggcatgagccattgcacccagcctgaatgttttcattttaccttcataacctgactgtgaaggatatgtgttatttatgtattcatcaggaagcctagaatattttatatatgtgtgtgtatatatatatgtttacaacaagaaaactaaaagtttcatgtgatgtacataaaacctcgagtctgacagattactatacatcaggagttgacaacccaaggattatgagctgtcctggaataggagatgattttgagtatcagtgttggattacttactagaaaaaatgagaagtagataaaggttatctctgctgtcctttcaccacttctcttttcctttctgtttctaactcctagatcttttctttctttcttacagctgctaaagcatttgccaataatatttaaatgccattcttttcatgttcttattttttaaaaagatctttaagatactcgctgagattagcaaaagggctgatagccatttttagatactggtgcctagggagaggtgtcttgaggagaggagaaagtttttccatcacttcccttccttttgctcattaatcacctggaacagatagttcctgaaggtgttattgacagtgcttctatagctgggagccaaacagcaacttaggggtcagttgccactctttgcctgttatcattgagagaacaaataaatgtagagctcgcccaagatccttgatatatttagaacctcaaaaatagaagacatactagtcattttgtagaaataaatgcaaaaggaaaatctcgcagtatgtatatgtttattataaaagttgcctgtgtttgtggtcactttttagaatagagttttgatttctcgttttccaaaataagggtgacttcattaataacactactgtttgataaaaagtgttttttaaaatttttgttttctctttgtctaactagatgtgatgctgatccttcagccttagccaactatgttgtagcactggtcaagaaggacaaacctgagaaagaattaaaagccttttgtgctgatcaacttgatgtctttttacaaaaaggtaattattatgggccttcaatcgagtattgaagtaaagattttaagtttaaaacttcctgaaaagtcttggagatataagcttgataggaaagaaagtagtcagagtcctttgaatacttgaatatacccattcatacttaattatttatcatgttttgttagaactggttttttccctttccttctttgctgctttcctctattgaggcaatggcagctctaatgctttttagatgattaggtcttttgcagcttttgacagagcctacttgatgattgaggggtaacagtttaaggataatgaagatgcttattcttggtgttcattaagatgatgagctcatcagtttttttccccccttggatggggcttcttaatatccaagaagagatgtgtatgatcctcttctctttgtgcctttaacttttcatcttcttaccaaatctgtttccatggtctacagagcttcctaaggtttcccctgttgcctctctgaccttatctcctatcattgcccctcacttgttccactctagccacaacgaccacctgttttttgaattatggcaaacatgttcccaactcaggccctttgaactcattttacccttgcctgaaacatggattcttctctcgcttctttctggtctcttcaaatgtcatcttctgaaagcagtttcccctgagtgctctacatacagtgtagtatactccatgcctccatccactctcctccttccaaccctgttttgttttatttttcttttttatttatttatttttatatctatgtatttttatttttgtagtgttggggtctcactttgttgcccaggctgatccttgaacttcttgcctcaagcaactgccccaccttggcatcccaaagtgctgggattacaaggcatgagcccctgtgcctgactcctgttttgttgttttcatggcacttgtcaccacctgtcataggtttatttgcctggttatctgtctctctaccctttgtttgccttttgtttggttgagagtggagacttggaacctacagtacttggtacatggaagatgttcagtaaatattgttaaatgggccaggcgcggtggcttacgcctgtaatcccagcactttgggaggccgaagcgggtggatcatgaggtcaagagatcgagaccatcctggccaacacggtgaaaccccatctctactaaaaatacaaaattagctgggcgtggtggcgtgtgcctgtagtcccagctactcgggaggctgaggcaggagaatttcttgaacccaggaggcagaggttgcagtgagccaagatcgcgccactgcattccagaatgggcgactgagcgagagtccatctcaaaaaaaaaaaaaaaatatatatatatatatatatgtatgtatagttgaatggatgaataggaatgtgaataatacacatttatcagttgatttagctattggtgatgagaagatatcatttaaaataagtatttactgagaaggagaaaagtaagtatggcttctcaatctaaaacataggattacatattttttcctacattttacagctctttttgtagaaacaaagcaatactgacagaattttttcccagtacaacagctacttaaaaaattcctccccagtacagatgttttcttttctaaatgtgttaatttacattacttgatttacattaaagatgagtcttgtgaaatgtagagccatgacaaaagagaaagcaaaacatatttggggtaaaaggccaaatgaatgtttagacgtccaagaattctttgttataaaaagttagaaaggattggccaggcgcggtggctcatgcctgtaatcccagcactttgggaggccgaggcgggtggatcatgaggtcaggagattgagaccatcctggctaacagggtgaaaacccagtctttactaaaaaaacacaaaaaaattagccgggcatggtggtgggcgcctgtagtcccagctactcggcaggcctggacgacagagcaagactccatctcaaaaaaaaaaaaaagttagaaaggattttagtaattaaaaaaaaaattacataggtaatatatatgagaaggaactatacactacatttttaaaaggataagaaaataagtaaccataaatttgccaccagagataaaatcactgttatcagcttgtgtgtgtctttctagactagcactgtccaatagaactttgtgcatatggtctatatctgtactttccatttcagtagccattagccacatgtggcttttgagcacttgatatctggtaaataggccagagaaattgattttttttttgagacagagtttcgctcttgttgcccaggctggagtacagtggtgcaatctcagctcactgcaacctctacctgctgggctcaagcaattctcctgcctcagcctctcgagtagctggaattataggcatgtaccaccacacgtggctaatttttgtatttttagtagacagggtttcaccatgttggccaggctggtctcaaactcctggcctcaagtgatccacctgcctcggcctcccaaagtgctgggattacaggcgtgagccactgtgcctggccagaaattgatttttaaatttaattttaattaatttaaactcaaatttaaagagctacatatggctagtggctactatattggacagtgcaactgtagacttatgtctgtgtttatattgcatcttaaaatagtattaagtgaacatactcttttataataacattttaaaaatttaatagtgtaccttgaatattgtttttatttttatttatttttaatttttcccaaactctttggtttcccagagaatattgtttaatagtagatgtttatctttgctttttaaaaattgagctatgtgtctttcagattacaaaagaaaataacatgttataaattgttttaaataataattataagtgaaagtattctgattatagaggcttttgaagggtctgattattgtcttaagtttatatgtaatagtcaatgagagctaacagttttataatcgtggaaaaatgcttactacacaaattagtagtgtaaagaaatttataagaagatgcttttctgtagaaaagataacattttagaaatagcttttatgtaaaagatgtaatcattgcaatgtaagcagagtttgtgttgtgcttttaatatgctctttagctgttccttagggtaggaccaatcaaagttatttagatttggttttaataagacataggctggatgtggtggctcatgcctgtaatcccagcactttgggaggccgaggcaggcagatcacctgaggtcaggtgttcaagaccagcttggccaacatggtgaaaccctgtctctactaaaaatacaaaaattagctgggcgtggtggcacatgcctgtaatcccacctactcaggaggccgaggcaggagaatcacttgaacccaggaggtggaggttgctgtgagctgagatcgcaccactgcactccagcctgggcaacagagcaagattctgtctcaaaaacaaacaaacaaaaaaaagcagtataaatatttgacgttaatacttttactaaattcatctggttctcccattcagttgtctgaggaagtttcaaacagagcaccctttaagtaaaacacaaaaagttagtttcatgtcattttcatatcagtaaatatttaactgattaaaaaaaattttcggttaagttttttgagttggcagtgcctttaatccaacaatataaaggtataccatgaaagtctcttacctgttttatatccaccgcgttcccacctagagtacacaattttgtcagtttttatttttttcagtttctttatgcagatagatagaaacacatataaatacatactgttatatctttgagatcaggtattatcagtattctttctttttatagccgctgtgtactctgttgtatagatgtcccatagtttatttaactagtctcttattcatggaaatttgagttgtttccgatcgtttgctattatatcctccaacaaataatcttacatatatatcattttgcaagtaggtcagaaggatttaaaaacctgaaagtgggattctcttccataaggtaggactcatttttagtcctactagcagtgtacaagatgtcctgttttcctgagctttgctgacaatgtgttgtcaaatttttgttttttgtttgcgcaatatgtaaatgttatttcttctccttagaaacttcaggttttgtggacaaactatttgaaagtctctatactaagaactaccttccacttttggaaccagtaaagcctgagccaaaaccactagtccaagaaaaagaagaaattaaagaagaggtaatgcaaattttttctcctgcttttgggggcttcttagatcctgtcaccagtatccttagttggaagttgagccttttaaaagtaattgtgtattgattcaagtttccggattttaggcatggtacagattcttcatcaggatttcatagttgcttggactgaagagttgaaaagtttcagatagcttgtttagagatccaagaaatatttcagaaatattgaggaagtcagagaaatcttatctagtgacttttagaaaaagaaaacttggttaaatatagagagattgactgaaagtgaactgttaacaaatcctcaagagaaatcattaggtaacacattttcatgtatatggagaaaccagttgcactttttgattatatagagttttaaaaaatagttaatgtaattgtgaacatcactgtcaacattggaaagaggattttaaaaatgtttttataatattgaagtatgaaaacatggttatagatggtaacctaattgtttgaaccaagaaggaaattttacagagttctttgtacttcctgttatatacagacaatatagtatagaagaatgtggattctgtaatcaggttgcatgagttaaaataacagctctacaagttaacttctctgtctcactttgatatcagtaaaatgaggatcagagtagtacttattgaggattaagtgagattatgtatgtatgtgtgtatatatatatatagtttctagtccagtgcctggcacataaatgttggttatcatgcagaaatatttcccagtatttatttttattacatttattctgaaggtaaaatgaatttttaatttagaaataattttaaacaaataaaaattacaagaggctgggcatggtggctcatgcctgtaatcccagtactttgggaggcttaggtgggcggatcacctgaggtcagaagtttgagatcagcctggccaacatgggaaaccctgcctctactaaaaatacaaaatattagttgggcgtagtggcaggcatctgtaatcccagttacttgggaggctgaggcaggagaatcgcttgaacccgggcagtggaggttgcagtgagccgagatcatactgttgcactccagcctgggcaataagagcaaaactttgcctcagaaagaaaaaaaaaaattacgagaataatacccaaaacacccatatgacgtctatctagataaacttttcttttcgatggagttggagtctccttatgttgcccaggttggtctcgaactcccacctctgcctcccaaagctctggggttataggtggtctagatatacttactgaaaatttgccccatctgctctctttaaatatccatatgatttttttctcagtaatttgagtagtgagtcacatacttcatgtcttttcacccctaagtaaagtacttcagtgtgtatttcctacatataaggaatattctcttaggtaactatgatactgtgatcaagttcagtaaatttaacatccatatagtactttaatgtattatctgtgttcagttttatcaattgatcaagcaatgtcctttttttatttccttttaaaaaagttttttgttgttgttaaagagacagggtttcactatgttgcccaggctggtcttgaactcctgagcttaagcgatcctcctgacttggcctcccgaagtgctgggagtacaggcatgagccactgcaccgagtcccaagtgtttcttttttatagcatgttcttttcctctccattttcaggattgattctaaggattaggtatcatttagttatcatttccgattcatttttaaatgctaggctgattgacctgatccaacattaaaagaaaaaatgtggctatatttatgaagatcaactgagactgctgtctgttttttctttttatatcatgccctgtaattatctcatcaagttctttcaaaattggagaggcttgttgaatgtgtcttaaagtactggaaataggaagaagcctttctgttttttacctttctgtttttttttttttttttgagacggagtccgctccatcgcccaggttggagtgcagtggtgccatctcagctcactgcaacttccacctcctgggttcaagcgattctcctgcctcagcttcctaagtagctgggattacaggcatgtgccaccatgcctggctgatttttgtatttttaatagagatggggtttcaccatattggccaggctggtcttgaactcctgacctcgtgatccacccaccttggccttccaaagtgctgggattacaggggtgagccacagcagctggccacctttctggttttttttagacagagtctcattctgtcacccagggtggagtgcggtggcgcgatctcggcccattgcaacctctacctttcaggttcaggcgattattctgcttcagcctcctgggtagctgggattataggccctgtcaccaagcctgcctaattttttttttttttttttcagtagagacggggtttcaccaagttggccaggctggtcttaaactcctgacctcaagtgacctgtttgcctcggcctcccaaagtgctgggattataggcatgagccactgcgccagggctggaagaaaactttcttgagtactttcatagacatttttctttggtactttatagtatataatttttggtctatggtatagattatgttttttataagttaaaattttttgtaacgtgttttttacagtcattgaatctcagtggtttagatgtatctgtttgagaggcagctgatttgaatatgagagaaaatttgcattatcttgagtttatttatttatttttttgagatggagtttcattcttgttgcccaggctggagtgcaatggtgtagtctcagcttactgccacctccacctcctggattcaagcgattctcctgcctcagtctcccaagtagctgggaatacaggtgcccaccaccactcctggctaatttttttgtatttttagtagagatagagtttcaccatgttggccaggctggtcttgaacacctgacctcaggtgattcacctgccttggcctcgcaaagtgctgggattacaggtgtgagccactgcacccagcctgtcttgagttttaaaagaacagttttaaaaaaaaacaaaactgttatactatcttgtttgtatctttgtagatacaattttgagaattgtgaaaaatggataatgccagtttctgtgtagagctacccccaactgacagctttccggcgtttctcattttctaagttttagaaaattacataacttatcgtaattactgaaataaattgtagttcatttagtagtgcataaacataattgtttatagtatttctgttagataatagagtaggaaaggagtctgaggtggcacacatctttggctaattgtctttttctggtctgtgcttagttgctctgaacagggtatagagaagcaaatctagggattacccattttaactttcttccttggtcttcggctacattgggttccattagtggttttctaattagactgttgatcaccagggtaagagaatttggatcattggcaccaactcatcctgcttctggaaaaacaacttggtagacatgtgccatgatttatgaagcacactgccttcattgcctgttttctttacctcatctttttccttaaattttattttgtgaagaaattcaatcatttgtcctgtagagttttttactgtctggattttgctgtctgcatcccagtggaataatacatcctctgtatttcctgtgaattaggatagagaatgttttttaaatgtagtctagtgagtgtgtagtgattttgctgccatatggttgccatattgtggctgccgttttatgttgcctgaattttattaaattattatctcctaagtccattcactcacttcctgatttgtgtatttgtcagtgagcttctccattagataggtatttgtttaactcttgcaaataactttatttcacctttctctggtaaagactatatattcggtttgagataaacttgttcaaagacaataataaaaattactggttctccaggaggcagaggttgctgtgagctgagatagcgccactgcactccaacgtgggcgacagagtgagactcggtctccaaaaaacaaaagaataaaataaaaaaataaaaattactgttctctttgtatttctggtcaattttgacggttaggctttaagagaaagccttaacatttccattagttccaataccatttttccatagtttacatgaattacttagttttatagcattcattgatttaaccattttttcctaaaacgtttcctatggaataaatctgaagagctactcaaatgaattatgtatgtatatatatttcataatgaggaaaacataaccgttttactctatggtacttaagagatttgctgttttaatttgaagaatgaattgtttatacttttcctacactaccattccctactttaacattaaaaaattaacaaactgcttgttgaagtaatctgagcatcttttttatttctgctgttgcctgactcttttggctatgaattgactttattttttcagtgtatttactcgtgccctctcttgcgccagaaatattatcaggtagatggacatgtttcataatttatagagggaccattctttcttttttttttttttttttttgagacaaagtctcgtgttgcccaggctggagcgcagtggcgtgatctcggctcactgcaacctctgcctcctgggttcaaatgattctcctgcctcagcctcccgagtagctgggactacaggcacgtgccaccacacgtggctaatttttgtatttttagtcgagacagggtttcaccatgttggccatgctggtctcaaactcctgacctcaagtgatctgcccgccccggccacccaaagtgctgggattataggtgtgaatcactgcgcccggccgagagggaccattcttattttgttttttgtttgtttttgagaaaggtctcactctgtcatccagcctgtggtgcagtggtgtgatcatggcttaatgcagcctcaaacttctgggttcaagcagtcctcccatattggcctcctgagtagctgggactacatacaggtgcatcccaccatgcccagctaacttattttatttattatttttagtagagatggagtctccctgtgtttcccaggctggtctcaatatcctggcctcaagcagtcttcccacctggacctcgtaaaatgttgggattacaggtgtgagccaccgtgcctggccctgctcttacttctactcaatattttcatataggtatttcaggagccagcagaggaagaacgagatggcagaaaaaagaaatatcctagtccccagaagactcgttcagaatctagtgaacgaaggtttgtgtttatctttaattaggaagacattgataactcactttttagttgccttgcaaggacattaaagggatttttaatatatatacttactcctctctctgtaaactcattaaagaaagatgttacctttcttcctttcattctttctgttttttgtcttttgtcttactttctgttccttttataaacagtcattattatgtgttttccccaagagctcaggggtgggagcagtccccttagagaatattaatgaaatgttccatttggttaggggtgcttagtattaaaatcatccaagtcatttttttatgacaagtagtacaacttgtatattgaatcatcagcctaacatcaaaaattggtctttgtttaggaacacttttttttgagccttttttcttttctatttcaaattttctgttttcccctgcccacccctccccatactttggattcacctctttttttcatttctccccacccagtataattgcaggagggatgttttttctctgtatatatttgattagaggaattatgtggtagatttgcaactttctaaaaaagcatagatatgcatttggatgactcaagagtagtatttatactatagatttgtttgcagacttggtttctatagcctgcatatggcttttatatctgtatattataggacacgtgagaaaaaaagagaagacgggaaatggagagactatgaccggtactatgagcggaatgaattgtaccgtgagaagtatgactggagaagaggcaggagtaagagtcggagtaagagtcgaggcctgagtcgcagtagaagccgaagtagggggcgcagcaaagaccgggatccaaataggaatgttggtgagtagatgagtgtccccctaaaaactctgtagttatttatctgtctctatcacaggggtgcaagaaattctcttaaagttgtacctttaatatgtctgagcagtgtaaaaactggaattgtctcaagaagctcaatatccattttgttagaaaacagggctctattctggggatggagtcaagggagtttgattaaaaaggagctattcaagtgtatcattgtacatgtctagacttaactcattttgtataatggatacaaatatcctttaatcaataaagctatcacgtgaggaagagggttgcctgcttttcttctttgtttggttttctaaaagtaattgatttgctgtaagggtgcttgaagtttataaaattaaatggataaaataagtagattattgggatcccaaccactcatcttctgagatacaagtttggaagtcagttcttagataaccttcttattaaatatctgtggagaagctgactctttttcagttaagtgtaactgatgttgatactataaaagatgattttgcacaagttcttgcccaagatatgtcacttgttgatgtccctgcttttaggatatattaataaagagaggagtatgaaatatggatagctagataagtttaattcaacattctcatgttttctatgtgagaaaataaatatagtttaagaacatgaaatatctgatctctttgttttctgtttttaattttgtctccaagtagagcacagggaaagatcgaagtttaagagtgaaaggaatgacctggagagttcctatgtgcctgtgtctgcaccacctccaaactcttctgagcagtattcctctggggcacagtctattcccagcactgttactgtgatcgcacctgctcaccactctgaaaacacaactgagagttggtctaattactataacaatcatagctcttccaattcttttggtcgaaacctaccaccaaagaggcgatgcagagattatgatggtaaaaatcaccaccttttctcatattgtgcccaaaagtactagcagagcaaatgttgcatatattgcatatcttttagttatagtccagtttattttattttatcttattttatttattttgagacagagtcttgctctgtcacccaggatggagtgcagtggctcgatcttggctcgctgcaacctccatctcccgggttcaagcgattctccttcctcagcctcccaagtagcctcccaggtaggcaccaactcatggggaatgttgtttaatctacactcccactgacttctatggcctgtattatttcaagcaagtcacacacaggcatgtgccaccatgcctggctaacttttgtgtttttagtagagacagggtttcaccattttggtctggctggtctcgaactcctgacctcaggtgatctgcctgcctcggcctcccagtgtgctgggattataggtgtgagccaccgcaccatgcctatagtccaaattttgttaaaagggatgaatggggaggagaatctctgtttgatttaatggtttggctctcattaagagaatatttaaattttacccttttttagattttttttgtttttttgttttcactgttatttcaaacactgtatgccatagtatactgtaaaatttcatagacactagtaattgtaattttttaaaagaattttatttatttatttatttatttttggagacggacttgctctgtcccccaggctagtgtgcagtggcacaatctcggctcactgcagcctctgactcccaagttgaagcgattttcctgcctcagcctcccaagtagctgggattataggcgtgagccaccatgcccggctaatttttgtattagtagagacggggtttcaccatgttggtcaggcttgtctggaactcctgacctcaggtgatccaccttcctcagcctcccaaagtgctgggattacaggtgtgagccaccatgcccagccaggaattgtcatttttttgagtagtgtttgctgccgggaatttgtagaagttacttacaagtttgatttgctgactttccatttgaatgaatgaatcggtatgtgtgtatttcttttaaatttttattatggaagtatttatatattcataaaagctgacaaaatgatatgcttaaccccagtgtatccgttacatcatttaaataggcaccaacccatggggaatgttgttttaatgtatgctcccactcacttctgtggcctgtattatttcaagcaagtcacagacatcataatttttttctataaatacagaatgcatacgtttttacattttacttattttaaagtagggaatagagtcaaattataattcaagaattacctcattctcgccctaatctctcagccatagaatactccttgccaaggccaacgtaatgttatcaatttgttgtttatctttccaaacataatctgtgcgtatgtacataagtaaatacacatattttccccacatttttaacataaatactagtatgctactcatacttctgcataatgttttttcagttagcagtatttcctggcgttcatcctatgttaaaacatagagagctttctcagtatttatttaggcttcttagtattcttttttttctcttttttttttgagatggagtctcgctctgtcaccaggcaggagtgcagtgccatgatctcagctcactgcaacctctgcctcctgggttcaagtgattctcctgcttcagcctcctgagtagctgggactacaagcgcgtgccaccacgcccagctaatttttgtatttttagtagagacggggtttcaccatgttggtcaggatggtctcagtttcttgacctcgtgatctgtctgccttggcctcccaaagtgctgatattacaggcgtgagcgactgcgcccagccctgcttcttagtattctttatgtacaaacgtgtttaacttattccttattgatgtatgtttgggatgtttctattatttttctactatgtacagtgctacaagtgataacctggtacataatgttcacgtgaatatttgaaagtttcaacttccagatatagcaataatggttgctttagaataatgtaatgagaatagattgagagtaaataatctaggtcaatgcccttattctcccctaccccacgcctttgctaaattgatatttgtttaaaatatctgagtttttattatgaaagcttaattgcaaatggtttagtataatggtagttggtaacctgttcttgactcttttatttgctttctcaacaagtcatagtatcatagtgtaaaaagtagagagtacatctgcctctaccttggggatatgtgatgcttaacagagtaacactgagactttggattccttggagaaaaccactttgtaaatgagattggtgggtttttcagggacatgttttgttgttttctgaactctaagtagatgataataagattctttttttattctttattccacagaaagaggattttgtgtacttggtgacctttgtcagtttgatcatggaaatgatcccctagttgttgatgaagttgctctgccaagtatgattcctttcccaccccctcctcctgggcttcctcctccaccacctcctggaatgttaatgcctccaatgccaggtccaggcccaggcccgggcccaggtccaggcccaggcccgggcccaggtccaggtcctggccatagtatgagacttcctgttccccaaggacatggtcagcctccaccatccgttgtgcttcccataccaagtaagtatatatttgttgaatttttctctagcgttctgtttagaagaacctcatcccttttagctaacttgacactcgtttaaagtgtttgagaaatagagtaataatataatttggaatatattcccataattaagatgctattcttttctttttttcatccgttattgcatgatgttatttgtattaccacagtgtaaattttgtgtgtagtggcctaacctatattgacctgcagtcaaatctagttatcatcttaagaaagccagtatttatttatttatctatttttatttagtttttctttagagacagggtctcattatgttggccaggttggtcttgaactcctggcctcaagcagtcctctcctgccttggcctcccaaagtgctaggattacaggcataagccaccatgcctggccaggaaagccagtttttaagatgtcagagaaaaaacatgttaggagttttatgaaattttccagtctttaaggaaaatctcttcaagaatattgaaataatattaaaaaaattttttttattacagacatttttagaagtagaatagtatgtgtgttgcaggtaccatcatccagcctcaatgacgatcaatattcagctgttttgtctcatattttcccttctctcccatacactttctttgggttggttggttttttgctggagtaaattctaaatgtcatgtcacttcaccagtatgtacttcagtatggatctcctttctgataaggactttttgtttttgttatttaaaaaaaaaaatcaatatgccattatcacatccagcaaaattaggagtaagaaatgttttaaaatggtcatttaaaaagcattattaacagttgccaatatagtagaaatagaagtaagactaaatttttaaaaagtaattgaaaaaattatggaatgaattgttttcatgtatgccaaaatataaaacgttatctgcttgaagacttttaacattaaaagatggcaaattaggctgggcatggtgggtcatatctgtaatcccagcactttgggaggccgaagtgggtggatcacttgaactctggagttcgagaccagcctgggcaagatggcgaaaccccatctctagaaaaaatacaaaaattagccaggcatggtggtgtgtacccatagttccagctacttgggatgctgaggtgggaggatggcttgagcctgggagacaggttgcagtgagccaagattgcaccactccattctagcctgggtgacagagccagaccctgtctcaaaaataaataaataaataaataaataaataaataaataaataaaagatggcaaatttttatttttagaaatattgctgttcagtttaagcagtagttttaatgaatttctttttaacattttattttgaaataattacagactcagttatagaattataattacggaaattgtgaaaatggtttcacatgatcctgagcttccctgcagtaataaagtattctgtagaatatacatttcatggcccggcacagtggtgcacgcctgtaattccaacactttgggaggctgaggctggcagatcacttgagctcatgagtttgagaccagcctgggcaacatggcaaaaccctgcctttacaaaaaatacaaaaattagccaggcatgtcggggggtgcatgtagtccctactgcttgggagcttggtgtgggaggattgcttgaacccaggaggtcaagggtgcagtgagctgtgatggcctcactgcactgcagcctgggtgacagagcaagactttgtctcaaaaaaattaaagaatatgttttattattaaagttggtaaatgtttggagggatttaatgcatatgtttggcctatagaaacatgttgttgtttttttttaacttagcatttgtgattttttttttcttttattttctttttgagacaagatctcactctgtgccctaggctggagtgcagtggggagatcttggctcacgactcactgcaacctccgcctcccaggcttgaagggatcctcccacctcagtctcctgagtagctgggactacaggcgtgtgccaccatgcctggctaaatttttttggacttttttgtagagacagggttcgccatgttgcccaggctggtcttgaactcctgggctcaagcagtttgcttgcctcagttcccaaagttcagggattacaggcgtgagccaccgtgcccagcccatatgtgaatatttaatataatcacataaacagtataattgtgaagctcaagctgagatttcatttcccagataaagcaacatcgttttatatatggaaattctaaaataaagaacgttatctcagcgtgggaacatatctatttaaaagttaaattcaagaataccatttctcccgacattttgctatgaaaagtttgtaacaaataggaaagttgaaggacttgtacttgtatacttaccatctaggttctacaattagcattttactgtatttatgttagcacatatctttccgtttctccatttttacttttgatgcttttcacagtatgttgcagacatcgtacacttaagcatgcttatcattaacttgaattctgtagaactttaccatcaccctagaaagtttcctgaagcctcttctcagccgttctccaccttcacccatagaggcaaccagtcctgccttttttcaccttagattagttttgcctcttctagaacaagtaatgttcttttaattgattatacaactcccagtgcttaagcttgcatatattaaattctttaattctattcagaaccaaattaggtattttaaatgtgagtatccaagttagtactagtatggtatttttttcttttttttaagatgaagtctttctctgttgcccaggttggagtgcagtggcgtgatttcggctcactgcagcctccacctcccatgttcaagtgattcttctgcctcagcttcccaaatagctgggattacaggagtgtgccaccacacccagcttatttttgtacttttagtagagatggggtttcaccacgttggccaagctgatctcgaacttttgacctcaggtgatctgcctcggcctcccaaagtgctgagattacaggcatgagccaccgtgcccggcctatgatggtccttttttttttttttttttttttttcgagacagagttttgcttttgttgcccaggctggagtgcaatggtgcgatctcggctcaccgcaacctccgcgtcccaggttcaagcgattctcctgcctcagcctcctgagtagctgggattacaggcatgtgccaccacgccctgctcatttttgtattgttagtagagacgaggtttctccatgttggtcaggctggtctcgaactcctgacctcaggtgatccgcctgtcttggcctcccacagttctggattacaggtgtgagccactgctcctggcctgatacttttattaggaaatattaatgctgtacttttcactttttgttgtctgtatgtaggaccacctataacacaatcaagcttgataaacagccgtgaccagcctgggacaagtgcagtgcccaatcttgcatcagtgggaacaagactacctcctcctttaccccagaacctcctttacacagtatcagaacgtaagtacatgttgtttgacttaaaattgacagggtatagaaaagccaagttgtctcatatcagtataaccctttaaaaaatggtaaatagtttctgttcttatggattctaaaaattgtatttgtgtttacaatacagtttatcgtgtgtttctgctatatagccacattttaattttgtgtgatatgggagagaaaggcaaggctttctgttttggagaattttactctgccatggagtagcaacatttagtctctcctttttatttttttgagacagagtctcgctctgtcacccaggctggagtgcagtggcacaatctcagctcactgcaacctctgctttccaggttcaagtgattctcttgcctcagcctcccaagtagctgggacagcaggcgtgtgccaccatgcccagctaatttttgtatttttagtagagacggggtttcaccatgttggccaggctggtctcgaactcctgacctcaggtgatctacctgcctcggcctcccaaaatgctgggattataggtgtgaaccactgtgcccagcctaacgtcaagtctcttctaaaggaaatttattttgaagctttttaaaaaaattgtttatctgattgattttctaaagcataagatgtatctcctaagaagtatacaaaagagcgggttaattatgcctaataattaacttgcatactgaaataaaggtagagcatcatttaaattgtaattttctgtatttaggctgtttgtgacattcacatttgattgtaataatacatttttcttgggccaggcgcggtggctcatgcctgtaatcctagcactttgggaggcctgggtgggcagatcatctgaggtcgggagttcgagaccatcctgaccaacatggagaaaacccgtctctactaaaaatgcaaaattagctgggcgttgtggagcatgcctgtagtcccagcaactcgggaggctgaggcaggagaatcacttgaacctgggaggcggaggttgcagtgagccgagatcgtgccactgcactcccgcctgggtgacagagcaaaactccgtctcagaaaacaaaaaacaaaatgatttttctggaatcctaattctcttttgtttcttaggtgttttattgtttactaaagctttaaaaaattacttccttcaaaaacattttttaaaaaggtagttggttgttaaaaatgtcaaattagaagatttttttttttttttttacaaggcctggtaactttatggatatgttcctcttttatgtaactatgtatatcataaagtttattttgcatcctaaacatttctgtatctctttgatgtcttggagaggcaattcagcaaactcgttaagcccagtttcaaatcctggttttatcatttactatctttgtgaccttgagtaagttgcttagtctctctgtagctcaatttcctcttctttaaaatgagaataatattacctcattaaggttgttttgagtaataaattaatacatctaaagcatctaaaaaagtgcctagccactagtaagctataaggattcattattatattattgtagttattattgtctcctgaaatttcaaactctgaaattgaacctattaacttcttaaatctgtaccttctaccatccctgtttttgtcaatggagtaacacccacctaatacctagaattgaaaccttcacaggactgactcattgctttgcttttttacatctggttaatcaaaaattctttttctttgaagtagccctttctatttcttctgtggcctctgccctcatccacgctagatcacttcacatttggattattactgcagcctacttgacaccattatgttttatgtttaacttccctaagtcataccacataatgctgctaagctaattttcctgagaaatccaaccatgaaagttccttatgagaacttttcggtggctaccatttctttctgagccatcagtaaacccctctctaggacttctaactcctttttttttttccttttctttttttttttttttttttttttgagacaaagtcttgctctgtcacccaggctggagtacagtggtgcaatctcaactccctgcaacctttgcctcccgggttcaagcaattcttgtgcctcagcctcccaagtagctgggattacaggcatgtatcactatacccagctaatctttttgtattttgggtagagatggggttttgttatgttggctagctgtcaaactcctggccttaagtgatctggctgctttggccttgcaaagcgctgggattacaggtgtgagccaccacgcctggactttttttttttttttttttgagacagagtctcaactctgttccccaggctgaagtgtggtggtgccatcttggctcactgcagccttgatcttccaggctaagtgatcctcccacctcagcctcccaaatagctggggccacaggcatgtgccaccacacccggctaatttttgaaatttttttgtagagacggagtctcactatgttgctcaggctggtctcaaatttctgggctcaagtttctcccacctgagcgtcccaaagggttgggattacaggcgtgagccactgttcctggcctttaactctttcaatagtctacctcttccttcttggcaatctttgtccactattcctcaacatgcatcttctctggtaatgccaattataccctttctgtgcccccgtcatggctcaactttcccccccaatcttctttcctactaatatactctgtcttcacctctttctaggcccaaattctaagtatacttggaagacatgattgctgttttctatctgtctgtctgtctgtctgtctgtctgtctgtctgtctatctgtctgtctatctagagtctcactttgtcgcccaggctggagtgcagtggtgagatctcagcttattgcaacctctgcctcccgggttcaagtgattcttgtgcctcagcttcccaagtagctgggattacagtcgcccaccaccacacctggctaatttttgtatttttagtagagatggggttttgccatgttggctaggctggtctcgaactcctgacctcaggtgatccgcctgccttggcctctcagagtgctgggattacgggcatgaacccctgtgcccggccttttgctctgttttaaactcttacaataccaaaaagcatttgttacataatgacatatacttatatataggcctactgtttgattttttttaatatatgtaaatcttacattcaactgagcttctacagaacggaaatcacatttgatacttaagtaattgtttttcctgtttcatacttagtatctcgctgtattctgattgctatagcgtcttttcatagaacatgtttgttgctcattttttaattatgggaaatctcaaatatatataaaagtaaagaggacagtatatggaactccggagtacccagtataatgaagttctttgtgcttatccctcagtttcaacctttatcaatttatagcggagcctcttttatctatttccccccgaatcagctcttaatattgtttgccttttggacttgtaaatatgaaaaagtggactattccagagtgtgttgcagatggcatatttttatactgttaaatttggtattatgactcatgataaaaattccatcttgtttttaatttaaaaaaaatctggcaattaccatttatttttatattgttaaatttaacattgtgactcactctataaatattccatttggttttaatttttaaaactctggcagttaccatttatttcagtgacttagcttaataaataaattaatttggcaaatatttattgaatgcctactatgtgccaggcatcgtgccagacactagggagccaaggtgaataagatattagatctcatgttttttgaagtccatttttctgttttatttaaaagtaagactattttgtagtatatgagtaaaggccttttagaactgtatttccaaattattattattttttgagacagtcttactctgttgcccaggctagagtgcagtggcgcaacctccacctcccaggtttaagcttgtgcctcagcctcaagtagctgggactacagtcgtgggccccaaggcccacctaatttttgtatttttggtacagatggggtttcgccatgctggccaggcaggtctcaaactcttggcctcaagttatccgcccgcctcggcttcccaaagtgctgggattacaagtgtgagccactgtgaccggcctctaaactcattttttaaagactggtaacgtttctaagaaaattcttgggacctgtacagttagcagcttgttattttgccaggttaaggtctgtatatgaaaatatctaatactttaattttaaaaatatgtttttaaactgaagaaaggacataatctcagaataaaagataatctttttaaaaatttatttaaaagttttaaaatttttagtaggcacaggttcttgctttgttgcccaggctggtctcaaactgtgggctcaagtgttactcctgcctcagcttcccgaagtgctgggatcacgggtgtgagccatcacacacggcctcaaggacaatcttttaattaaaaaaaaaatcttttgtatgtagaggcagggtcttgctgtcttacccaggctgggtgctcaagcagttgtgccttggcctcccaaagtgggtaggattgtaggcatgagccaccatgcctgacttaatcttttaatatttgattttatgaaatagcactacatatcccccccgttttgttgtagaccaataaaaggtgataatttccccttagcatttgtgaattactgctttagaggattgtcttatatgctgcatcagtgttgataaacagatttgattggttggcaactgaatattttgaaagttatagaatattcatattgaacacttcagaagtctgctatgcagagaaatatgtggttttctttcttgagtgtgaaatctgattctaaaatttatagagaaattttgaagactagtagagttcctgataatctaaacattaaaaaggggatgtgtagtatagtttgtcagtcataagtttatttatttatttttttagacggagtcttactctgttgcccaggctggagtgcagtggtgcgatctcagctcactgcaacctccgcctcttggtttcaatcgattcttctgccggagcttccccagtagctgggattacaggcacatgccaccaagcccggctaatttttttttgtatttttagtaaagacagggtttcaccatgttggccaggctggtcccaaactcccgacctcaggtgatccttccgactcagcctcccaaagtgctgtgattacaggtgtgagccaccactcctggcctcagtttttaatatctttctattacctttatatttctaataagtttttaatatttttctattcagttgattttaagatagcttttgggctgggcatggtggctcatgcctgtaatcccagcactttgagaggctaaggcaggcggatcacctgaggtcaggagtttgagaccagcgtggtcaacatggtgaaatcgcatctctactaaaaatacaaaaattagctgggtgtggtggtgggcgcctgtaatcccagctactcaggaggctgaggccagagaatcacttgagcctgggaggcagaggttgcagtgagctgagattgcgccattgcactctagcctgggcaacaagagcgaaacgccatctcaaaaaaataaataaaataaagtaaaataaaatagttttaaaaatatttttgtctttgagacagataattgaatccttcacattgttcaagtttatttttctaaatacaggtcaagcattcccagtctgaaatgctccaaaattagaaactttttgagtgccaatatgatgctcaaaggaattacttactcattgaagcattttggattttggattttaagatctgtgatgttcagccagtaactataattcagagatagaaaaatctgaaaaagtctgaaatctgaaacagttctggtctcaagccttttggatatgggatactcaactcgtactataattggtaatttcaaaaagattagaagtttgattcaaataaagtaaaaagctatatgtatgttttcagtgtgtaatgagaacttgagctgtcttaaaagtttaacaagttgggaaagtttaaattatggatattttattgtcattaaaattaatattaaaattcacagcacagaaaatataggtgaaaaatgcatatcaaatggtgtttagttgtgcagatgatgtcaataaggacccaaagtaaacacagaaaaacgaaatctggatttttcaaggtaggagttggagtctgctcagtgttaggtactaggaatatacagatgaataagaaatggtcatctaagaatctaaaaatctaatagtgggaaagaaatatgttaaaaaaaatctccacaaaatgaaaacccattacagtatattttgctattacagctaaaaaaaaaccccaggtaacaaaggaactaattctgtgagaaataaagcattcatttaggctgcagttgtcactggttttggaaaaagacaagttggatgttaaaataagaaaaagaattaacctgattctgaaactgaataggatatacatggttcctggtaaagttaatattggctgaatgcagtggtttacccctgtaatcccagcacattcaaaggccaaggttgggaggattgcttgagcccaggagttcaaggctgcagatagtaccattatactctagcctggacagcagagagaagtaagaccctgtcttaaaaaaaaattgattataatttataaaaaactttgaaattttgttacttttcttgagttaaaatgtcatagaccctgtgaaaataaataactaactgtgtttggaattttgtgtaaagacagcaatcaactgttaaaatcaactatttcctctgaagtacttaacattttacccatgcccccccaccccctttatttctttttgagacagagtcttgttgtgctgcccagactggagtatggtggcatcatgggtcactgcagcctcaacctttcaggctctggaaatcctcctacctcagcctcctgagtagtttgggaccacaggcatgcaccaccatgcccagctaattttttaaattatttataaagatgaggtctttctgtattgccgaggctgatcttgacctcctgggcttgagctcttccctgaaccttagtcccccaaagtgctgggattacaggcatgagccaccatgcccagcttaccccaattttaaaaacatttatttatttatttatttaccttttttttagaaatagggtcttgctctgttgcccagggtggagtgtagtggcatgattctagctcgctgcagccttgaaccactgggcttaagtggtcaccccaccacagcctcccaaataactaggctgtacaggcacatgccaccatgcccagctaatgttgaatttttttgtagtcttgctgtgttgcctaggatggtctcaaactcttggcctggagcaatcctctcaccttggcctaccagaatgctgggattacagacctgaggcattgtatttggacccctaattttttttttttttgcatgggggtttcttgttgggagaccagagaacttgctagagaaaatcttaaagagctgtaccactgcagcctccaagtttgaactcaccaactcagtatatacttttggcttttacaagaccattattaagtaaagtacactctcttttctaccttgcttttggtctgttctgcttcttgaagaagcatagtaaaaatattttgtaactgctaagttcgttcgttgtactggatgtgtgaaaaagtaagagtagcaggtaacatcctggattctagagactgattcttaggttgaagataactgtccagtcttaatataaattcacataaatctttatctttcagaaaatactttcctactaactgtataaaattgttaaaacagtataattctaaatttgagatttgctcatttaattctgtggcattatgtagaataatgggtttgatggctagaaaagtaagtcagtgtctattagagtccttgtatattgtctagagcaggggtccccaaaccccgggtcacggtggcactaaattatcataggagactcaacggtattgtaaattgcgcatatgaaggatctgagttgcgcattctttatgagaatctaatgcctgataatctgaagtggaacagtttcatcctaaagtcaccacctccactcacccctgccatttgtggaaaaattgtattctgtggaaccggtccctagtgtcaaaaagcttggggactgctggtctagaggctttctcccccttgtatttgacctgattcatgttgtattagttgtgacattgtctatttcaacatacagatattcatccaaagaagtacttaagtttcatttgggtactttaagctttcattttttctttaagtgactgtttgatttctattatacatcaggcactgtttagcccttggaacttctcaagtgtaccaggtaccttgtattctaatcaagaagacacataaatatggccagtattgggaagatgtagctttttattttttctggatttgagtttttagcttaaaacttaaaatttttttcctgtgaatactcttaaagacaaaatcaggaaaattatacagagttgctaaaattttaggttgaataaagactgtctttattctgactagagttaatattaagaagttgaaaatattgatattaggcatgttacctatatgaacaatttaagatgggaacatgaacttgggatgtttgcagtttggaaactactctgaccaaaactaaactgaatgaatataaattctgacagactgatcttcaccattactgtaacctatttgatagtgaacattttttaatgtagctgggcgtgtgggcatgtgactgtagtcccagcctcttgggaggctgaggcaggggaagataccttgaggccaagagttccagctgcagtgagctatgatcacacctatgaatagccactgtactttagcctggataacatagtaagacctcatctcaaatttaaaagagaaaacatattatgatggaaaatttcaaatacaacatacataaaagtagactgtgtaatgtagtgaatcttcatgtacttatttctggcttcaacagttaatcaatgtggttaatcttgcttcatccataacctactcctgacttgattattttagtgctgtggttttttttttttttttttagacaaggtcttgctctgtcacccagccttgagtacagtggcacaatcttggctcactgcagtcttgacctcctgggctcaagcaggcctcctgtctcagcctcatgagtagctgggagcacagatgcgtgccaccatacctggctgatttttaaattttttgtagagatgagggctccccatgttgcccaggctggtctcaaactcctgggctcaagcagtcctccagcctcagcctctcaaagtgctgggattacagatgtgagccatcacacctggccttagtttttatttttgttttcttttttattgctcctcaaaattcagcttaatgacatgattgttttagaataagtcccaaatatagtagcatttcatctgtaaaaacttatgtatctttgaagataagaattaaacatacatacacacaaaatcctacatacacacagtactattatcacagtcccccccaaaatttgtaacagtttactattccttgtgaaatatccagttagttttcatatttctcaattgtatcataaatgcccttttgtacctggtttatttgacgctatatccaaacagggttatacattacgtttagttgatatctttcttaagtctttatagaaatatcctttacttctttttttttctcccttggcgtttatttgttgaagaaatagatcatttgtcctaaagaattttctcacattctagacttggcagattgatcttctggtgtcatctaacacattcctctatcccctgtattacctgtaaatttgaagttagagctaggtatttgataaaattcaatttttttctttttttggcaagaacattttatagatggcgttatgtacttcctacacagtacattataatgctcatgatgtctggttgtctcctttctgtgttataaatattgattagtgtgtaaaggtgttttcatcctgatccattcattttaaaacttgcttgatggtttcaacagccatttttgatcattgcctggatttgctgttgtatgtgaaactctaaatctatagtttcttctacatttattgctagcattccatatagttgactataacaaccatttggttaacctgaaatgcagtttttacagaagagacatgatatatgtgtattttctttcatttatcaattttaagaatgagttgattccctagttttttccaaagggaactcctgttttttttttaagtatcattatgaactcatgaatttttaacatttgatatgtttcactccattatagtcttttttgatgttcagattgtctcatctttaatcaataggagcctcttcatgttggcttctgctagtttttttttttttttttaatttttgacatgccagtttttgataactctcttgcttctggaaggacaaggtatactaaggtgtaccaggctcatcttataaattttctgccctgacctagaattagccctttgtctaaagaactctgttgctttagaagtagtatttagagactcagtaggaattgtttaagaaagtcaggctacatttggattaattgccatctttttgaggtatttgttttttattttgaggcagaggctttctctgttacccaggctggagtgcagtggtgcagtctcggctcattgcaacctctgcctcctgggttcaagtgattcttgtgcctcagcctccagagtagctgagattacagacatgcaccactacgcctggctaatttttgtaattttagtagagacggggtttcaccctattgcccagcctggtctcaaattcctgagctcaagggatccacccgccttggcctcccaaagtgctgtaatcacaggtgtgagccatcgtgctcggcctttctgtatgttctttgtcagtagttttaaaaacagacattgggcaaagtagccttttggtttccagtttactttgagacagctattattaattagacatacttaattagatagtatacttagtacatcaagtgatgtatcatacatttaaagtagtcatatggactaagattgtacttcccatttttctatatatgtatgtatttctattttttaattaattttttttcttttaaagacagcatctcaccctgtcacctaagctggagtacagtggcacaatcgtggctcactgcagctttgaccttctggctcaagtgatcctcctgccctagccttccaaatagctaggactacagctgtgcgccaccatgcatggctaatttttaaaatatttagtagagacagagtctcggtatgttactcaggctggtctcaaactcctgagctcaagtaatcctcacaccttggcctcccaaattgttgggtttatggatgtgagctactgcacctggccccatttttctctttaacatactactacattctgctgataggtcactcttcacaagtaattccctgccattgattgtgtgcttacaactatttgttcccctcattgagactatgttaaattgggctgggcacggtggctcacgcctgtaattccagaagtttgggaggccgaggtgggtggatcacctgaggtcaggagtttgagaccagcctgggcaacatggtgaaaccccgtccctactaaaaatgcaaaaaattagctgggcgtggtggtgggcaccagaaatcccagctactagggaggctgaggcaggagaattgcttgaacctgggaggcagaggtcgccgtgagcccagatcatgctactgcagctccagcctgggcgacagagtgagactctcaaaaaaaaaaaaaaaaaagaaaaagtaaaaaaaaaagaaaaaaagaaaatatgttatattgtttttgcagtgtaataattagctgattctttttaaatgtacttttttttccccatcaacttttattttaagttccagggtacatatgtaggatgtacaggttttttacgtaggtaaatgtgtgccatggtggtttgctgcacagatcaacctaccacctaggtattaagcccaacatccattagaaatgtaaattttaaaagggttaatgctaagtgcacagttatacagtatgatttgttacttcctcttttgcttcttatatacgaagaaaagggtagtgaagtttagcatctccatattccctttagggacttactgtgaaaccaagtggttgctttgtagcctgtcctattaaggtgcatttaaaatctttaggaattttacagcttttaaggacatttcaccaggtataaaaaaaattcaaggctgggcgctgggtccggtggcactttgggaggccgagacgggcagatcacgaggtcaggggattgagaccatcctggctaacacggtgaaaccccgtctctactaaaaatacaaaaaaattagccaggcatggtggtgggcgcctgtagtcccagctactcgggaggctgaggcaggagaatggcgtgaacccgggagacggagcttgcagtgagcaccactgcactccagcctgggtgacagagcaagactccgtctcaaaaaaaaaaaaaaaaaatccactttattttgtcttgtgtcacatagtaaatgtctgatgttggacatatataataactaaatcatataaatatgtctcaaatggggttgtcggtgaaaaagatactgttaaatggacacccaaagggattttgctccttgataccttatctttttctaatcctgtccttcagattttggcttcattgtgtgtgcattcttgcattagcctatatataaatcctaaatgtgttgtctttcaaaaagtgcttcttaatatccaggataatttcatgtgtccagtgctgtgctggtctgtttatctgttttttttttgtccttttttttttttttttttttttttgagacagagtcttactctgtcgcctaggttggagtgcagtggcacgatcttggctcactgcaacctccacctcccgggttcaagcagttctcctgcctcagcctccctagtagttgggattacaggtgcccaccacgacgcccagctaatttttgtatttttagtagagacggggtttcatcatcttggccaggctggtcttgaactcctgacctcatgatccacccacctcggcctcccaaagtgctgggattacaggcgtgagccacgtgagccaccgtgcctggcctgtccttttccctttctcaatttttgttatccatgtgctcacagagataacaaattttcactatctttaatttttttctttggagcattttttattctttgcgaaggtatgcatatagtggtttgttttttcttaatgtctttgtctttttttctgctctcagatacgggagcatatttggtgcaaacctgaaattatgtgggttggttggagaggggttgttttctttttaatggatatgacagttttcatacctgcatatctcattggatagaaaaattctgtgtaattaatagctcagggctcctttgtctaataacctgatatggttcactgttcagctttagataaaattagcacgtagttttctccacttaagatcataaaagatggagattatatatactacttaattcttattcttttctttatacctcaatggatcctaaccagttgcacgtctgttctttcttgagttagaaagaatcccaggaacatctttctgtacttctattcctgttggtttaatttctctgtttttggctcaaagtctcaggaaacacatcatcacctaagagaagcttgtgactctcattcccagctgccctcctattctttcctctataggacagcccatgtactctcgtgaacatggtgctgctgcatctgagcgacttcagttggggacaccgcctcctctgttggcagctcgtttggtgccacctcgaaacctcatgggatcctccattggataccatacctcagtctccagccctacccctctggttccaggtaagctttgctacagatggccatccacctcactgatcttttttacctcaagctggccagtctaagcggtgacctggcatcctgatctgctgttacaaagtcccattaaagctcataggtagttttattttctgctcctttgcttctttggtttgtctctagtggctgctagatgattaggcctcctgtgtatctgtcatctctggtgtcctctatatttactttcagtgcctcggtaacaaagtgatgctagttccttgagctagtttctaatcaggtagatagaaagataatatctacttgaatgttttctaattagttatacactgtaataaactaggttaatttttctttaaaacaaaacaaaaataaacatctggtttcttgccgatcatatcctttttccccttttgccccttgtatgtgtgcataatgtagcgattcttaaaaactcttttctcctattgacatacgtattttgaaggatctgtggaatgctttgtgggtgtttcatgaggtgtttttaaccctttctcactttgcctttggatcttattcttataattaactaaagggcttttaagttaattggtgttctgtgtattcccaggatttatggcacaaggtcatttgattatgtaacttctttaaaactttctgcagtcttaactgtaggagattttctgtcagtagtgccaagtggtaactgaaaactttttaatcataatttgctaatccttttttaaaaagataaagcagtatgcattttgtatgttatattgcatgtaatttttagagttggcataagcagggaagctgttactttacatatcattttcaaactgtgtcatccttaaacacattgaaatttaataagcaactatgttagatttacttttaagctagacatatcattacagtgtgtttccatcaggagggaatgctcatgattaaatactgtctttagttgtcttaaagagacaaaaaatttataaagagaggagttagaacaaaagctaaaataattaagtatgaagcccccaaaatactctttggcggataactataatcatagtcctgtaaccattgaggcaaaattatttgtttttatttatttatttatttatttttgagacagtctctcgctctgctgcctaggctggagtgcttggagtgcaatggggtgatcttggctcactgcaacctccacctccagggtccaagcgattctcctgcctcagcctcctgagtagctgggattacaggcgtgcatcaccaagcccggctaatttttgtatttttagtagagacggggttttgccatgttggtcaggctggtctcgaactcctgacctcgtgatctgcccaccttggcctcccaaagtgctggaattacaggcgtgagccactgcgcccggcccaattatttggttttattgatcatcatcaggaaactttgagactgaatgcaagccttaggaatgaaataaaaaatctctaataggaatgtcattgtgataataatttattaaaatttctgtgccattgttctctgaggaggacagtacagatgccccaaatgattaattttcaacatcatttaacattttattagagggagacagttcttaatctagtgatgccttttttgtgtgtaattccatgagctgttttcaaaacctgaaaaaaggggaaaaatgggggtgggaggaagagaaggaatgccaaccagcagttctagttcttatattagatatctcagaatcacctgtgctttaatggcattttattattattgcctcattatagcttctggatgttttgtgcaagaaggaaattagcttgtgaatctgaagttaggaggagcacaatattcgtgggagaggtttaatctaagagtattgggggtgagacgttttctggattgaggacttctgaatcctagttgtgctgcttattggccgttgactcaaatgcctgtagtggccaggaagatcccctaaatgaggataatttgctgatcttatattctgaatcacttctatactgtaaatcatagaagtgactgacgtgtatgtgcgcgtgtgtgcttttttatttgaaatatggtttatgtgtgaaaccagctgttctcactctagtttgaagaagtgtacataaccaaatgaatacattttcttttcacctcaattaaaaaggtacctagaaattggagatatgatggataacagaggaaactcaattcttcacatatggtgtttgtgtatgtgaaaatttgtattaacaaatgtgcattgggctgggcacagtgactcacacctgtaatgccaacagtttgggagactgaggtgggcaggtggctgaagcccaggagttcaagaccagcctgggcaagatagtgagactccatctccgtttttttaaaattagaaaaaaaagtgcattgacatttggattaggtaattaatatatagagtagaaatgagtaggtgagtgaatctgaaagtatcagtatttaagaatggatgcatatatctatattctgtaataggagcatttttttttttttcagtttcaaaaggtgtgtctagatactgtaacacaaagagaaatacagtcatcccttcacctcaggttccacatctgcagattcaaccaactacagatcaaaaatattcaggaaaaaaataaaaataaaaaaaaaccagtacaataattaaaaggaatgcaagttttaaaaacaatatccataacagctatttacgtagcatttatattatgtattataattaacctagagatgttttagagtatacaagaggatttacctaggttatatgcaaataccaccaccctgttttatatcaaagtcttgaacatttgtgcatttttatatctgcgggagggtcctggaaccagtccctcacagatactgagaggtgactgtaggttgatgtatttgttggagaatatatgttttttaagcagttgtttattttataacaatgagagatggtttaacctctctctgatttgttgtgtgttttgttgctttgttttccctcagatacatatgaaccagatggttacaacccagaagctcctagtattactagttctggtagatctcagtacagacagttcttttcaagaactcagacacagcgtcccaatctgattggcctaacatctggagatatggatgtaaatccaagaggtgagaataccttgaactttttctgatgctaagtgttatgcagtagttggatatagttattacatttgcatttctggcctagcttgaggaaattaaggtccaaattacttatatattatctctttggagggtgctatgtattaatctcagattttttaaataactttatctccaaattttattttaaagctatagttaggctatatttgtttttaaatgcaaatcatactaatattatttaactgcttcttttggtaggactttaggctgttttagttttgttgctaggcactgtgttagatattgtgtatagaaagatgaaattactgatcccctgccctcaaagaactgatcattgaaggacctgctttgtatcctaagagctatgcatcacactaattatattgagaatctaaaatgttacaattatttgataatttttaacacttataattacatctttaagttaggacctttacaaaacttaggaataaaccttaaaaatgaaacaaaaccaagattaaatgcaagcatttacctttaatatggctgataacctcctacctactcccccactaaaaaggttggttaatgatggttagtttgatgagattccagtttttttctagctattatgaatttccaatatataatttcaacatgagtgactggccatggactgcactgacacaatagttttttgattaatttaatcatctggcaaacattttccttttcttcctttcttttcctttttttcttcttcttcttttttttttttgaaatggagtctgggtctgttgcccaggttggagtgcagtggcgtgatcctgactcactgcaacctctgcctcccaagttcaagggattctcctgcctctgcctcctgaatagctgagattataagcatgtgccaccatgcctggctaatttttgtatttttagtatagacggggtttcaccatgttggccaggctggtcttgaactcctgacctgaggttatccacctaccttggcctctcaaagtgctggtattacaggtgtgagccaccatgcccagcctagcattttcctgttcttcctttctatcctagctttattaattcttttttcctgctgttaataacactattaccactataagaataacaggttttgtatgaagactacaccaaatgccttctcatatatatatattttatatatatattatttatatatatatttttatatatattatttttatatatattatttatatatatatattttttgagacagggtctccttctgtcacctatgctggaatgcagtggcacgatctcggctcactgcaacctccgcctcctgggttcaagcgattctcccacctcagcctcctgagtagctgggattacaggtgtgcaccaccacaaccctgctaatttttgtatttttagtagagacgaggtttcaccatattggtcaggctggtcttgaactcctgacctcaggtgatccagatctcacctcggactcccaaagtgctggtattacaggcatgagccactgcacccagcctcatatatattattgtctctcatatttctatttttattctccttttacaagtaaaaacactgaggcttagagaggtttaaagaacttgcccaaagtcacacagctgttaagtggcagaactagaattcagaggagaagtcatgttgtgtatacaacaagatttctttgttgtcttgggtaagtcacttaacctttagtgacttccttcctttaatatgacacacttcattaaattaaaaaaaattaattaaaaaaaagcattaggcaatgttagctggtaatgataaaaactatttaaggagaacataatggcatctcaaactctagaatgctttatgccatcgcagttgctatcttcttcattagccttctgcaaacacaagtcccgcaagagcaaggatcacgtctattttattcactaatgtatacccaaggtctgctatagttgctgagctgtaaaatagctaaacgttaagtgaatgaatctttacatcataatttccctgacaaagatgaaatcaaatgtaccaactcctaaccatatacctaccccagcattcagctctgagttattctttgcttggtggagttgctaaagttaagagaaatactcaagatttaataggcatagttttgtgttgctaatttctgttttgttcagtacacgtcttcctacccacaggttatttattgtaaggacagattcttagagtatttctgccaatttatagtattggctttggattttcttcccaactttaaacctgtggaaaatcaaaagaaacacagtgaacatttgaatgccttcatttagattcaccagtaatattttactacctttgggcatgaatgctctcttgtatactctctcttctctttcttctctccactcacatttttttgttgaatctcttgaaattaattggtagacattgtgaaactttaagtcctttaccttatatctaagaataagacagtcctatataagcacagtattattgccacacataaaaccataattccataataatatgtaatccttatgatttggtgaacttcttgttgaatcataccaggaggcaaataatgtccattaatggtgctaagtttgattgcttgtataaggtgatcattgttggagctctccattgtttttgttttttttttttggtttctttatgagaccgaatttcactcttgttgcccaggctggagtgcaatggcacaatctcggctcaccacaacctccgtctcctgggttcaagcgattctcctgcctcagcctcccgagtagctgggattacaggcatgcaccaccatgtctggctaatttttttgtatttttagtagagatggggtttccccatgttggtcaggctggtctcgaactcccgacctcaggtgatccgcccgcctcggcctcccaaagtgctggaattacaggcgtgagccaccgtgcctggcccagagctctccattgtaaatgtaatttttggagtggtactttggcaccataaatatcttgttttccagcaacctttcaccaatatttttttcatctattgatcatccatgcctgagtcaattattacatcgaggttaactttgagttttgaaacatggatttctattttttatagaaaaaggcatttgtaactttttcttctgttaggcatttctaaaagagaaatgatagtagttgagctattcatagtagtttttagcttttagactaaatatattaatcattgagactcctgaaaaactcagtaatttcaatttttttttccaacagctgctaacattgtgatccagactgaaccaccagttcctgtttcgattaatagcaacataaccagagtagttcttgaaccagatagtcgaaaaagagctatgagtggtttggaagggccactcacaaagaaaccttggctgggaaagtaagataatttgctaattagtagcatctaattgttattgtcgtttgcattggtaaattcataaaaataagatttgtcattaattaatgtttttcaaactaggtatcttgaagttagggttccaggagacatctttagaatgttgtaaaaattaaaaagttaacaatatttataattttttttttttttttaaaagacgtagtcatccaggctggagtgcaatggtataatctcagctcacctcaacctctgcctcctgggttgaagtgattctcttgtcccagcctcctgagtagttgagattacaggtgccagccaccatgcccacctgattttcttgtatttttagcggagatggggtttcaccttgttagtcaggctggtctcaaactcctgacctcaggtgatccacccaccttggcctcccaaggtgctgggattacaggtgtgagctaccacatccagcccaaaataggtatttctaattcgtacctacctatttctacgcctaacccaatattagaaattactgagacactagcaatggatagaaaagaagaaaaaaatgaaatcaacggtgaaaaaaaaaagcttagtacctttgcagaagttgaaaatatgccgttaaagatgatgttctagctgggcacagtggctcacgcctataatcccagctctttgggaggccaaggcgggtggatcacttgaggtcaggagttcgagaccagcctgaccaaaatggagaaagccaaaatacaaaattagccaggtgtggtggcacgcgcctgtaatcccagcaacttgggaggctgaggcaggagaatcgctggaacctgggaggcggaggttgcagtgagttgagattgcaccattgcactccagtctgggcaaaaagaacaaaactctgtctcaaaaaaaaaaaaaaaaaaaaaaaggtggtgttctagccttcatttaatgatgttagagtctttgataattgtggtagatctttatggtagatctatttagcatatgattttaagtgttagttgggccttttctttttgtaatctattgctgttcaccttttctattctcatgtaataagaataatgtggccgggcgcggtggctcacgcctgtaatcccagcactttgggaggccaaggcgggtggatcatgaggtcaggagatcgagaccatcctggctaacaaggtgaaaccccgtgtctactaaaaatacaaaaaattagccgggcgcagtggcgggcgcctgtagtcccagctactcgggaggctgaggcaggagaatggcgtgaacccgggaagcagagcttgcagtgagccgagattgcgccactgcagtccgcagtccggcctgggcgacagagcgagactccgtctcaaaaaaaaaaaaaaaaaaaaaaaaaaaagaataatgttggccgggcgtagtggctcacacctgtaatgccagcactttgggaggccgagacgggtagatcaccgacgccaggagttcaagaccagcctggccaacatggtgaaaccttgtctgtactaagcatacaaaaattagtcgtgcgtgttggcatgcacctgtaatcccagatactcaggaagctgaggcaggagaatcacttgaacttgggaggtggaggttgcagtgggccgagattgttccacggcactccagcctgggcgaatgagtgagactccgtctacaaaaaaaaaaaagaagaatgtgaaaattgcttagtaatttccgaagaatgttaagggctcacaaaaggaactttaaacaaattaatcaatcagttaatttattacatagagatgtggtcttactatgttccccagactggtctggaacccctgggctcaagcaatcctcctgctttggcctctcagagtgctggcgttacaggcatgagctacttcgctcagcctgtaatctgtttctggatgcttatgtattttctgtggtttgaattttgaatataatgtttcatatgattttgaagaagttttctgggattataggtggagccaccatgcccagccacaaaaggcacttaaaaaaattataaacctaaattctttgtggttatatctctttgctaggcatgaagtaggagaattaaccaagatgtattaatcttccttttaggcaaggaaataacaatcaaaataaaccagggttcttacgaaagaatcagtatacaaacaccaaattagaagtcaagaaaatccctcaggaattgaacaacattaccaagctcaatgaacacttcagcaaatttggaactattgttaatatccaggtaaatgtggctatgtcagtgacagaatccaggcattttatgggtcttgggaatatttctatcagctcaccttgtttaaatgagtcagtggttattctgatcatctctgctaagtgctgtaaatgccaccatatatctatatacccacttttatgatggacttgttaaaccatgtttgttcttgtgaattcatttggttcttttctgcaatctcttcctgaaagagaatgggtagcctcacagttttggagactgagaagtccaagatcaaggtgctggatgattcatttcctagggagtgctgtcttcctcgcttgcagatggttggcttcttgtgttctcacatggcagacagagaaagagaaagagggggtcagggcagatctctttctcttcttttaaggccaccgatactattcattaggatgcacctttgtgacctcatttaaccttaattacatcctaaaagctctatctctaaaacagtaatgttggagtttagggctttaacatgtgtattttggggaaaacattcattacatagcagtgggtcataatttatttaactattttctgtttttgggaatttatattgttttattttcttcaaggttgcttttaagggtgacccagaagcagccctaatccaatatcttaccaatgaggaggccaggaaagccatttctagcacagaagcagttctaaacaaccgattcattcgagtcttgtggcatagggaaaataatgagcaaccgacactacagtcctcagcacagctgctcctgcaacaacagcaaacacttagtcacctctcacagcagcaccatcacctgccacagcatctacatcagcagcaggtgctagtggcccagtctgctccttcaacagtgcacggaggtatccagaaggtaatctggttcactgggaattaaaggtcttttagttacaccctctagatcagtatttttcaattcctggtccttgggtcttctacagaagagctactcttaatttgaactgcagaccagtagcatctgatctcctgggatcttatagaaatgcagattcttgggggaaaaatttcagattcttgagccatactccatcctactgaatcagaatccctatgggtggggcccaaggatttgtgttttaacaagctctcctggtgattcttacataccttaaagtttgagacctgctattttacatcagaatcacttacctgggtgcaaatttctgggcttcagcttctcaaacctctgtagagtcagtctctagatacagggcctataaatatacatatttaacaagtactcttaagttattgttatgcaccctaaagtataataaccatctaccacagagcaactttaactgtagagctatttattttttagaatcagtcttttttgtgtctacccatttgccctcctttttcccatgtaaaaaagttatatgttccttctaaaaatgggaatagaagctccaagagaattggaattttgcctgttgtgtccattctatccctagtgcctaaaacaatgtctggtacatattgctcaaagcatatttgattgaatagatgaaggaaggaaaaaacaaaacaacaaactaccacacatcagagccattcagagattgacctagataatctcatgcttagattaaatacagtcagatttttaaaaagtattccttacagtacatggcatcaactccatttatcatcctgctcatttgcatctaaattctctttcagttatgtttgtatcccacttcatgtaagggtgcaaaggtgaatgcttcccctagatgttgggtgaatagtgtagaaaagagttcatactatcaccttcatggtgatgattaaacatgttctgttagtacagcccaagattgcattatgtttttgaggtgatcatttcacaattattcatattaagccactgtcagttaagaccccctaattcttttcttcttcttttttcctttttttttttttttgagacagtcctgctttgtcgtcattcaggctagagtgcagtggctcagtcttggttcactgcaacctctgcctcctggttcaggctacctgcctcagcctcctgagtagctgcgactacaggtgcatgccaccacccctgcccaatttttgtatttttagtagagacggggtttcaccatgttggccaggctggtcttgaactcctgacctcaggtgatccacccaccttggcctcccaaagtgctgggattatatgtgtgagccactgtgcccagccaagaccctctaattctttcagagcattgcatactagaggaaacattaaaaaataattaatggtttttttgtgtgtaggtgcatgtatattttgttgtgatatgttttagacatcccaaaaagtatgaataatctatcatttgtatattcaccagttccccttaaaaaataaaaccttacggataattgaagcaccttcccgttcccattttcttatcttcttccctagagtaatcatcttaaatttgtaccatttctaggcatgtttttaaacttctgccacataagtgttcattttgtatgtgcagatgatgagcaaaccacagacatcaggtgcatatgttcttaacaaagttcctgttaaacatcgtcttggacatgcaggtggtaaccagagtgatgcatcacatttgttgaatcagtctggtggtgctggagaagattgccaggtatgcatttttgggagcttcagatatatttagaatcattcagtgaattaacagaataaatcagttatcattcagacagtgaagacagttgtgacagttaacctaagtgtggcaggtatacctctctagtttccatgtttcagtcagaaatttgctggtgaaatttttttcctattcaaaattaagtaggaggctgggcgtggtggctcacacctgtaatcccagcactttgggaagcctgggtgagtggatcacctgaggtcaggagtttgagaccagcctggccaaaatggcgaaaccccctctctactaaaaatacaaaaaaattagctgggcgtggtggcagacacctgtaatcccagctacccgggaggctgaggcacgagaatcacttgaacccgaaggaggaggttgcagtgagccaaggtcgtaccattgcactgcagcctgggtgacagagcaagaccctgtgtcaaaaaaaaaaaaacacaaaaaacaaaaaccaagttaagtaggaatttgagaattttagatatttatttgtttgtttgtttgtttgtttgttttttgagacagagttttgctcttgttgcccaggctggagtgcaatggcacaatctcggctcaccgcaacctccacctcctgggttcaagcgattctgctgcctcagcctcctgagtagctgagattacaggcatgcgccaccatgcccagctgattttgtatttttagtggagatggggtttctccatgttggtcaggctggtctggaactccgaccttaggtgatccaccccagagtgctggactacaggcgtgagccactgcacccggctgaattttagatatttattaatagataagtgtctttattaatttctttaatttcatctttaagaatttagtgaagggtattctgtcatagtaaaaaaccaaactttgaaatatgttttaagtaatttatttttagtaatatatctatactataactcttgagcatggtgattattacaaagagagctaaaaaaaaaaaaaaaaaaaaagggaaagcaaagaaaactgctatcccaaaaatactatgtagcttctgtaactgaaacaacctgataatgactcatgaatagacagactagtggaacagaatagaaaatctagaaatagactcagttgcaaataggagtttattatataataacaaagtggaacaggtcagtggggaagttatagacatgttgataaatagtattgggatgactggatagccagtagggaaaagatgaaataagatctgatcctttttttaaaaattatatcataaaccagtataaattccaaatggatctgagatttagatgctgattgaaagtctaaatgatacaaccctcatgaaaggaaatttggcagtacagtatctgcaaaaattatgcatatgcattactaaactagttatcttccttctaagaatctatgtcaaaggtataccagccaaaatatggaaagacatatgtgcaaggctagtaatgatatactctttataataacaaaagactggaaacaacccaaatacccatctgtaggggactggttactgcaaatgtagtatatctacacagtaaatatacaactatataaagaatgaagaatatttttatatgtaccatggagtgattatcagaatatattaagtaaaaaagcaaaatggaagaaaaaaatacatagttgactactgctggtgtgaaaaagtagaggcactgaacacagagaagtatttgcttttaacaggaaaaaaaccaaaaagataattcatattatttaaatcttgtggttatggcaagtatagaagaagctagatgacttttgattacgtcttgttttgtagatttaacttggaaccatgtaaataaattctgaaagtaattataaagtaaaattaaatgaaatagaagtaatccctaaaaagtgaaaagaaaagtgaaacacatgaactagcatatctgcattgagtgctttaaaacagtgatttgatgatgtattcctaatgtgatataccctgaggacaaaaaacaatttaaagaaagctctttctaatcatattgttgacagtgttgatattctaaaacccatctgtgagcattgtagggtaaatcaaatgaggaattacactgatgtccttgacaactcagactttcagtgtggttgaaaagagagatagaagatagataagactaagtaaatacctgtagtcctgcatttgaatagaaactatccgtattaactcaggttgtattttatcttaagcgggaaaaaaaaggcaacaaaatattccccaaacatttcccaattctattcactgaaaaggtctagaaataatgaccagcccagtcattgagcatccctagcactcaaagggacccagggatccttgaagaaatagctgtctccagacctgagactggcagtactgcagatgagcctagaatatggtatcaaaccagaaactaaggagggtgtcaaagattactagagtcctgtcaaagagaaaaacaaatctgatcaggcctctagatctacccactaatttaaaagaaatttgggggacagagggacatcttcaagggtaccacagaatcctatgggggagtactactggatgagtgacctggtttcttcaacaaacaatttgcaatgaaaagcaagagatagagagggaaactatgaagtaaaggagactataaagagatgtaacaagttgcacttacatggactttaatagatcccatttcaaatggggggaaattgtttagaatattataagctggaactggagaggtgaatattatggcacatgcaggactttcctgtgtaaactagtttaattttgatgataattaagtgttgtggtgattgagagaagtcttacatttggatataatatttatgtgattgaattttccatggatttcttcatattattttctatatctcttatattattcaaagttaattaagaagtttttaaaaagacgggtgcagtggctcacacctctaatcctagcactttgggaggctgaggtgggaggatcacttgagcctaggagtttgagaccagcctaggcaacatagagagaccctatctctacaaaaaagaaaagaaaccagctaggcttgcaggctcgcacctatagccccagctactctggaagctgaggtgggattgagcccaagagattgaggcgcagcaagccgtgattgcacctctgcacgctagcctgggtagcagagtgagaccttatctttaaaaaaaaagaagaaaggaaaactttaaaaaaagaacgtagcttaatacttagaaggatttttcagttactggaaacaagagtttttatttggcacttcacttacgaaaaacaacttgtgaaataccctccagccagataccacctgtagccaaacaaattcaacttattattcagtgagaggtatacacaatgaaactggatgccaaaaggacttattttaggattttggctaagttagatgatttagaaggatttaaggaaacaggcataaattctatgataggatatctcactaaatcttacctggaatgaggctaaagcagtaagtggtaaagaagcggcagtcattaccaggataaacagatgtttagtcattttatagtttggatagcattcatatttttgtctctgttcagtcatgattagggattggtcttgcttttgtcttgatctgttatggtcacaggagcacctttgtctgatgttggtgttttgtgaaattgtgtttaacagaagggtacttaggctgtttttatcttttgggtgacaaatttatgcataaagaactagattttataatgaaatttttaaatgtaaaaagaaaatttaactcctaagaagagtagaaatatatgcatcttttctaaaaaagtattctaagcatttctaagatataattatatttgtgtgtgctttttttttttctttattttttagatattttcaactccaggccatccaaaaatgatttacagctcctcaaacttaaagacaccttcaaagctctgttcagggtctaaatctcatgatgttcaagaagtgcttaaaaaaaaacaggtaacagtcttgattcttcttgccttacagaagaaaagatgccttgaatttttaagtggttacattatcacttttaaatcagttcatgttggcagggcataacatcataatgcttatttagcttcttctctaatgtaaacttggaaaaaaaaggtggacatacagaaaaaatgtttcacaattgccattcagaatttttttttgatacactattattccctccaattctagtgtttattttctttttttaattcctaggtagataatgattcatataaaatataagacttttgtaattattatctatatgattcagttctgagtttcattgtcatcctgttaagttcacatagggttttccaaattaaatagatatttatatgtactatctcagtataattagagatttaacaggagggtgggaggcaaaattttcctggtgaaatccatagattttactctcttatttcttatttcttttttttttttttgagacggagttttgctcttgttgcccaggctggagtgcaatggtgtggtcttggctcactgcaacctccgcctcctgggttcaagcgattctcctgcctcagcctccagagtagctgggattacaggcatgcgccaccacccctggctaattttgtatttttagtagagatggattttctccatgttggtcaggctagtcttgaactcccaacctcaggtgatccacctgcctcggcttcccaaagtgctgggattacaggtgtgagccactatgcccggcctactctatcatttctaacctatagctgcatgtcacttttttcttttcttttcttttctttgagacaagttctcactctgtcactcacgttgagtgcagtgtcatgatcatggcccagtgcagccttgatgtcccaggctcaaatgatcctcccaccttagccttctgagtagctgagtaggcatgtgccaccatgccctggctaattttgttcatttttttgtagagacagggtctcattctgttgccgaggctggactcaagcattcctaccacctcagcctcccaaaatgctaggattacaagttgagccaccatgcctagcctcacatttttaaactttaaacttaaaaaataaggatttagctattacattggcaagtgaaaacaactttggtttttcttcataaggacattcaggtcattcaagtcaataaatctcatagatatagctaattaggtccaatattttaaatattttttaagtacagttgtaaactctattatgctgaaagtgttagggaaaatatattcaaaggtttcatctatggtgtcagctatttttttattaggaggacagtctgtctcagggatgacccagaaaaaatgagttgagaatggtggcaaattacattatctgtattaatttcttttttacttatacaggaagcaatgaagttacaacaagatatgaggaaaaaaagacaggaagtgttagaaaagcaaatagaatgccaaaaggtaagacaagagctcattatttgcatgctagaattgatgtatagaattgattttaaaagtattattcataatttttaaagacttctttatattaaagtttattaagcatggttttacctttttctatttatttcgtagatgttaatatccaagttagaaaaaaacaaaaacatgaaaccagaagaaagagcaaatataatgaagactttgaaagagcttggagagaagatctcacaattaaaagatgaattaaaaacatcttctgcagtctccacaccatctaaagtgaagacaaaaacggaggtatctatttgcattttttatttaacatagggttattgaacatctgccatgtgcttgacaccttgaaagtacaatgggacccttaggtagctaatatcctaacagggatataggcaaacaattatagtacttaaaaaaaaaatcctaattatagtaccttttttttttttttttttttttttaagagacaaggtctcactatattgcccaggttggcctcaaatgcagtcctcccaccttggcctcccagagtgctgggattacaggtgtgaaccactgcacccggctgccacaatttttttgttttagtgtttctgtagatgctctgtaccctttttgggaagaggttgataataccctgtttgaacaaagatgtgttttttaactgaatattttggttctctgctgaagatgacactattaaagtgatggtggtgaaagaggtatttcccatttcagcagtgtttttctaatgctgtaatagtattgtaataaaaccatcctttaaaaaaagaagcctggcctattcatatgggtaaaaatgtggcatgttattaaaaagaataatcagaagttttagatctatttaagtctaatttttattaatttccatgtgtttccttgctgtacttggtttagtcagtggttccattacaccacagttctgtggtgtgattatagataattctagtcctttgagaactggtaatgaatttgtcagatatgtagaatgtaaattgttatatgtagtattacattaaatttgaaattatggttctctatcagtatagaaacataaagtgtttaagatttcttcttaaagatataataaaaatgttttttattgaaatcttttctaattatagaaagaatatatatgcacattttaaaaattaaagaggtgaaaaaatcattggcagtcatgtcttttaaagactgataaataattcgtctctaacaaaaaagagaatgtcaacagttgtggattccaatctggtagtaattatgtagctgttactttgtattataaatacatttttactatataatttattttgctccattgtgtttcatttgtgatactttattatgtgacagttattctcagctccctcatctcaggtgtctgttcctaggatgtaatttttaagccgtctaatgcttactctttttcactgatatctatatactttttacatgttggcactactatatctgtaaagttacttttttaaaaacacccatgtttattgcatcctctcattctcatgttccaaaatacatgtgtgtcattgtgtaactatcatgttctggaggagatcttgtaagttatctaaaaaatacctttttattttcaatttttccaaaggcccagaaggagttattagatactgaactggacctccacaagaggctgtcctcaggagaagacaccacagaattacggaaaaaactcagtcagttacaggttgaggtgagatttaaaaggagttagcgccccaccacatttaacgtctcaaaaaagttttcctttgaccgggcgcggtggctcacgcctgtaatctcagcactttgggaggccgaggcgggtggatcacctgaggtcaagagtttgagacaagcctgaccaacatggagaaaccccgtctctactaaaaatacaaaattagccaggcatggtggtgcttgcctgtaatcccagctgcttgggaggctgaggcaggagaatagcttgaacctgggaggcagaggttgcagtgagccgagatcgtgccattgcactcgagcctaggcaacgagagtgaaattccatctcaaaaaaaaaaaaaaagttttcctttgtttttaaggtttagtctaataatgtatgctacattctactttttgttgttattcaggctgcacggttaggtattttacctgtgggtcgaggaaagaccatgtcctctcaaggtcgaggaagaggccgagggcgtggaggaagaggaaggggctcactaaatcacatggtggtggaccatcgtcccaaagcactaacagttggaggattcattgaggaagaaaaagaagacttgcttcagcatttctcagtaagtttttaaaatagcaaatgctaactgtaaaaacactgtgctcatcattttccttgctgcagtgtctataaatgtcagatgttttatagattagaaaaattagttgtaaaaaacatgagtactaccaaatgcctatttaatatatttaaaagtcaagaagcagctcttgcttttgattccataatactccacttaagtgcatttgtagtgacaagttgttccagagctatatttaatttttgttttaggattattacatggcttaccaggcatttatagttaatagtgaaacagtctgggatggaagcaaaattcaaataaagaatttattaggataacaggtatatttagttacattctgtatatagtggcaaccacttacttttaggcaaacatgcaaatagagatttgctacaggcaaatgtctttactgttttggacatatgcagtatatactctttccagccactcattcattcagtaaatattttattgacattatttgtgctagaacattttcatacatgatctcatttaattttaaatgactgtataaatgtgaaatacatgcaaactgtatatacatgcaaaactgtgtacatgtgaaatcctgtgtgtacagatgtgaacaccacaagttaaaatgtcaaccacaatcatataattaataagtagtggaaccaagataaccaggttccctattcctcaaacaactcttttgagaggaagtattttcagtcctattaagttttaaagatggccagggacaatggctcatgtctgtaatcccagcactctgggaggctgaggcaggtggatgacctgaggtcagtcaggagtttgagaccagcctggccaacatggtgaaaccccatctctactaaaaatacaaaaattagctgggtgtggtggtgtgcgcctgtaatcccagcttcttaggaagctgaggcaggagaattgcttgaactcgggaggcagaggttgcagtgagctgagatagtgccattgcacaccagcctgggccacaagagcgaaactccatctcaaaaaaaaaaaaaaagtattaaagatggtgagggaaatcataaagagcaaggcttcacttcaagtgtttttattagtttgatgcccattaaccctgtttcaccctgattcttggggaagataggccaagaaaagtgtccagatttgaatgtcctctgggttgtgaatggttcactcttgacccagttctttccctgatgtaacccttatttgccttttttgtaaagtgggagaatagctctaagtgacttcttgaggagtaaagaagatggaggaacactatacaagtgcagtgtattgtgaaggccgcacgaatgttgatttttgccttttaaggtttagtatataaaattaaaatctctttgccaaataaattggtcttgtagaaccagtaccagttctggtgaggtgatattggattatgtgaagcagaatttctacaaatttgactcattgcagaaagtttcagttacaaaaaatagttaatcttactagggagacagctacatgttctatcctgtggtcactggagactatatgtagatgtttaaattttaacccagaagccatgctcaaatggatctccttccttctgaaaagtagaaccattctaaagcatctaaaaataaccaatttttatgtacatatacctgacaagtctgcagtgtggcattcagttggcagatgtggttatgtctagacacttagaaaagagcaagcaaagctaaggcagatgaggtaacttcaagaacaaaacacttcctttgatttggatggctctttttttttcttttttgatagcatactatcagaaagggtattgagtactaggagcacacttccctgataataactacctgggcaatatagtatgctttctttgaaagaaatacagaaatacatattcttaggcattattgcgaatagagttagcaaacataaaaggaaactcttcttcaaggtcttttgtatctcacagaggccaaggtaaaatctatattttcagtattcttctattcttaatgattatgaaaggatcatgggtgagccatatctatatgagaaaatgatggatggattttaatgaagctatttggaatctaattctggagtccttcagagtttgctcttcaatagtctaagaacttatcataagtggattatggtcgtatgcaaatggcagctataagtatgctcattatagtgcatgtaatagtgaaaaatgataaccatgtaaatgtttgacagtgttttgctgcctttaaaaatgtattttttttgagacggagttttgctctcgtcgcccaggctggagtgcaatggcacgatcttggctcattgcaacctccacctcctgggttcaagcgattatcctgcctcagcctcctgagtagctgggattacaggtgttagccaccacacccagctaatttttgtatttttagtgttagtagtattagcatttctctattttccatacttcctgaggaacacatactcctttttttttttaataggtggttatcttttttttgttttttgttttctgttttttgtgacagtctccatctgtcacccaggctggagtgtagtggcatgatcttagctcactacaacctctgcctcctgggttcaagcgattctcgtgcctcagcctcctgagtagctgagactacaggcacgcacgaccacacccagctaatttttctgtattttttactagagatggggttttgccatgttggccaggctggtctcaaactcctggcctccagtgataactgcccgccggccgcgttggcctcccaaagtgctgggattacaggcatgagccaccgtgcccggcccacacatactacttttaaaatcagacttttttcttcacattcacttttgggatgaagcatcagtgttttatattatgtattttaaaaccaaatttgaggatattgattgatctcgatctttttggtcccaggtacttatatgaaaggtatatttacattaaagcatatacaaatttaaaatacatagaatatttaatttacagtgcaggttatatatataacagcataaaaacatacattaatatataaatatattaatagtatgtatcagagatcagcagactttttctgtaaaggactagatagtaaatactttaggttttttgtgaggagatacagatgatctcctttacattgtcttctctcctttcacctgctcttccctctcttcctctttcctttctagttctttttcttttttttctttttcttctttgtacttcaatggatgaacatatttttcttttaataaccttttcaaaaatgtaaaaaccattcttagctcctgggtcgttaaaaacagggtgctgggctacatttatcctgagggctgtagtatgcagacccctggtatgttattatgttactttatatatcaaatatttaagttaaacataattgaaatatataaatataattttatatattttaaagatcaaaatcagcgaatccagaaagaactttttaattttaatttttttttattttttatttttttggagacggagtcttgctctgtcgcccaggctggagtgcagtggtgtgatctcgactcccttgcaatctccgcctcctaggttcaagtgattcacctacctcagtccctccagtagttgggattacaggcgtacacctcctggctaatttttttgtgttttttagtagagacgggtttcaccatgttggccagcctggtctcaaactcctgacctcaggtgatccactgccttagcctcccaaagtgctaggattataggcatgagccactgcgcccggcccagaaagaactttttaaaaaatagaaaaatctttatttacctatctttatttcacagaaatcttaagatttttaatatcttaatgaagttaatgttaagtatttataattaaagtttaattcagaagctgaaaattttaactcagagccttgccaagggcacagatgggacaaaaactaaagtacttcatccctgttgaagggaggttcggctagatacaacaggaaaagttattttctctaaatatttggaatatatagactgtactttgatatttttcaagtagtgtggctcatttaactgtaagaattttgaatttttccttcttttcaagaagtctagagttaggttttaggattgatcaattcagaaattcagctgctcagattaatatatttctcttcttctatcctaccatgttgccttttattaggcttttttcctcttgccttgacctcccaaaatgttgggattacaggcatgagccattgcacctggctagtttttttttctttttttaaattcctgtttttactgttacttcttgatttctaaattgtaagcattatatattgacttcccattaatctttctgcttcccacctctccagtttttttttgaccttgtcgtgttttcttttatttttttgttacggatttataccttaaaaaaataaattattctactgtcatttcagtgggtgtctggggaagggtatgaaattgcatacgacagatggtcagttccccatctttagccagaagaccctttgagtcttgagaaagtaagaggtttatctctaaagtactgtttagaacctgtgctcccacaatatttatataattcgttataatttttatgttcttactggcaaaaacctctaatgtctcactcctgtcattcctggaacttcatatgaggcaacagaatacctctgctgtaattaccaaagacttcgcacatagttagcttttccccacagcctctcaagacagggattttcccccatcttccaagtatctgaaaaatatatttgagaattttactgtacatggaaatgatactttatagttaggcagatagttttcttttgtgctttccagaacaaaaattaaccttttctgtgtatttaacatttggagaaagttttttagatagtgcttcattgattgcccttcatcagaccttgttaaaaaagtaatgtaggcctggcttggtggcacctgcctgtaatcccagcactttgggaggctgaggtgggaggattgcttgagcccagaagttcaagaccaacctgggcagcatagtgagaccctatctttacaaaacaacttaaattaaatttaaaaggtaatatgggtgatttgtgagctatgaccatttactgttgttatctgtcacaagtgatcaggagtttaccttttctgcacactttactgtgttcagggttcttcaggtgaaaatataattttcgtagctagttctaggagtgaaatatggcaatggtaattctgtgacctttacaaagacattgaaactctaaactgctgtaattttttctcttaattttgaaaatttctttacaaaggtagttactgcttttagaacattcaaacaatacaaattataaaggagaaggcacaacaaatttgaaatcttaccaattacatttttatgaacatctttctagcacctgtatctgtcatatgtatacatactacccatgctgttttggagtttgtttttacatccatagtgtatcatggagaattgttcatgtttatgaatatagatatacatttgtcttatttgaaggcattctgttataagaatatgccataatttttatgtacagccccctattgatgagttaggtaggttgtttaccatttaactattatgaacaatgttatatacatcatgttagatttagcatatttactgggataatttttttttttttttttttttttgagacggagtcttgctgtgtcacccaggctggagtgcagtggcacgatcttggctccctgcaacctccacctcctgggttcatgccattctcctgcctcagccacccgagcagctgggaccacaggcgcccgccaccaggcccagctaattttttttttttttttgtatttttagtagaggcggggtttcaccatgttggtcaggctggtctcaaactcctgatctcaggtgacctcccacctcggcctcccaaagtgctgggattacaggcatgagccaccgcgcctggccaataatttttcattatgtgggacagtgctgcacattgtaaaacttctggcacccctggctaccacctactaattgccagtaagtgctacttagtcagtgtgactgccaaaatacctgctagagtgatgtctccaattgagaaccactgctttaggtaaattcctaggaaggagataactggatcaaaggcatgcattgaaattttggtacagctcgctaaataacccttcagaatgttgtactaatttatacttgtagtgacattggatgagagtacctatttgctcattccctcatatagcacttgaattttgtttttttatctgccagtcagttgattgatacatgatgactggcatagattgggcgtcagtttctaatcggggaaaatggctggactagatgaatttctctttgagcagcttctaccaagaaccctaatatgcatataatttttaatttatggtatatatagttgatctcatattcacatatatatgtattttatttgaattatttccttggccaacacacgtaaacaaaatgaaaaaggaataaaagtgtatacaatgaaaaataagatttccttctacctccagtcactcaatttcactccccatagacaattattgttacgagtttctcatacatctgcttaaagatattctctctctatatatattatttgttctctcttttataaaaatggtagcatgttatacaacaccgttttgccatatgtacttttactttatattagattttaaattgttctacactagtgcatgtggtgttgcttcattctttttaatgactgcatggtatttcattgcacagatatataatactacagttgaaccatcctgtattgatggacatccaattttttcccaatttttttttttttttgagacggagtctggctgcctcccaggctggagtgcagtgatgcagtctgagctcactgcatgctccgcctcgcaggttcatgccattctcctgcctcagcctcccgagtagctgggactacaggcactcgccaccacgcctggctaattttttgtattttgagtagagacggggtttcaccgtgttagccaggatggtctcgatctcctgacctcgtgatctgcccgcctctgcctcccaaagtgctgggattacaggcatcagcccctgcgcctggccttttttcccaatattttatcattttaaaccatatttagatgtgtatgtgagagaatgtatatgtatgtgtagaacaattaggtactgtaataagtaacaaatatgttaagagattaatcctagatttttttaaaaagtactttttagggctgggtgcggtggctcacacctgtaatcccagcactttgggagccccaggtgggtggatcacgaggtcaggagattgagaccatcctggctgacacagtgaaaccccatctctactaagaatacagaaaattagccgggcatggtggcgtgcacctggagtcccagctactcaggaggctgaggcaggagaatcacttaaacctgggaggcgggttacagtgagccgagatcgcgccactgcactccagcctgggcgacagagtgagactctgtctaaaaaacaaaaaaacaaaaaaaaaacaaaacttttaaaaataaaaatataatgtatgcaaatggttaaaaggatgactagggccaggtacggtggctcacgcctataatcacagcactttgggaggccgaggcgggtggatcacctgacctcaggagtttgagaccagcctggccaacatggcaaaaccctatctcaacaaaaaatacaaaaattagctagctgtggtggcatctgcctgtagtcgcagctactcgggagcctgaggcacatgaattgcttgagcccaggaggtggaggttggagtgaacccagattgcgccactgcactccagcctgggcaatagagcaagactctgtctcaaaaaaaaaaaaaaaaaaagtatgactaataaaagtaaaatctcccttttattaatctttttccattcttaaaagatagtcactattcttaggtatctttatagaaaaatactatgtatgtaagaaaacatatataaagcttctcactttaaaaacatttacgaaaatgtgatcgtattatacatacagggctgcattccaaaccttgcctttttcacataaaaatcttagctatctggtattcctttaattttttttttttttggagacagagtctcaagtcacctgtcacccaggccggagtgcagtggtacgatctcagctcactgcaacctccacctcccaggttcagggattctcctttcttcgcctcctgagtagctgggattataggcatgcaccaccgcgcccagctaatttttgtatttttagtagagatgaggtttcaccatgttggccagctggtctcaaactcctgaactcaggtgatctacctgcctcagcctcaaagggctgggattataggcatgtgccaccacgcccgacctatttccttaaaatttttaaaggttatacctatagtcaactaaaaatgtttataaaaaccaactatactgatcataaacatatagttcaatgatttatgagaaggcaaacacctaatatacctatacctcaggtcaagaaatagaacatttccaataccccaatctcccttgttgctccctccagcctctatctatcttctctccttctcagagcagtaactgttagcctcactttatgatagtcaccttgctttctttatacagtcaatccttattattttcagattccacatttgccaattcatctactcactaaaatttatttgtaaccccaaaatcaatacttatggtgttttgtggtcattctcagacatacacacagttgccagtcccctcatgagcccgttttcagctgagatagaaataaggtggtgctatgccttcttgtttcagcttttatactgtaaacaaatgccccttttgcagtctatttgttttatttatttatttatttatttttgagacagagtctcgctctgtcactcaggctggagtgcagtggcatgatcttggctcactgcagccttcgcctcccgggttcaagtgattatcttgcctcagcctacctagtagctgggattacaggcgcccaccaccacacccaactaatttttgtatttttagtagtagagacgaggtttcaccatgttggccaggttggtctcaaactcctgacatcggcctcctaaagtgctaggatgacaggcgtgagcccctgcgcccagcctttgcagtctatttaatgccacatttttctcaattttttttgttttcttggtgattaaactgttttaaatggcccccgaatgtagttctaaagtcctgtctagtgttcctaagtgcaaggctgtgatatgccttacaaagatacatgtgttagttaagctttgttcaggcatgagtgagtgcttttggccatgagttcaatgttaatgaatcagtaacatatattaaataagatgtctttcaacagaaacacataaaaccaaagtttgtgttgattagctgacaaaaatgttgtgaccctctaaaacaggagtgtccaatcttttggcttccctggaccacactggaagaagaataattgtcttgggccacacataaaatacactaacactaatgatacctgatgaacaggaaaaaaaaatctcatagtgttttaagaaagtttatgaaatttgtgttgggctgcattcaaagccatcctgggccatatgtggcccatgggccacaggttggacaaggttgctctagaggctcataagagtctaattctatttcccctataagtagtggctatttgccagttaaatgtttgcatcaactttttagaacaaaactactgcaagtaatgagaattgactgtagttttatcacctaaatatgcattcctaaatattagagtagtattctgcctgtttttaaaatgttatgtaaatggaatcacacagtgtatattcttttgtgcttggcttcttctgtttaatgtttgtgagactcattcatgtttttacatgtaacattaatttgccatttttattactatataatagttgtatcaatataccacagtttatttttcatctttttttttttttttttttttgagatggagtctcactctgttgcccaggccagatcacagtggcgcgatctcggctcttggcaacctccacctcatgggttcaagcgattctctcctgcctcagcctcctgagtagctgggattatgggcgtgtgccagtacccctggctaatttttgtatttttagtagagatggtgtttctccatgttggacaggctggtcttgaactgctgacctcaggtgatccgcccacctcggcctcccaaagtgttaggattacaggcgtgagccaccgcacccagcctcatcctcttactgatggatgtttgggttatttctactatgtggcttttgtaagcagtgttgctatcttatacatgtttttaactacacatgtacacaccatttctcttggatatacagttggcccttcatatgtgtgggtttcacctccatggattcaacctattttggatcaaaaatattgggaaaaaaatgaaaggttgcatctgtactgagcatgtacattttttgtcattattccctaaacaatacagtataacaactatttacatagcttttacattgcattagatattataagtaatctagagaggattcaaagtatataggagaatgtgtgtagattacatgctaatactacactattttatgtaaatgacttgagcattcatggattttggtattcacagagagtcctggaaccagtcccccagaaacaccaagtgatgactgtatgtggaattgctgagtgaaccccatcagttttagattcttaccagtttagaatcagtttgagattctcaccatttgtgtatgagaattcctaacttggtagcgtcataatatatctttattctaattgctaatttatttgatttgttgtaagttagatagtagaaattatttgttcttaatttcagactctgtatacatttcttattcttcctttaataatgtatatgcaatacatttaatgccttaatattccttttggaggacagacctcttatcctctttggagagcaacacagttattacagatttaaaaatctttattactttttctgtttataaaagtaatatgtttttatttagaaattcaaataataaagaaatgaacaaaacaagcagggaaagcctctctataattgggctgtgtgttaaaggatagagtaaagggtaaaggatctctgttacgtacattacctaatttttaaaagatggtaaatatagaccaggtgctgtggctcgtgcctgtaattccaacactttgggaggctaaggtgggagaattcctcgagcccaagagtttgagaccagcctgggcaacatcgggagaccccgtctataaaaataaaaaaattagccaggtgaggtggtgcatgcctgtggtctcagctccttgggaagctgaagtgggaggatcacttggacccagggagtcgaggctgcagtgagtgtgatcttcccactgcacattccagcctgggaatcagagcaagaccctgtctcaaaaagaaaaaaaaaaggtacatatctatatttggtagggctattttgatacatcagtttggtatgtcccatgagtcataatgtttggtgttaggttatgagcatttagacccttcaaggaatggtgggaatttttcccttagaacacaggacgatgtctgtgcaggcagtaatggatttatgagtctgctctaatgtacattctcaccatgctatgctccaagtgttttatggaaacatttggcaaatgcttcaggaggtttagcaatgattttgctagatagactagaatgaaagcccaaataaaaaagaatctcttctattatgttttttagaacccccagttctataaatgaggacctttgataggaaagctatagggatggctaaacttctacttttctgaaactttggatccctagtcccttgtctgtgttgctttgtctttaaaatttgctttcccctattggaatttgctggggagaaaaaaatgtttaaaaattagtaccaagtaacatttgaaatggagcagttttatgagttaggatagtattaggcatttgtttaatgtttattgaatgcatagatgagctgggaggtgcttattagtgtatagcgtttcagaagtggaaataagaagaactttatccaacataggtggggctgtgagagatgcagtgagatgaataagcagatgattcaccttttttctaaggtttgagtctatatatgtagatatcaaagccaaaggtcaatacctgtattaagaatatttcttgtcctcatcatgacttttgtaagtagagcaactctacttagaaaaaaaattatttcttcaaccaagacagatgctaacatttacctgacacagatataaaccatgggttatcctaggcaaaccagaacatatagttgctctaattaaaagggactttattttttttagctctcattggagattgtagatccaccttaacagatttctctcctgccctatgttatactttttaaataacacagaatttgcagaaatcattagtaaatttgagtgcaaacttgtatgttcttctaatatatattttagaccgcaaaccaagggccaaaatttaaagaccgtcggctacagatatcatggcacaagcccaaggtaccatctatatccactgagactgaagaagaagaagtcaaggaggaggtaaatttagtggttggaaataagagttgaattagatcacttctcaattatgtattttttatgatattaaatagtataaattaaaaaatgctgggtttttctttcatgcatgcaaattaagacccgtttagatgtttattagagaattaaaacaggtctagagatataagaagctgtgttaggggttattttcttctgatataggaaagactgttcttttttgtttacatttatattggatttatttgagctctagaaatttttattctgatgaataaagtcagagattacataaatgaattaaactttaattggttggtttcactttttgtttattcaagttccatagtaatagatttgagtttcttattttccttctgtgtacaattggttaaaatcagagtgtgcagaagttgaacatagaggagagaattggaaaactaaagacctaaataataaaagtactgaataatcagcttcttaaaatatatgagaatttattttgcttttttactcctgttgtttatcattagtttatttagtgaacacttaggctatattgcgaggttttcctgatttatatgacaatcttggttttaaaagatacctagctagcatttatagtttgatcaagtgtcttctcactatataggtaattttacacagcaaaagcagaaatgttccctagattaaaagaaaaacagaagtcatggtatttgggtagtgtttgcagatacatctactttgtctaagattttagatttttatataagatttggaatatcagtgtcatggggaagctagtatattcacctctcacaaacaattggatggatataaaaacaaagatttaggtgtttggtcatttattttcctaattttttatagaataaaattaattttaatttatcagaaatgtatctcatagtcttttttaaattttctgtactaaatgtccacattattttcctgatgatattagagtagaaatctcctattaaaagtagcaaaattagcaggggagaagaattcatattcatttacaaaaatattttgggcttttttttttttttgccctgaaagatactcttgcatgcatcccttatgaaatctagcctgggctttgtatactagcctgtttgtcctttggcctaaaaagtattttacttaccattcttgtgccactaagcagattttaacctctctttcttcaggaaacagaaacctcagatttgtttttgcctgatgatgacgatgaagatgaagatgaatatgagtctcgctcatggcgaagatgaaatctgatgctagctgtataatttttaggaatattgtttagaagaacaacttttaaaaattatttaaaagaagtcaatgagccaaaaaaaatttttttatttttcttttcaacacagtaggttcaagaacagcaagtttgctatttaaacacatctcataactgtacatgatattaaagcaccaaaggcctagtgacttttacacagttgtgaagatccacagcaatgacatggataatctctagagccttattttccacaccaccttttttttgttgctgttggtgttggattatgatgtaaatgacagggtgttcagaaattttattttggattataatctactgataaaatttaattaaatgtcaaaatcacctgtaatcttttaactctcagttgttatggatgggtcatcagacagtaggaaatatttgtaattaaaatacccttttgctttcaagagtggtcttggaagaaaaatatgtttattttaattttaatttttttttttttttactttggaggagcccaatttgtattcagtctaaatttgtttttcatggtttttatgtgtggtagtactagttcagtgaaaatcacaacaaactgtgtgttcttaaatgctacagcaatggtagctagctctatagtatttccattctcttgtcatatgaactcctggacttttcctgctactgattcttagtttgctttgatatttagtgagcgctggttcggctggtctttttaaaaatttttataactcagaatgtaaaaggctttcacctattgcccctttctcgtcccccttttcttcctcttgcctttctattaataggcctgacttagtcatcattgatataagtggttcatttgggcaaccgcaggcagtctccaataaaaggttcaaaccagcacctggataaataagtgatgttttgatgagaatgatggaaggattttggggagaagagaatcaccagctttattttttccctcttttgaagcttcagttcagtatagttacacagaagggtttaaaaatgtctgaaattcttttcctaaatttaaaccatgatggtgaggtgactggggggtggggggtggaggtgggagggggttgagggctgagtatgctagtaataaatgggagtcatatatgactttgttcagatgaccttattttttcataattttgtagcttgttgctatccatgaacatacgcatccctcagtagacagtttcctttactgtgtgcatttttactgtacactgtatagagtagagtatctgttaagtaaaatatatatgtaaatttatgtcttcgtgttctgaatgttagatggaaaagcagaggagcaacactacactgtactgacccctgggaaaataaaatgattaatgtacctaggctgtcactttttcaaggatatacacatctgtgtttttatatatgtgtggtatgaaaatttgaaacctcctgttgtctccaaaagggtcttggtgaccactatatcaaggattttgtttgctgaggtaaagacaatttctcaatatagaaactattcactaagaacttaaaaccatcaggattctagatttacttagctataagaagttaaatcccacgttctgataatctttattcttctacatgttttcctggaatgatgtgtcaaaccagggtcatttttaagttcatataattttctttcataataatgaggacttcctttttctaggttattgttatatttctagtaacactgaaggtaaaataagcttataaaagaaggaaaacatcagaatggtgtatctagaatacacaatcttgctccttactcctccatcatctctaatgaaatttttcttgatgtctgtggctcagtcagtatatattttgaaagattcattgtggtgaatattttgagtcctgacagtttaaacgtgatagagggaacaaaggatttatatattttttgtacaaagttttttcttaaactgtataattttgtaaataatttgtttgggttttttttttgtgtactaaaactaccagcgtatagatttcaataagaattgttgtatttttgtatttggaaactgaaaattacagtaaataaatggaactctaagaaaaatttcagtagacagttcaacagaatgagattccttttcatatgatttttttgacctcaaaatggacatcttatttcactctcagtaaaaagttgaaaatttgactttttagtattgggggcagaagatagaagtgtgttaaagtgaaaaacagttttttcagtaaggtttgaggccctttctataagttttcagtacaccttaaacaggactaaaaatactttaaaagtgtgctttcaaagaattttaaaacatgtttgactcaaagatgaatttgaagtgagttaattataatactggaaaacttcaggttagcataaaatagtttatatatatcccctgccccctttgggatttacttccaccatcaaatcttcaactgttagaatttcacttaaaagtgaataactgccatacatgttttcttggcatcttcatttacagaaataacatacagcatctaaagcaagttctgtccctcttaatgtgtatgacatctttttaagtagctgatcagcaataatagccaccagttgactaggtcagcctgatatactagtggatcactgtccaagataaaaaggtaaccccaagtattgcaaaatttccctcaatttctttatgtaacattgaagaaatgttgttaccagctaagatgataaattggaaaacagtcttgttaaggtgaaaggggtccttggtgatggatcattatttcaaaaaagaaaaaaatcatgtgaaaaggaatagtggttcctcttgatgtatagtatgcctgtattatagtttttacaaaattgtgaacttgtgtaatagtataataggagatattgttgaatttctaactgtttatacatttaaattcatatatgtaatgtttgttttatcaattacaatctgaatttctaagaagcatgttgacttttgcaataaagatgcaatatggaatggttcacaattggaaaaaaaaaagaaaaaagatgaaagtattacaaatttaaaagaatttggaaaatttatgaaccattccaaaaattataacaatcaccaa

SEQ ID NO: 597 - DNA, 62857 bp, Homo sapiens
cagtgcacgccgggcaagaggaagacctccatcagctcgccgcgcagcgcggctgtatttgcggcctgtgcgagtaggcgcttgggcactcagtctccctggcgagcgacgggcagaaatctcgaaccagtggagcgcactcgtaacctggatcccagaaggtcgcgaaggcagtaccgtttcctcagcggcgggtgagtttgtgtctctgaacgcgtgtggaaaccgggagaccgggtgcctcagctggtggaggaggaaaagccggggtggctgcgaaagcgccagggtggggtagaggtaagggggagcgcggaggcgggggtgggggaggggtcggcacgaggcttggtttcttctcttctctaaggcctggaaaagctgtgggcccagccgtagctggtggaggccagacctacggcttgagctttccgtcttgcattgtcgcccactttccctttcccttccacgttccgccgcggagtgaatcgtctctgccccccctgggctccacgttagatacaaaacgatcgatctgccccaggggagcccttccctgagcccccttacttaccggagccccacagtaggttttcgggcctgggacactctcgccccagccgttgccttgaagttagcctctacccaccctttttagcgaggtgctggccaccaacggatatctttcccttcctctttggccatctagagcccgccaccaagtgaactgggccccacccccttggaattgagctaatacctacctttttagcagtctcctggcttgcttaagatagtcatgaattttgccatcctgcctcttttgcgcattggagggtgcagtaaactgtatatcgccattcattctaggcgattactaagctccacattaaaatgttactttctcatttttctttggtcgtcaatcctgcttttaaatacggttttccggaatagacgtaggactatgaagatttttcggaggttatgtaatatggatttgtattgccatggaaatgccattttgatactgggcagagtggagccaagagaagggaagagattggacctctgttgcaccctactgctgtattagtgtgaagtactctgtgtattaggccgtgggcagtaatgtataaataatttttgtatagtctttggagcttttaatttttttaaaggctatttccaaaaacattcagaggacttgaaagggattaagttggtcataagttactcatgattcaagtgaatcttatagtattctaattcatttaacttaaagccttggtttttctttttcttttttcttttaagctttggtttttgttcctctgtaaaatgaatttatagtagtatctatacgttattggggttggggattgagaaaaacgtatgtaaaatccttcgtgcagtatccaggtaacacacataagcatttaaatctatattgacataatttgttatttaaggattttcaatgaaatgtaagagtccaaccctgactctgtaatttttttttttgttttgtgttgttgttttttttaagacggagtcttgctgtgttgcccaggctggagtgcggtggcgcgatcttggccactgcaacctccgcctcccaggttcaagcgattcgcctgcctcagcctcctgagtagctgggactacaggcgcgcgccaccacgcccggctaatttttgtagttttaatagaggcgaggtttcactatgttggccagaatggtctcgatttcctgacctcgtgatccgcccgcctaggccccaaagcgctgggattacaggcgtgagccaccgtgcccggccttctgaatgtatttttaaagtaaaactagtccatgttaacattgggtaactacttcagacctaacaggaatttggaattttcaagttatgtttttgtccacagacaaattagcagtttacttttcttatttacacatgatttagtgaaaatttacattattttatagctttggaagcaaaggaatcatttatcaatcttaacatcttgctaaaacagtctgtattttagagatctcttgattgacttttcaaacactatcactgccattcacaaaaggggatttttgattcttcttaaatagcttttctacctttttttgaaaattgaaagttgctgaaactagaagaacaaaattccactacccagaattattggtattggcttttaactttttatttagacataatttcagatttacaaaaaaagttgcaagaatagtacaaaagaaatctcagctatctttcaccagattcctcaaatgttaacattttgccaatttgctttatccttctcttcataggtttcttctgaaatgttttgctagtaagttgcagatgtgatgccccttaacccataaatacttaagtgtattttctaaaaattaggactagtcttacctaacaacagtacgacaatcaaaatcaggaaactaacactgataaaatacctaatctacagttcttaaatagattttgccgatttttctgagttggtgtacttttttttttttttcctttttggagatggagtctcgctctgtcacccaggctggagtgtagtggcgcgatctcacctcactgtaacctccgcctcccgggttcaagcaattctcttgcctcatcctccatagaagctggaattataggtgcctgccaccatgcctggctaatttttgtatttttagtagagacggggtttgaccatgttgtccaggctggtcttggaacttctgacctcaggtgatccacccgccttggcctcccaaagtgttgggattgcgtgagccaccgcacttggccaatatgccttttttaaaatggcagctatatgaactatattgacatagaaaattcacctgtaagtgcacaattcaatgatttttggtaaatatacaaagttatgcatccattaccccaaaaggattccttctgtctgtttgcaagtcaccctgttccaccccagtttcaggcaagccctcatttttctgtatagatagtagtagatagcgctgcttttttgttttatttggtttttgagatggggtctctttcacccaggtggagggcagtgctgcgatcttggctcactgcaacttccgcatttcaggcttaagcaatcctcccaccccagcctcccaagtagctgggaccacaggtgcacgccaccatgcctggctatttttttgtatttttggtagagatggggtttcaccatgttgcccaggcgggtctggaactcaggctcaaaggatccacctgcctcgtcctcccaaagtgctgggattacaggtatgagccactgtgcccagccttgtttttgtttttaaaaagatgaattcttcctgtgttgctcaggctggagtgcagtggctattcacaggcgtaatcccactattgatcagtttgggagttttgcccttctctgttggcaacctggtggttctctctcatcccaggaggtcaccatattaatgctgaatggacttagcatgaacacctgatcagtagcgtgctgcagcccagaactccagggctcaagtgatcctcctgcgtagctgtgactataggcaggcacaggagtgttgctctttaatcattgaaaatggtaaaacaacaaaagtggcaatgtcagaaaaagatcaactcttttttggagatttccaaacaattgagtattttcatacttctgaaaagctttgctgtaaaagtagtttttctgttaagcatttcccattcttctttgggcataaaacacttttttttttctaggaataattcctgcagacctgacacataattggaagtagatattgaatgaatgagtgagttgtatgtgaatatttgctcagaggaatctcagttcattatcatttcagaaatttggcacgtagtgtactgatggagctagtctaaaataatctatcctgggagaaataattttgtttctatctggataagtctacaatagaggaatgcttattagcagtgttttgctgtattttgcatacttgcagtattcttaagagtgcagaaaaaaatagtttgaaagattcaaagagaaaaaagtgaaaaaagaaaagctgagtgcatgcatatgttgagtactagagatatgtcttcagggtttctttttggaccagatttcttgagataaaatttgcatacaataaaatgcatctgttttaatttcaatgagtttagacaaatgcatatacttgtgtgaccaccgctacactagaggtagggaacccttctatcataggtttctgttattttatttaatttttggggggcctcactctgtcgcccaggcttgagtgcagtggtgtgagctcggctcattgcaacctccacctcccgggctcaagcgattctcccatctcagcctcctgagtatctgggaccacaggtgcatgctaccacacctggctaattttttgtatttttggtagagatggggtttcaccatgtcgcccaggctggtcttgaactcctgagctcaagtgatctgcatgccttggcctcccaaaacgccgggattacaggtatgagccactgcacctggcccaggttcctgtttttattatcgtgggctatagagtttcttttttttgagatggagtctggctctgtcgcccaggctggagtgcagtggcacaatctctgctcactgcaagctccgcctcccgggttcacgccattctcctgcctcagcctcccgagtagctgggactacaggcgcctgccactatgcccggctaaatttttgtatttttagtagagacgagatttcactgtgttagccaggatggtctcgatctcctgacttcgtgatccacccacctcggcctcccaaagtgctgggattacaggcttgagccaccgcgcccggcccggagtttcatacttagcaggaaaaggtgctttgaaccttctaaaatgtgaggtactttcaatattttaaaaaatgctatggaaatgatttcagtgccataagataactctgcatttctctcttttaaatcccacatattatacaatccctcagcaaatcctattggctgccttcaaaatatatccaggatccaacaacttgatagcactttcaccactaccacctgttccaggccaccatctctccaggctaccatctcttatatggattattgtaccagtctcttgcttgtatcctgttcccttccaggcttaacacagtggccagtgatactgttaaaatgtgacaagtcagaaactcttcaaatgattttcacctcattcagagttaaaactaaaatgtttatttacattgtgttacatagccctacactctactcataatactcagtatttatttctgattttcttcatttattctgctccagtcatactgttggccttgctattcctccctcaaatacaccattcctgcttcagcctctttgtatttgtcttttcctttgcttggaagtctctttcccccagatatgaatagggcttcctgcctctgcctcttttaaatctttgttctaatcttcaccttcttggtgaggcctaatcgctgtatttaaaataaactactccatagctctcttccctaatttatttttctacaaagtacataccatctttcaatgtattataatttattttgtttatcatctataggtaacagataagctttgcttatgattatgaaagttaattctcaatcagtttcacatggcaaaacacataaacctgtgttgaaataagtagttggtaatcttttaggctgcttaaagtggacattagtatttatcaaagatgagaaatgttttctgattttccatgagagaccaatcttttttatttttgttttgaaatggagtctcgctctgtcacccaggttggagtgcagtggcgcggtcccagctcactgcaacctctgcctcccaggtttaagcaattctcctgcctcagtctcccgagtagctgggactacgggcgcctaccaccattcctggctaatttttgtatttttaatagagacgggctttcaccatgttggccagtctggcctcgaactcctgaccttgtgatccgcccgcctcagcctcccaaagtgctgggattacagatgtgagccaccgcgcccaggagaggccagttatcttaaaggaatatccataaaaattagctgttaactggtatttttgccttcacctttgaagtccagcctatcaacaagcaagttttggcagctccaaataaaggggaatatgttatggaaaaatttgaagtgaatggaatgggtatattggcataaacgaaaattaaatatatctggttaactctgcagaatgaattacacatttaaaaaccataaaatataacttaaataccaagaatatagagttttactttttttttttttttagacggagtcttactctgtcgttcaggttggagtgcagtggcgcgacctcggctcactgcaacatctgcctcccaggttcaagcaattctcctgcctcaccttccagagtagctgggattacaggtgcgcaccaccacacctggctaattttgtttgtttgtttgtttgttttcttttgagacagagtctcactgtgtcacccaggctagagtgcagtggcgcgatctcggctcactgcaacctcggcctcccgagttcaagtgatctcctgcctttgcctcttgagtagctgggattacaggcacccgccaccacacccagctagtttttgtattttagtagagacggggtttcaccatgttggccgggctggtctccaactcctgacctcaagtgatcggtctgcctcggcctcccaaagtgctgggattacaggggtgagccactgtgcccagctaattttttttttttttgaaactgagtcttgctctgtcgccaaggtggagtgcagtggcgcagtcttggctcactgcaacccctgccacccaggttcaagcaattcccctgcctcagcctcctgagtagctgggactacaggcgcacactaccatgcctggataactttttgtattagatacggggtttcgccgtgttggccaggatggtcttgatctcctgaccttgtgatctgcctgccttggcctcccaaagtgctgggattacaggcatgagccacctcacccagcccagtgtttatatttttagtggagacaggggtttcaccattttggccaggctggtctcgaactcctgacctccagtgatctgcccgccttggcctcccaaagtgctgggattacaggtgtgagccaccgcccctgaccgagagttttagtttttaagcattatttatatctaatattattgggggaaaagtggttttaaaaatgagttcatggcccagtcttgtaaccattgtgaggctaggcactgggccattgctagaatatagtatgcggcatgagatagcataataaatttgtttattgaagtcctcagagtttgtttactgatttattcattaatcagtttattcaacaggtatgaaaaccaactatcctaagaaagcactgagataggctattataatgataatagaagagcttctgtaagtaggacagtagccctttctgttttaaaaagagataccacccccagtttttggttttggtcaaaaagttttacagaaagtttattttaaaactcaacacatttacagtcttgcaatcttgtgtttttcattgttaatatgtactgataacctacctactgtttaaaacatttctaatacctcatttgccaagtatattaaatcctcctaagggctgggcgcagtggcttatacctgtaatcccagcactttgggaggccgaggccgacggatcacttgaggccaggagtttgagaccagcctggccatacatggtgaaaccccgtctctactaaaaatacaaaaattagctgagcttggtcgtgcgtgccttgtggtgtgcacctgtaatcctagctacttgggaggctgaggcaggagaatcgcttgaacccgacaggcggaggtttcagtgagctgagatggtgcctctgcactcctgggtgacagagcaagactccatctcaaaaaaaaaaaaaaaaaaatgcatcctagggattcctttacctataaagttttctaaatattttaagtatactgtgttttctgaaattgaagtttagttttattgaatatggtattatcccaatttaagtcaaaggaattctgaggaagtagagctgtgagcatgtaggtcatgcttttctgttttaaagaaatgtctagtaaacaggtaaacgcatactcaacctcattagtcatgagggaaatgtaaattgaaataagagtatattttacttatgaaattgtgagaattttgacactgatctattctaccaatgatgaggatatgaggaaagggcatacccatattctggtggtgggaatatacatttatatgctagttttcagggatgattttggaggtaaagtttggatacatataattttttttttttttttttttgatgtggattcttgctctgtcgcccaggctgacgtgcaatggcaccgtctcggctcactgcaacctccgcctcccaggttcaagcgattctcctgcctcagcctcctgagtagctgggactacaggcacctgccatcacacccagctaatcagatacatatagttctaacctgtattagagaattacctgtacagatgcatacagttatatgtctattatctccaggaatgttcaacattatttgtgagagctgaaagtggagccaactgttaatgttggttaaataaatatgtccgtattataataatttactgcattattattattttattatttttgaggcagtcttgctctgtcaccaggctggagtgcagtggcttgatctcgggtcactgcagcctccacctcccgggttcaagcaattctcctgccttagcctcccaagagctgggactacaggcatgtgccaccacgcctggataatttttgtatttttttcatgttttattgcctgtatttttttttttttttttgaaacagagtctcgctctgttgcccaggctggagtgcagtggcgcgatcttggctcactgcaagctccgcctcccaggttcacgccattctcctgcctcagcctccctagtagctgggactacaggcgcctgccaccgcacccagctaattttttttttttttgtatttttagtagagacggggtttcaccgtggtctcgatgtcctgacctcgtgatccacccgcttcggcctcccaaagtgctgggattacaggtgtgagccaccgcgcccggcctgtattttgtttttatatgtatcattaattcttaaaaattaagattttgaatctctttggatatttattaggcttcaaagatcttgatggagcagtctgagttgactgccagtttcttaagttggcggtaaggctggggtgcagcgcacactggtttagcgtgagcagtgatcactaagcacatgagctacgaccaccccaactttacctcgttcacagacagaactggaaggttggtcctagatggctgcttggtcctggatgctttagtggtctcttgatatgtggaaagccttgttttggaacaaatgtttccattgatacagatgagaaatgcctctttaatatttttataaaccatttagaccccaatagatttggtttgtgggtcactctcttgtgagtaccaaaggatttcatggttggaaggtgtgccttttcgtcttggcagtgagcagcatttaatggagagacaatgcttgtatttgattttttttttttttttttggttcatttacaggatctgagacttattcagactaccagctgtattatcaggaaggaacaaatccaagttttgacgtattgtcagtgtgccgcatgttgtattttcaaattcctttagtggttttaacattagatgaccaattctttggcactgatgtgcttttgccagtgtacggtagatctgaccatggctctgagaagtctggctggcattaccacatcccaagctctctgtccaaagagaaggaagcgccagggacgcacgcttccttggctggactgcaggaaaagagctgcagcaccagcctctcattactgcagccaccccctctcctaatttttgtatttttagtagagatggggtttcaccatgctggccaggatggtctcaatctcttgaccttgtgatccacccacctcggcctcccaaagtgctgggattatgagcgtgagccaccacgcccagccaatttactgcattataaaggtggaataagactttatttttattttttatttttttagacagactctgtcacccaggctggagtgtagtggcacgatctcagctcagtgcaaactccgcaccctgggttcaagtgattctcttgcctcagcctcccgagtagctgggattacagacatgtgctaccacacttggctgatttatgtatttttagtagagatggggtttcaccatgttggccaggctggtctagaactcttgacctcacgtgagccccctgctttggcctcccaaagtgttgggattgcagacgtgagccaccatcccggcttggaataaaacttttgtgaactgacatgaagagatggcaattataacgagggagaaattcacatgatgtgattggttgtagaaaaataaaaattattagttcatagaatgatattaagaagagcacagcagtagataccaaactgttgggattgggggcaaggaagtggaagacttaaactttttatgttttctctttttatgtttctgtaaaacatgaaagacaaaatagtagagacaaatatttttgtttgttttttgagatggaattttgctcttgttgtccaggctggagtgcaatggcacactacaatctccacctccctggttcaagcgattctcctgcctaagcctcccatgtagctgggattacaggcatgcaccaccatgcccagctaattttgtatttttagtggagatggggtttctccatgttagctagactggtcctgaactcccaacctcaggtcatgtgtccgcctcggcctcccaaaagtgttgggattacaggcatgagccaccgtgcctggccgaccctgtttcttaaaaaaaaaaaaaaaaaaaaaaaaaaaaaaaaagtgtgttgctgaaaataaagtttgaggtgaaaaaaaaatttttttctttcttttttttttttttttgagacagggtctttctctgtctctcagcctcaagccatcctcctgcatcagcctcccaagtagttgggaccataggtatgcactatcatgcttggctaatttggaaattgtttttaatactaaaaatgctaatgtttaaatattaacattaaatggcaatacttaataaaatgacaaagttttctttaacatgacaaactaagtgaaacagttaaatgtgttcttttttttctttttctttttcttcccaccccgagacagagtcttcccctgtcacccacgctggagtgcagtggattacaagtgattctcctgcctcagcctcccgagtagctgggattacaggcgcacaccaccataccctgctaatttttttttgtttgtttgttttagtggggacggggtttcgccatgttggtgaggctggtctcgaactcctgacctcaggttttccacccgctttgacctcccaaagtgttgggattacaggcgtgagccactgcaaccaacctgttcttaaactttaaaaaatcaaatgctagcttctgattcttcagttttgattcaagaatggttacaaagtttacttttaagtttaaaaaaaaaaactatgacttttttttctcttgtcaaaagttgtatgttctctttatatttgaatggttactatctgactggaagtcaggagtttatttccccctgctgagatgtatggttcatgagcacatttgtctcttaggtagtggccagcattgaagcaacaaatactgtgtaacttggtacctttagtttttaggattctgatagatataagaaaaatgggccgggcgcggtggctcaggcctgtaatcctagcgctttgggaagctgagtcaggcagatcgtgagatcaggagaccgagaccatcttggccaacatggtgaaaccccgtctctactaaaaagataaaaattagctgggcgtggtggcgcgcacatgtaatcccagctactcaggaagctgaggcaggagaattgcttgaacccaggaggtggagattgcagtaagccaagattgcaccactgcactccagcctggcgatagagcgagactccatctcaaaaaaaaaaaaaaggccaggcatggtggctcacgcctgtaatcccagcactttgggaggccgaggagggtggatcacttgaggtcaagagatggagaccatcctggccaacatggtgaaaccccgtctctactgaaaatacaaaaattagctgggcgtggtggtacgctcctgtagtcccagctacttgggaggctcaggcaggagaatcgcttgaacccgggaggcggaggttgcaatgagcagagattgcgccactgcactctagcctgtccacagagtgagactctgtctcaaaaaaaaaaaaaaaaaaaaatcagaacacttaaaaactattagatacccatctgaattctcagtttggtctaaaaagattcgtttatgtgtggtatttaatttttggatattaactgaacctcaaaatttttttcttcctttatatgtattcctacatgattgtaggagtctgtcctgaacttcgatcatgtacattttggaaacttattttagaaaaaatctaagtcgtaagaattctcaatgaaaagagggtctttgccaatttctttgggtaagaaaagttcagaattttgcagatactctaaaaatgaaagtcaacaaagaaggcatataaaattgtgacgttttcaaataaaatgatttgtcatgtccttttttctttagactgctgcagtaagaatgtcttttccacctcatttgaatcgccctcccatgggaatcccagcactcccaccagggatcccacccccgcagtttccaggatttcctccacctgtacctccaggtaagtttgttgatactgttttttgtcgttaaacttgtacttttgtctttgtgatactaacttcaggaaaatgttagatatgtgactgtgttagtgaagatgcctctcagcgttgtttgggaaatgtggatgtctctttttcctatagcagtagcttttatatctggctgagtatcaaactcatctggaaatttttttttttcttctcatctggaaagtttttaaaaaattctttttttttttgagctagagtcttgctctgtcacactggctggagtgcagtggcacgatctccgctcactgcaacctccacctcctaggctcaagcagttctctgcctcagcctcctgagtagctgggattgcacgcacctgccaccatgcctggctaagttttatatttttagtagagacagggttttgctatgttggccaggctggtctcgaactcttggcctcaaatgatctgccggcctccggctcccaaagtgcgggattacaggtgtgagccaccatgcccagcctaaaaattctatatttaaaaaaaatgggtaatacatacacattgttcaaaaacaaaaaaaaaatacagaaagtaatacagtgaaaaattttcttcatatactcccataactgctattgctatccccttactaaaaagggaagcaataaggttattagttttttcttgatttttccagatacttaaaagtgtatattataagtcaatataagtaaagatttatggagttaaaaaaaatgttcagaccctgctccatccccctgaatcagatcctcagaaattggggctcaggattcttaatttttaacaagttcacaggtaatttttggcactcatttaagcatggagaatccacatttgagaaccattatcctgaagtacatagtgaacattgcttatgctgggtgtggtggtgcgtgtctgttgtcttggctattcaggagactgaggtgggaggatggcctgagcccaggagttcaagtccaaagagtgagacctcatctttgaaaaaacaaaaatctttgcttataagaaatttttcttttgacttaagaacattgcagttggctgacttatgatgggttgttaattcatagcatgtatgttacgggggttgtataaacagcacatttgtctttattttgtttgtgtgtgcgtgtgtgtgtatgtgtgttttgggcgaggcctcactttgttgcccagactggagtacagtggcacgatcatggctcactgcagccttgacctcctggactcccatctcagccctcctgaggagctgggaccacaggcttttgccaccatgttcagttaattaaaatttttttaaaaaacattttataaagatgggggtctcaccatcttgtccaggctggtcttgaacttctggggtcaaggtatactcctgcctcagccttccaaagttctgggattacagatgtgagcccctgcacctgaccttgtctttattttggattcaactactcattgtaaaatttttaatttactgccacaggctcagctttgggaaccttctacccttgggtctgaaaagccccaagataaatatgggaatttctgtggaatattatttaacacttcaagaatttggggaaaatcataatttaaaaaaatcaggccgggcacagtggctcacgcctgtaacctcagaactttgggaggccaaggtgagtggatcacctgagttcaggagttagagaccagtctggccaacgtggcaaaatgccatctctgctaaaaatacaaaaaattagctgggcgtggtggctcaggcgtgaatcccagctactcaggaggctgaggcaggagaatcgcttgaaactgggaagcagaggttgcagtgagctgagatcatgccactgcactccagcctgggcaacaagaatgcaactttgtctcaaaaagaaaaaaaaatcagaacaactgtttatgcatgtatattatggaatagaatgcagtactttaataagctattttagacattatgcttgtagtggagctgctttacgctgtgcttctagataatcatggatgtatatttgttatcatctgctgccagaagagtaatgtaaaagtttacactactgctttattatcccatgtaacaattactgattttaagtagtaacttagttgttttataatggaccataaatagactaaattctactggaaggctctagctggccctttggacaaagttttttcttaaaatgaattttgctgaaaggaaattctattgagaaaattgagaaaatgttgcagaaaactgaataaagttagttatcagccatcaaacagattaatagttatagaaggaaagtgttttgaacaactttcatttgggcttcagttttctctttggtccgtatatcctgattttcttcatatatttataggctcataatgcagttctgggttttaatttttaatttattaatttttttgagacaggatctctctttgtctcccaggctgggggtacagtggcataaccataacttaatgtggcctctatctcctggactcaactgatcctcctgcctcagcctactgagtagctgagactatagatgtgtgccaccatgactgactcagatccgtttttcgatgggccttaccataaccatgatgcaaagcccgagtgttctagaagttataggctgggcatggtggctcatacctgtaatcccatcactttgggaggctgagggcaggaggatttcttgaacccaggagttcaagatcagcctggacaacatagggaagaaagaccctgtcttgtggggaggtggggggtggcagtaagcttaattgcttgtttagaatcagaaaagatggttatggagaatctgtgctttaatttccttaccagtagattgggtttatagaaaagattttaaatttctttgatttttttttttgtttgttttgctttttttgagagagtctcactctgtcgctggagtgcagtggtgccattacagctcactgcagtctctgcctcctgggttcaagtgattctcctgattcagtctccctaataactgggattatgagtgtgtgccaccatgctcggctaatttttgtattttctgtagagatggggttttgccgtgttggctcaagcgatgtgcctgtcttggcctcccaaagtgtttggattatgggtgtgagctaccgtgtcccctcactccctgcctttttttttttttttaaataaagaaatggagttttgctatgtttcctaggctagagtacagtggttatacacaggcacaatgctagcacaccgcagccttgaactcctgggctcagggatccttgtgcctcagcttccagaatagctgtaactacaagcatgattttatttatttatttatttttttggtacagagtcttgcacctgtcccccaggctggagtgcaatggtgtgatctcggctcactgcaacctctgcctcccgggttcaagcaattctgcctcagcctcccgagtagctgggattacaggcacgcaccactacgcctggctaatttttgtatttttagtagaaacagggcttctccatgttggtcaggttagtctcaaactcctgacctcaggtgatttacccatctttgcctcccaaagtgctggcattacaggcgtgagccactgcgcccggcccatgatttttattttctgcgaaagagccaggaataacaagattcttcttagatttacacataaatttctcatctcatgcttaaaataactgtcaaaagatttgtttttactttatttgacaaaattttatatgtttatcatgcacaacgttttgaaataacatatgttgtggaatgactaaattgagctaattaacacttggtgtattactttacatacttattttttgttgttgtgagaacaccctagattttaagtggagattttctcttagttattttcaagaatatagtacacttactaactgtatcaccatgttgcacgacgtgttttaccttttttttggtcttttttttttttcctttttgtggagaacggggtctcactattttgcccaggcagatctcgatctcctgggctcaatctgtcctcctgcctgtgcctccctaagagctggaattacaggcgtgagccaccgtgcccagctgtttttacttttaaaggattctttaatagcattgttcacctataagtcagtctgtatttgtgaaaggcattggttttgaggatcaccgaaccacatgaacccgaatggataactatccaggattttatgctctttaagtcaaaagcatattgaggtggccattttgttttcaggatagtcttttttgtaagtttatatggaccaacctgataccacattccttttgaaaataagatagtatttatcagtatttcactttcatttgtcttatatttccacttatgttaattatgagtaaggatacttaattgtgtggcatgttgttgatagagaatgcagtcatgtaaaatcagtgtggtttttcttttcttagggaccccaatgattcctgtaccaatgagcattatggctcctgctccaactgtaagtataacttaaaggaggaatcatgagttatggtagtgctagtgcttttaagctgaacagcatgataaacttagataaattatgagtatttaaaagaataacaaggacagaatgacagcacccctgtagagcatatcatttatttgaataagtatcattttcacttaggtgtgcatatatgcagttgcccttgcaatgtgctccctaagtagataattctatgattttcctgttactatctagactcttcatatacttgttattacaaatttaggactttggctcttcattgccttctcatcttggtcctgggagatgggagaaggatgtgacatgtctgatctcttaaaagaacataggaatccttgtaaaaattaaaattttgaaatgaaatttgtgtggactaccttttacatgtttcctcctaccttcctaaggtatatggcctaaggcataaattttaaatgttcaagacataggccaggatcacctgaggccaggagttcaagactagcctggccaacatggtgaaaccctgtgtctactaaaaatacaaaaaattatctaggcttggtggtgcgcgcctgtaatctcagctactcgggaggccgaggcaggagagtcccttgaacccaggaggcggaggttgcagtgagccgagattatgccactgcactccagcctgggcgacagagcgaaattccgtttcagaaaataaaagtaaaaattatgtcttaaacataacaaagttttcttggttatttttgtttcttttttaagaagaaaggtaatctagtagtagaagtttacttgtcacaaataagtttgcattaatgaaatgtgctatgcactttaggagctttagaagtatacaagcatgcagagcttaaataatgtgctatatatatttatttaatcctgatgtttttagcctaatgttaattgtggtaggaaatttaattgctggatcaatttttattttgtttcttcaccttaggtcttagtacccactgtgtctatggttggaaagcatttgggcgcaagaaaggatcatccaggcttaaaggctaaagaaaatgatgaaaattgtggtcctactaccactgtttttgttggcaacatttccgagaaagcttcagacatgcttataagacaactcttagctgtaagttaaactgtttatttttcattaaaaatttttttatcattctacatttcaaacttaagcagaaagaagactttcagtgattgctttttattttaaaaaatttcagtcctgcagcaaaggtgaaaaagtacagtgaacacgtttgtattcttttcctagattcaccaatgaacatgtttagatattttatgtacacatgtgtaccacacacacttttttcttggataatttgaaagtaaattgtggcataacatttcacctgtgaatccttcatttatctcctaagagcaaggacattctgcgacataatcacaatgccactatcacacatgaaatttggccgggtgcagtggcttttgcctgtggttgtcatcctagtcctttgcaaggctgaggcaggaggatctcttaagctaggagttcgagaccagcctgggcaacatatcgagacacatctttacaaaaaattaaaaaataatagggccagatgcagtggctcatgcctgtaatcccagcacttcaggaggccgaggtgggcagatcatttgtggtcaggagttcgagaccagcctgaccaacatggtgagaccctgtctctacaaaaaatacaaaaattagccaggcgtggtggcgtgtgcctgtaatctcagctactcgggtggctgaagcaggagaatcccttgaacccgtgagatggaggctgcagtgagctgaggtcgcgctactgcactccaccctgggcgacagagcgagactccatctcaaaaaaataatgacagggattaaaaaataaaaataaaaaaaaagccaggtgtggtgatgcacgcctgtagtcctagctgttcagaatccgaggtgggagaattgcttgagtctaggagttgaaggctgcagtgagctatgatcttgtaattgcactccagcccgagcaagagagtctctaaaacaaaaaaatatataaaattgatataatattgttaactaatgcacatgtagttcatatttaattttcccagtaatggccataatattaatagttgttttatttttcatccatgatccaatgaaagatttttatttacttttgagacagatttgctctgtcacacaggctgaatgaagtggtgacatcttggctcactgcaaactctgcctcctgtatttaagtgattctcatgcctcagcctccctagtagctgggattacaggcgcgtgccatgacacctggctcatttttgtgtttttttagagacaaggtttcatcatgttatccagacttgtcttgaactcctggcctcaagcaaaccgcctgcgttggctttccaaagtgttgagattacacgcgtgggccaccacacctggctagggttaatattttgagactgtgagtccttttccccaatgatgttaaacaatgattttagcatccaatgatgattgactgattccttttaaagttttattctgagcttgaatagtaataagttgtttaaatttggtaagcttgttgattcactttttttacctttttaagattttatcttgatgatacatgtacattgttaagtgaaataatgctgaatgattgtataataaaataaggccaggtgcggtgtctcacacctgtaatcccggcactttgcggggccaaggtgagtggatcacttgaggtcaggagtttgagaccagcctgatcaacatggtgaaaccccatctctactaaaaatacaaaaattaaccaggcgtggttgtcggtgcctgcaatcccaactacgcgggaggctgaggcaggagaatcatttgaacctgggaggcggaggttgcagtgagttgagatggcgccactgcactccagcctgggtgacaatgttagactttgtctcacacacaaaaaaaggagtttggaagaatgactatattctgcactgagaggatctgcaaagatgtcattcttcgtctgtatcccagaatcttgtgtaggttctctgtaaggacagggccagggttatctcaacctgtggttcacctcatgagtagttcagtatgagtcctgcaatcttgccatcctctggaaatattgttgcctgctctccttatgcccctctgagatgctgggcaattactttacatcattcatgattcttgttcctcaactattcatatttaagaaattcctgttcttttagaagactggatctcctgggcactctgtaagttttaattaactggtttgaggatgttttgggtttctcagttttgttttcttctattacttccatgggatttttggtaatttcagtctgaagcctgactccatttttattcttgagttttctcctgggcttcttttcactgtagccacaaggcctaatctgaggtctgcagagaactagcacttactctgctctaatggaattcaggaaagtcagaaggtactggagtatagaaatgtgtttgctcctgtctgcttctggaagtctctgttttgctatgttattactgctaatgttttctccctaggtgtatgtgaaaagattctcatcacaaattctcatagaagtgccgtttctgagtcttagggcatgcttatctgcagctttacaagataattccacaccaatttatttatatttactgcagcagtgtcatgtccgagtttctattcttacacatcttttttttttttttttttttttttttttgagatggagtcttgctctgtcgcccaggctgtagtgcagtggcaccatcttggctcactgcaagctccgcctcctgggttcatgacattctcctgcctcagcttcccaagtagctgggactacaggcgcccgccaccatgcccggctaattttttgtatttttagtagagacaaggtttcaccatgttagccaggatggtctcgatctcctgacctcgtgatctgcccgctttggcctcccaaagtgctgggattacaggcgtgagccaccgcgcccggccctcttacacatcttttttaacaattggtgtttatttagaattttacattgtgttgtgaaataccttattcctatttcaatatgcctttttactgttcttcataattttgatattatctgttgacatgttatggtagcttgaggcctaaactgttaaaggcctcagtctcccttccctacttccttacaggtgttacaagatggcgaacttgataataagtattattatgtaaatagttttagcagaactaggttatgtgctatgattgtattttctttctttggtttgttttctttctttctttttttttttttttatttgagatggagtctcactctgttatccaggctggagtgcagtggcgtgatctcagctcactgcaacctcgccatccggggttcaagcaattctcctgccttagcctcccgagtagctgggattatggatgcctgctaccacacctggctaatttttgtattttcagtagagacggggtttcaccaggtttgccaggctggtctggtactcctgacctccagtgatctccctgcctcagcctcccaaagtgctgggattacatgcgtgagccactgcctagtccattttcttattttaattttttattttttatctttgagacagagtctcgctctgttgcccaggctggagtgcagtggcacgatctcagctcactgcaacctccgcctcccgggtcagtgattcttctgcctcagcctcccaagtagctgggatttcaggcacccgccaccacgtccggctaatttttgtatttttagtagagatggggttttaccatgttggccagactggtctcgaacttttgacctcaagtgatccacccaccttggcttcccaaagtgtggggattcttttcccttcttttctagagctcctcctgtcaggtccctttgttcgtctcatgtgttctggttcctctaagtctacttttatccttggatttttttctgtcttttctagtattccccttattgctgttctgtgttgggtggtttggatcctatatcttgcttgtgccgacacatagtagttcctgttatattgggatgatacatcctctgtatatgatgtacatggtatatatgggtatgtggttggtaacttttctgaatctaaatctgaagtgctttttatttcatgtggtcagtagtttaccgggatatagaattcggtgatgaagcttatcttcctcacattgaaggtgctgccttatcgtgttatagcatctaatgatggttttcagaagtcccgcatcattctgaatgctctttgtgtgtgaactgtttttccctggaatgcctctcctagtgaggatttgactgattggaggttttagttcctaattatgtgaaattcttcgaatgtttatttgattttcttatttttcttatatcattgtgttggtcacttacttggtgggccatttcgttctggagccttttttcaggagaaaattttgagctatttgagaattctttttactttcttcaggaactctgtttggatgttgagcttccaggtttgacctatgtgtttttgatttcctattttccatctcttactattttgcacgggttcttgggatttgtccttaactttaccttccagacttacattgaaatatttatttttaatgccatgtttcaagtttccattagttttctcttgttctctgaagatttctcacctacaccctcctccttctgtcttttttttaactggatggaactttattttatttttcttttttgagacagtctcattctgttgctcagactggagcatagtggcatgattacagctcactgcagcctcgatttcctgggctctagccatccatccgtctcatcctcctgagtagctgggaccactggtgtgtgccaccacgcccgcctaatttttttgtttttgtagagacagtgtctccctatgttgcccaggctggtcttgaactcctgggctcaagcaatccttccacatcagcctcccaaagtgttgggattatagacgtgagctacacctcgctgcttttatttttaaagtataatagtgtcctaccgttcagataacctgccctccttcacattttggaatatttctctttatttttacagaaagctgtttttgtttatagttagagtcttgctgtgtatctgcattttcttttcccaagttatttttgcataccgtatcaagcgttttcccatgttaatgggatggctgggcgcagtggctcgtgcctgtaatcccagcactttgggaggctgaggcgggcagatcacgaggtcaggagttcaagaccagcctggctaatatggtgaaaccccgtctctactaaaaataaataaaaaaaaaaaaacaaaaaacaattatccaggcgtggtggtgcctgcatgtagtcccagctacttaggaggctgaggcagaagaatcgcttgaatctgggaggcagaggttgcagtgacccaagatcacgccactgcactccagcctgggtgacagagcgagactccgtctcaaaagaaaaaaaaatcctttataaatacatacatattgtttcaaaacatttctttatagattcataatatttacttaaatttattatagtttgttttaaccattctaattttaggcatttaggtttacgtgtttattttgttaggataagtagtgatgcgaaacttttaataaaaggtaaacaatgttctgcaaatgaagaatcagtaagaatttatatttttctttaaatgatttgttgttcatttctttcatgtgataagtttgtgggaattgcaaaaattttcgcaaatgtagttgctggttttttattttatgttttttatccctagtagaaatataattttgcttttagttacattaaaaattattttgttaaatggtagcaatctgtttgttttgttttctttttaagaaatgtggtttggttttgagctggaagagagtacaaggtgcttccggaaagcttcaaggtatgtcatttttttccttatttgctgaaatcactttaactaacctgtgtgcttaaatcactttgcatgacttaactctcattgtctttatcagtaagacttattttattagcactctttgtcctcttttttattgaaatagggttaaaaggcagtttgggaaaatattggctgagaattgagatcagaaggaggaaaaaggtgtaagaggaaaggaaaaaattaaaattgctcaatttaactggtttcttgttctttcaaaagtctcttttgtctcaagaaatgactgcatgatcaaaatggaacaattagtaagggagaagaagagacaatcatggcctgttaactttttttttttttttttgagacctagtctcactctgtcacccaggctggagtgcagtggcgtgatcttggctcactgcaacctctgcctcctgggttggagcagttctcctgcttcagcctcctgagtagctgggattacaggtgtgcgccaccatgcccggctaatttttgtatttttagtagagacggggtttcaccatgttggccaggctggtctcaaactcctgacctcagatgatccacccgccttgacctcctaaaatgctggcattacaggcaggagccaccacacctgacctcaaatgttaattttttaaatagttgatttgattcaggttctatatgaagtccacacattgcaactagttggcaatttgttttaagtctcctaattttttttattagcaccatcctctaaccaactgagctaactggccagactcttaatattttaagttattctatttctaattttccttgcagtttatttgttgaagaaactgggtcatttgtgcaatagtattttttaagttgagttttgctgaatgcagctccagtactataatttgccattaatctatcctctgtgttttctgtaaagtggtcagtagttgtacttgatgtgtgctgtgtggtggtttgttttgttttgtttgtgttttttatttttttggaggagtttcgctcttcttgcccaggctggagtgcagtggtgcgatcttggctcactgcaacttccacctcccaggttcaagcaattctcctgccccagcctcccgagaagctgggattacaggcacgtgccaccatgcccggctaattttttatttttagtagagacggggtttctccatgttggtcaggctgctcctgagctgctaaccttatgatccgcccacctcagcctcccaaagtactgagattataggcacgagccactgctcctggccgctatttttttttttaatgtttttattctagcaccttatagcaagaatactataaaggtagtattcttccatcagggaacacatgtgagattgtcttttttgtatgtgtaatagcatcagtgttgccagtgcctagattgattaattcattaggaagtaattcatcagtagtcttttttcttttttttgagacagagtcttgttatgttgccaggctggagtgcagtggcataatcttggctcactgcaatctccaactccctgattcaaacgattctccagcctcagcctcccgagtagctaggattacaagcatgtaccaccccacccagctaatttttgtacttttagtagagacagggtttcaccgtgttggccaggagggtctcgatctcctgatctcgtgatctgcccgccttggcctcccaaagtgctgggattacagacgtgagccaccgcgcccggcctcatcagtagtctgttttgaagaattctgtcattcttttattgaggaacaaatctttttcatatattagtagaatgcttctctatggagaaagttgcccctgcatctactgtttggtaacttagaggcatttttgttgttcttgagatggagtttttcgctcttgttgcccagactggagtgcgatggcaccatctcagctcgctgcaacctccgcctcctgggttcaagtggttctcttgcctcagcctcctgagtagccaggattacaggcgcccaccaccatgcctggctaattttttggtttttttaatagaggcgggattttgccctggttgccaggcaagtcttgaacacgtgacttcaggtgatccgcccacctcagtctcccaaagtgctgggattacaggcttgagccaccatgcctggcatagaggcatatttaatacagaataggcaggatagatgcactggcttgctttcttaaaacaatgagttgctatcctcagcattctctagcagtgactgattttcttttttcttttgaattattgtgaacttaggaattgaagcatatttagtgttattgtatttaatatggattcattgtagttattatcaccattaaagcttaacttaaattgtctctgcactttacatctccagtggttttgacatgaccctgaacacctttgacagctgctttgttatctggtatgacaatttgttctaaggtcatctagtataataggttttcggccccagacttagaatcagccatttctccaggggaaattgttttgaagatcacgatctggacactaggtgcactcatattaacagtggtttgggatgggtgtggtggctcgagcttgtaatcccagcactttgggaggctgaggcaggcgggtcaagagatcaagaccatcctggccaacatggtgaaaccctgtctctactaaaaatacagaaattagctgagtgtggtggtgcgctcctttagtctgagctactcaggaggctgaggcaggagaatcgcttcaacccgggaggcagagtttgcagtgagccgagattgcaccactacactccagcctggtgacagcgcgagactccgtctaaaaaaaaaaaaaaacaaaacagtggtttggtgtttgcttttaggtttttccagtgtatactaattcagattcaggactaaaaggtttttatttagcctgttttgtcatatatttgtatctcctttttccccacactgaggtccccgagtttcaaggccattggggatgataaactattaattactgagttgctttatcttgcattgcacatataacagtttcacactaacaacattgacactatcatcagcaatatgatcatttaaaattacttttctttttttttgagacagggtctctgtctgttgcccaggctggagtgcagtggggcaatctcagcttactgcaacttctgcctcccgggttcaagcaattctccttccttagcctccctagtagctgggactacaggcatgtgccaccacacccagctagtttttgtatttttagtagagagagggtttcaccatgttggccaggctggtctggaactcctgatctcaggtgatctgcccgcctctgcctcccagagtgctgggattacaggcatgagccactgcgcccggcctaaaggtacttttttgaggggcatatctgtttgtctttatggtatatcacactgaaatgtcaaatttactattttaatatcagtagtttttttctgtttcctgtcattatatacatatttagatttatttgattttattttcaatttgttggttgctcttcttagatttaattttgttttaatatttctgttaaagtcatcttaatagtgagattgactagttataaaaggaaatagatgtaagtaaaatagactggtaactaggatacaaattctgtaatttaacatctcagaattgaaaagtgcattgtttgtgttcctgcagtctgttctttcttgtggctgtttggaagtctagatagggtgaatttatgaaataattgactcctttctttttttttttttttttgagacggagtctcgctctttcgcccaggccggactgcagtggcgctatctcggctcactgcaacctccgcctcctgggttcacgccatactcctgcctcagcctcccaagtagctgggactacaggcgcccgccaccgcgcccggctaattttttgtatttttagtagagacggggtttcactgtgttggccagaatggtctcgatctcctgacctcgtgatccacccgcctcggcctcccaaagtgctgggattacaggcatgagccaccgcgcccggccaattgactccttttaatcatgaatttcattgactctgctaaatattttattagagcttctaatgagtagcagtttgtctgatttgaatttttcttcctctctgtttttccctttttttcccctttggttgtttgaggatactaaaagtgaaatggttatcaaagggaattggtggacaggggtggaattatgaattgagtggtctttgtattaaaacatttggactctagtgattctacttttccataattttttttcttttgtaagtgaattggtatttcactaattgttttcatccattgctagccttcggattctgtgagtacaaggagccagaatctaccctccgtgcactcagattattacatgacctgcaaattggagagaaaaagctactcgttaaagttgatgcaaagacaaaggcacagctggatgaatggaaagcaaagaagaaagcttctaatggggtatgttttctgtcgtgttatcttttctaggccagactgtgctatttcagtgtagtgcttctcattataaatgaatctaatatggggcttcaaaagatcatcatgtatgtgcttgtggcttaatgtaggagggtattttatagtttgtagttattttaagtcttatctgcccatagtgggtggatgactgttggtttgcttgttccaggttgggatgaaagtagtaagggaggctggacaaggttaacttgccagagaaagcactggtacagactattccaaacagagctaattcattaaggcagctttgtaagtaagtacaaaatatatttcaacctacacaatttttattagtttccctctcttttagaagtacaccgactctaaaatgaatgaaagtctgattacttgccttaggttgggggctttatccaagctctactaagtgaagctaaaataaaggacattgttgtatattgtattttaatgtatacattattacctcctcagcaaagtgaaacatagctaaaacttgagtatatatttccttcatttctcttcttagttcctttttggcatctcatgctgaacaaatccaaaatagatttattaatgccttcccccaacacaaacaaaaccagaagagtctttcgctgtcgtcaaatttttattatctttcaaaatagaaatcgctttttgctgggcacggtggctcacgcctgtaatcccagaactttgggaggcagaggcgggcagatcacctgaggtcaggagttcgagaccagcctggccaacgtggcgaaaccctgtctctactaaaaatacaaaaaattagcctagcgttgtggtgggtgcctgtaatcccagcaactcagaggctgaggcaggagaatcgcttgaactgcagaggcggaggttgcagtgagctgggatctagccattgtactccagcctgggcaactagagtgaaactctgtctccctgctgccaaaaaagaaaaaagaaatacctttcatgttccctccaagttctttgttaaaaaaaaataaaaaccaaacccaaaaaactcacaaaatgaagcaaagtataaataatcaattaaataccacctgtaatcccatcatcataagcaacactgtaggcggtttggatgtatgttcttccagacatttttctgtgtatgaatgtggttcatttgttttttgttttttttgagacagagtctctctgtcgttcaggctagagtgcagtggtgcgatcttggctcactgcaacctctgcctcccgtgttcaggtgattctcctgcctcagcctcctgagtagctgggattacaggcatccaccaccacgttcagcaaatttttgtatttttagtagagatggggtttcatcatgttggccaggctggtctcgaactcctgacttcaggtaatctgttctccttggcctcccaaagtgctgggattacaggtgtgagccaccacacctggccaaatgtagggttttgtttgtttgtttgtttgaaatggagtttccctctcttgcccaggctggagtgcagtggtgcgaccttagctcactgcaacctccacctcccaggttcaagtgattctccctcctcagcctcccaagtagctgggattacaggtgtccgccaccaggctcggctactttttgtattttcactatgtaagtgaggctggtcttgaactcctcaccttaggtgatctgtctgcctcagcctcccaaagtgctgggattacgtgtgagccactccacccggtcagcattgcctgtatttctaaaacataagtataattttatgaaactcttgcttatattatgtgagacccatccttaatggttttggatttcttacagaaaaaagtaccccccctctttttttttgatgcagtctcgctttgttgcccagactggagtgcagtggcgaaatcttggctcactgcaacctccacctcccaggttcaagcgattctcctgctttggcctaccgagtagctgagattttaggcacccgccaccacccccagctaatttttatgtttttagtagaggtgggatttctccatgtcttccaggctggtcttgagctcctgacctcaggtgatccacccacctcggcctctcaaagtgctgggattacaggcgtgagccaccgtgcccggccataaagtccatatttttaggatgacattcaaggctcactccagtccacgtttctagcttccgtcttccctcccctgcacatactactgcatgtacctccacagtcttcccttttgctttgctggcatctcatgtctttgttgcctatccaagctccctgttgaaattctatccatacttataattaacatgtcccttgattcatacagactttatcagcctgcccttagtttctgtcagacagaattaagtcctctgttcccatataaagcagatctttatagctgttttagtagatattgtttatatatctctctctttcacagccccttgtaacccatctcattcccatattctctttcaacccccatctctgattacagatagaaagggtgataagtttgtgggctgtgtctctttaatcttgtacctccacagcatctaggacagtgtcttgcctaaagcaaggatggaattaacatttgttaatagacgcttatctgtcagtcttactatcctcaccctgcttcataaggaaattatattttatttatattttatttcaaatcagtaatactgcctgtcacatcactaaaacctcaaaaaacagaaatgtttgaaataagaattttcaggtttgccttgtgataactgtatactaactagttgaaagtatggattcagtatcttcaaagtgttctgatttgctaggactcactgttttcttgtgtttaatcttcagtttgtgaggtcatttaatttgtagcatttgcaaatgttatactgaaaaactctgagaatgaaataagtcactatactacgtatttttataaataaggaagtgcacaattatgtgacttcacatttcttgcttgcttgctttttttggggtggggacagagtgttgctctgtcacccaggctcgagtgtggggtggtgtgatctctgctcactgcaacctcctattcccaggctccagtgatccttctgcctcagctgggactacaggtatgcaccaccatactggctaagttttatattttttgttgagatgaagtttcactgtgttgtccaggctggtcttgaactcctgggcttaagtgatccacctacttcagccttccaaagtgctgggattacaggcaggagccactgtgtccagcttacattttttgtataatcaacattagccagagtaaccacactttagatctgttggtcttcaggaaaagcaatatgtgtctggatgtggtggctcacacctgtaatcccaacactttgggaggccgaggtcggaggatcacctgaggtcaggagtttgaaaccagcctggccaacatggtggaactccatctctactaaaaaaaaaatacaaaaattagccggatgtggtggtgcacacctgtaatcccagctacttgggaggctgagacaggaaaatcacttaaaacccaggaggcggaggttacagttagctgagattgcgccactgcagtccagcctgggtgacagagtgagactctgtctcaaaaaaaaagcgaagttacatgcaataaaatcacacagaaaaattatttttaataaaaaattaaaacaattgacagatatcagttatatgatttattgttccaactgttatatgtgtatttctgagtgccctttggcttcttgcccggtggtacttgaagtcataggataaacatggcatattttccttaagtgtcaatattactcaacaaatataggttaaaaaagcattctatctgatgtaaaaaaaaattttcaaataacttaagcaaatattactatatagtggagtagattagagatttgccatgattttttttttaagggtggtggggggtgtagggagagatgaaagtcggagagtgagagattggagggagggagcagggggaggggagaagatggtgggggtgagatgggtggctactgccgccatgatttttcagtataaaaatatgacatggtgattgttttttattcttggtcgttgattagttggagaaatttagaaagctgttaagtagaggataggagaatgagacattgaaaaccctttgtgttgctttattaggcattttcctctgaggcagaagagaaaacaattagttccttatttctcattgactaaaaaggaaacatgagtttgtctaggggagcaacatatttttcatgatccagaatttttttttaaattttcttgcctttttttttttttaattaagttttagggtacatgttcaccacgtgcaggtttgttacgtatatatacatgtgccatgttggtgtgctgcacccattaactcgtcatttaacattaggtatatctcctaatcctatccctcccacctgccccccaaaattttcttttttttatgagatggggtctcgcgttgttgcccaggctggtgtcgaactcctgggctcaagcagttctcctgcttcggcctcccaaagtgctgggtttacaggcatgagccactgtgcccagccagattcagaattttaagaagaattttgcgcatgtgtaaggtgtcttgtcaaacaacttgactgaacattttaatttagattttgcagaatttgcaggtgtaactttttttctttccatttcttattgacctctagtagtaaagtattccatgtgaggtggccatgctaatttagttcatgtcctattgctttctggctgtccagcaaaaatagtataggagacaatatatctgcttgtatgtcacaagtcatagttattaaccatatattcaagaatgaacactgacaagtgctggaaaaacagttattctctggaaagaacctatttaatagaggacagctgcttcaggggaacatctttggaaattagcctggctgagtacattttctcaaaagaaagaactctgcatttccttaaattttttaaaaggttcgtactttggattctagacctcagtgccaaagaatgagcccagcagagctgtttaacttcacagctactagctttactattgaaattttaatttctctgaaaagaaccaactaggtgggccatgtaaacattacagataatctgtcagcttcctatatggctgaatccttcaccttttgtttcccagtattactgattatgctttctggtttctccctctctgcccaccgaagtctcactcttgtcgcccaggctggagtgcaatggtgtaatctcggctcactgcaacctccgcctcctgggttcaagcgattctcctgcctcaacctcttgagtagctgggagtacaggcacccgccaccacgcctggctaattttttgtatttttagtaaagatgggtttcgccatgttggctaggctggtctcaaactctggacctcaggtggtccacccgcctcggcctcccaaagtgttggggttataggtgtgagccaccgcacccggccatctggtttctgaagtataagaaaaaaacaggaaatcagaaaatcgtgtatagttgatattccagagatagagctttagatgaaacttgccagtctgtggagtggtctttctaacctgatcatctaccatgatcaggttttgttttttttttttttttttcttgagacagagtctcactctgtcgcccaggctggagtgcagtggcgcgatctcagctcactgcaagctccgcctcccgggttcacgccattctcctgcctcagcctcccgagtagctgggactacaggtgcccgccaccacgcctggctaattttttttgtatttttggtagagacggggtttcactgtgttagccaggatggtctcgatctcctgaccttgtgatctgcctgcctcggcctcccaaagtgctgggattataggtgtgagccactgcatccggcctaggttttttgttgttgttgttattgttttttttttaaatattagcaatcagttaagatttttgggttaataaacttttcttctaaaaatgtgaattagttaattccaaatgctttatctctaatagtaaaatagccatattgatatttaaattttggtttacagtggaaacaataatcaatttagggtctataaggattttttttgtcttttgagacggagtcttgctctgtcgcccaggctggagtgcagtggcgtgatattggctcactgcaatctctgcctcccgggttcaagccattctcctgcctcggcctcccaagtagctgggaccatgcccggctaattttttgtgtttttagtagagacggggtttcaccatgttagccaggatggtctccatctcctgacttagtgagccgctgcacgcggctggggaatttttgtatttttttagtagagacggggtttcaccatgttggtcaggctggtctcgaactcctgaccttgtgatccgcccgcctcagcctcccaaaatgctgggattacaggagcgaggtgtgtgtgtgtgtgtgtgtgtgtgtgtgtgtctgtgtgtgtgtgtgtgtttttgatgggggtggagacagagtctcgctctgtctcccaggctggaatggagcagcatgatctctgctcactgcagtctccacctcctgggttcaagcaattctcttgcctcagcctcctgaatagctgagattacaggcacatgtcaccatgcccagctaattttttgtatttttggtagatggggtttcaccatgctggccaggcaggtctcgaactcctgacctcgtcatctgcccaccttggcctcccaaagcgctgggttgcaggcgtgagccaccgagccctgccaagtggttagttttgtaataacatgtaatgccttatatttaagttatctgtgtcataacccatctgttactctgtagtgatacagcttgaggagaagagagcgtttttcaatttggattttattccgtctaagtgcagcatctttctcacagtatgctcttaagaatttgttgatgggtgtggtcgtcacgcctgtaatcccagcactttgggaggctgaggcgggcggatcatgaggtcaggagatcgagaccatcctggctaacacggtgaaacccccatctctactaaaaatacaaaaaaattagtcgggtgtggtggcgggagcctgtggtcccagctactcaggaggctaaggcaggagaatggtgtgaaactgggaggccagagcttgcagtgagctgagatcacgccactgcattccagcctgggcaacagagcaagactccgcctcaaaaaaaaaaaaagaatttgttgagcaaattaatttaagaaataaaatgtttgttgaatacgtatccattggagacagctttcagaatgcttgtggtcaacttataaagttactgctaagttacattgttaaggaggcacaaggcatgaaactcaccttgaatagagttgcaggaattatgaccaagagccaggcatgtatgcacatgagcatggttcttgtatgtatctgaaaatgtgcacggtatatgtttaccaagtaagtcgttaaaaactttggggcatgcacaactattgtagcacaactattgtagcacattagaagccaacaattttccccacatagagggaataatctagacttcttagaaaataataattattattattgagatggagtttcgctcttttgcccaggctggagtgcagtggcgtaatctctgctcactgcaaccactgccttccggttttaagcgattctcctgcctcagcctcccgaggagctggaattataggcatgcaccaccgcactcggctaatttttgtatttttagtagagtggggtttcaccatgttggccaggctggtcttgaactcctgacctcatgatccgcccccgcctcggcctcccatagtgctgggattacaggagtgagccactgcgcctggccagaaaattattgataaagacctacaaatacttactttgattccttgttagggttgtaagtgtatggtttctataagtggtatgtattcctgcattataagcactcgtagaaagcaaataggaaataagccatcattacagcccctaaactcccgattcttgcagtttggtatatttagcaatctgatgtttttgtttgtttgtttaatctacatacaattttgctttttctgagtggtagctatcacaattaacttaaaattgtattttgcctttactacgtaactgaattttcaactgtttaaaagagtcgttactatttgtgtacctattgagcaaaacagtctgaaaacttgtgaatggtttgcagatgtgtcgtatagtgtgctagtcctgaaatttagggaccagaattttttagctattaagaaaaagaaaatgaaaatgaagtagtatctcaggaatagttaaataaaaaaatgaagcttttctgatgttaagaacaaaaccaattctgtgtttaataggactacagagatgtttttgagaaaacatgtatgtttattaactcttgttgtagagtgattttgattttcttgcttgatttttctttcccctgaatttgctgttttgtttaagaatgcaaggccagaaactgtcactaatgacgatgaagaagccttggatgaagaaacaaagaggagagatcagatgattaaaggggctattgaagttttaattcgtgaatactccagtgagctaaatgccccctcacaggaatctgattctcaccccaggaagaagaagaaggaaaagaaggaggacgtatgtgttctgacaacaacatatcatttctaccgtttgttttttatgatatcactcttatactttgattacatgtcagttttcttttttcttttcttttttttttttttttttttttgagatggaggctcactttgtctcccaggctggaatgcagtggtgcaatctcagttcactgtaacctccgcctccggggttcgagcgattctactgcctcagcctcctgagtagctgggactacaggcatccgccaccatgcccggctaattttttggtttttagtagagacggggtttcaccgtgttagccaggatggtctcaatctcgtgacctcgtggtcgacccgcctcggcctcccacagtgctgggattacaggcgtgagccaccgtgcccggccacattttaaacttttttacagagacaaggtctcactatgttttctaggctggtctccaactcctgggttcaggttatcctcctgcctccgcttcctaaagtgccaggattacagtcatgagccactgcgcccggcccctattttactttgtttgcctatggttgttctgtctctgttctaagcaagaaaccagatctgattcactgaagatttccacccactcttaatttttagctgcctttccttaagaaactatgtcacattcccctccctgaacaataatggtattgaataatcaaactggaggattctgaaagagcagtacaacttgaaacattcctcctcagtgaattgattgctacctctttgtggccctaagctaattgtccaggttgaaagaaaaggtttagttttctcatacttatttcctttggataaacttagataaattataggaagtgttcttttaaaaatactggaagaagccagaagtggtggctgacacatgtagtcccagcaacttgggaggctgaggggagaattacttgagcccatgaacttgagtctagcctgggccacagagcgagacccttctataaagtaagaaaaaaaatcccacaaatattggaagtgttttatttatgtttttgagacagtatcttgctctgtcacacagactggaggatggtggcgcaattacggctcactgcagccttgaatacccatcctaaagtgatcctcatgtgttagcctcctgagaagctgagactataggcatgtgctaccatacccagctaatttttgtattttttgtagagacagggtttcaccatgttgcccaagctggtgttgaactcctgagctcaaatgatctgcctgcctcagccttccaaagtgctgggactacaagtgtgaatcactcatagctggctcaacgtgttttatatgcatgcattatgtaataaaaaagtactacgtggtatatatattatgattagttatgaatggatggttacattttatattattttaaatttcagtgcctttttaggccatattcagttttctttgtggccagatacatacatttttattatttggtatgtgtttcctcgtttggtcatagaacttttcttttttgttcccgcccctacccccacccaagacggagtctcactcacttgcccaggctggagtgcagcagctgcgatctcagctcactgcaagctctgcctcccgggttcaagcgattctcctgcctcagcctcctgagtagctgggactacacgtgcctgctgccacgcccagctacttttttgtatttttaatagagatgggtttcactgtgttagccaggatggtctcgatctgctgacctcgtgatccgcgtgagccaccgtgcccgacccataacttttctaaggaggtgtattctgttaggaatggtaattggtagggtcagtaaggtacagggtaattgaggcctgtagaattcattcttcctctttcttcattagtgggaaaggagaaaaataacatatttgtttgatgtggattgggaggagataataaattcttcctctgtggcaggagttatgggtaaatattgttggtatgattagaaagccctgctactatgagagcaccttctatatttccatttcttgggggtgttggagtatccagagaggagggtagtgtgtgatcagttattgtaaaaagagtgaaatcacttctattcccaagtaatttgaaatcaagaaagcatcacagaagtgtactgtattgttcacgtcataaatgtatagggcattgctttgcagattagtatgagctctgtttttcttttttaaaaaagattcttggtggattttttcacagattttccgcagatttccagtggccccactgatcccttatccactcatcactaaggttagtttaaattgtaggctttgacaatacctgtgtttactgctgattgttgatttgtcattcttgtctatctgatttttcactatttaactttagattgttagatttgttattgtggatattctgtttacttatttactctttgagacctatacagaatatctaacctttaactgtttatattgaagtagggtgttctttattcattccctcctgtgcccgttttcttttaggaggatataaatgctatagaaatggaagaagacaaaagagacctgatatctcgagagatcagcaaattcagagacacacataaggtagtattcttgtcttttcacttgataccaatctagactttttacagaatccaaagcaaagagacaaaaaaaatcaaccttaaattagaatataattttaaatgttttttataggtttaattgatatttagatagaaaaaagaaacagaagaccaataccatattaaagtggtccttgacatgttgtgcttagttttttcagttactgactattctgcagtcatctcactttaatatgaatagaagctaattttatttttagatttcaacataaacatcaaggtcagacttaaattagattcagggggcagcaggataacatacactgtagtgtatttctgggggcagttatttaacttgatcttaggaataccttttctttagagctgagattaaaatttacattttatatttgtatagatttaagttgagtgggggagattttaaacagtaggtcagtggttaccagacttaccaaattttagatgcatggaagaactgtaaattcccataaagctaatctattcattgacccccaccattatgatagagatcatatggtgactaatgcaagatgaaactctcagcttggaaagtaacaaggaataggatgtaagtatgagcttctgttttttattatatttatggatgccccctcagaaaaatatgcaaaggggtaactggcttggaaatgggtatttatgcatagtaaatcccactcacgagttttgcctatttgaagcttctctcaatgacagtgcatctgtgaatgttcgctggtgttgaaaatgatgcttttgaacggtgcaatgcaaacactgcatgaaatgtattttgatggtcgagataataaggtgttgctggttcttactgatagactgagagatctttaactcagtgaaatgttaaatgttcattttctcttttattcttactttttcccattgctttcaaaatctgcagttcacaaataatgccaatgaatcagtgctgctgaacacttactatccagatgcccagcccttgctcacaaacacaatgctttttcaagaattaaatgtgtctaagagcacaaacataattctcccaaaattaattttgagagttgaaaaggtggtctatgggaaatcattttagatgaataattttggttaggtataatactgaaattcaggaccgagtaagcttaaaaatggtatatggttgtgtgtgtggtttaccccctttttgtttttatttatttgttaaaccctgtcatgttattggtaaattatgaggaaatcatgttttaagaaaaattcaaaaatatatttgctttaaagtttgggaatctgttaggcattttactgccttagtattatttcactggagggaatgttttgaattttcagaatgtcttttcaaaataaaaagaaatcaaaatgaaaaaccaaaacagttgttttttattgggtggtttggctaaaagggttgtttgaaactccagtaacaaaaaatgagctcagtgaacctttgcatgttttggtatgagtttattaaataaccacagactgtcagggtatcagcgtggcagggggcgtccatttacagcacggatgagtctgaagagagaataaggtaagatttatgattttttaatctgtcctttcctcttcatgactttcttacataattttagactcacctcatttcccttctccagtctttctttaaaaatatacatgtatgtttacatgtatacctgtatttgtatacatgtgtgtatatatatatatatatatatctcatatataaacttcaggaaacatttagtatggactagattcactcactttttcatttacttagaaccaaacttttgaaatgagttctgaaacaaatggttatttatataactgaatataaggagcacagtgaaataagcaagaattaaaaattgaggaattctacaggaaaaattagtattggaacagctaaaatattctgtaagtatctatttcagaaataaacaaatttctttataagtgtatgccattgaggtaagttttatatagtctagcctcattttacaatataaatttttatattcattggaactgtttcagaaatgagatttttccccctttaatagctgttagtttctgtcctctttctatcatatcttatttcatccctttgtaatttcaatgtattcagttttgactttgcccgtattctacttcgatatagactggcacagcaactgaatatattgctcatacattagctttcctttcataacctgctataagttctctgatccatgaggaagagaaaaagagtatctgacaggtaagattgctttttaaagttgttttaaatgcattacatgactgagaaaagaaaaatgcacattttattgttgcagtttaaaatttcattttggtgaaactaaacgtgaaacaaaagggataaatgtgttttgttttgttttgttttacctgtttggggtatttttttctgagtttgtgtagaaaccgtgtggtacactggtaatcttgtcagggtacaaacttggtctgactttgttatttggtttatttgtgaaccatgtacttgctcttcctcccagaaacatagcttgtaggcaaggttaatccagtgttggcgatccatgtcctagcacagcatctgtaagttaatgcacaatcgttccttccaaggatggatttatcattgtaaatatattttcattgtcttacaggcataatgggcataagtatgttgcttttaaatattttaaattaaactattacagttacatatattttgcttgaagtgagtgattttcaaactttttgtatttggtgggctgtccatcttgtaatggtgggagtaaatgtttccatagatgataaggcagttcttggctgaattcagcttgtgtttcttttggagggtgggcaaatcagagggcagagattatttagttgcattataggtattcttctataccacttgccctttgaaaccctcaacttgaggtaatgtgcagtctggggttttaattagtattaataatcttgtggatttacagaaatctataatgcacagagttgagttttaaccaatgatcgtattcatagaaaatatttcgaaccaccacattcttcatggtcattttagttagtacatagtcattgagtggccagccacacctgacacaatctcccagcatccaagattggagattcctggtctgtgtagagtatatggttttgcacgaaatctttctagtcttgtgattgcttcagtttaatttgtcacataaaaccacaagtatttaatattaatgtatcagtggtttggtgtttttgttcccagtactgggctttgcgccgggaaaaatctgaatactggagctacagagttaactctaaaagtgcttttattggtttctagaaactggaagaagagaaaggcaaaaaggaaaaagaaagacaggaaattgagaaagaacggagagaaagagagagggagcgtgaaagggaacgagaaaggcgagaacgggaacgagaaagggaaagagaacgtgaacgagaaaaggagaaagaacgggagcgggaacgagaacgggatagggaccgtgaccggacaaaagagagagaccgagatcgggatcgagagagagatcgtgaccgggatagagaaaggagctcagatcgtaataaggatcgcagtcgatcaaggtaaggctttacagaagttactgtttcctgatagctttaagaaaactatcgggtagtcctccagagtaccatttgcattcatggaatgagaacttttgtgtgtgtgtgagacattctcactctgtcactcagcctggactgcagtggctgagcaatctccgcctcctgggttcaagtgattctcattcctcagcctcccaagtagctgggattacaggttcataccaccatgcccagctaattttttgtatttttggtagagatggggttttgccatgttaatcagcctggttttgaactcctggcctcaagtgatccgcctgcctcagcctccctaagtgctgggattataagcgtgagtcactgtgcccagcctgagaatttttttagagacaacatggtctttgtctgtctgtctgtctgtctgtctctctctctctctctctctctctctctctctctctctctctcacacacacacacacacacacacacacacacacacacacacacacactctctctctctctctctctctcactatgggtaaaagtaataattttcaactctggttaatttctgtctgaagccactttttatagaaacacagtggccactcaatgttctgggcagacatgactccctgctgtctccttgggtccgtgggcatttttaaagttgctctttttgttgaagttctgtatactgagacatcagctctagcaccacgtctttttagcccctagcatttttatttgtttttgtagcccactgcactgccatagcttaatctttctgtctataaatttactatctacctctacctctggctcctagtaattttactctttggaaggttttattttttatttaaaattttttaattatattgatttttttttttttctgagacaagtttttgctctgttgcccaagttggagtgcagtggtacagtgttggctcattgcaacctttgcctcccaggcttaagcaattctgcttcagcctcccgagtaactgggactacaggcacacaccactgtcccggactaatttttgtattttttttgtagagtctaggttttgctatgttgcccagctggtctcgaactcctgagctcaggtaatctgcctgcctcagcctcccaaagtgctgggattacaggcgtgagccaccatgcccggccttatattgaattattttgatgagtcatctcactgttgaataatgaggtatagcaaacatgaacaaaggaagaggagaaagcagcaaggaagagagaaaaagctcctttttcttcaggctagtttaaaaatatacattactgtgttgcagtttcttacttgattatggctggagggagttccactttaggtcatttcacctagttgctagaactggaaacccagagctctcaaccttcagtaggcattaaaattatttcattctgtccattcctgatacagtcattgagaggttggtatgtgtaaaatccatctcttatatttatggcataagtgtatccataaagaacatatttcatatatacatattaaatacacacacacacacacacacacacacagagttatttgattagatccttggtatcatgctgtatgtaatctgcagtttggttttattacttttttttttttttttttggagacgggctggagtgcagtgatacagtcataggtcactgtaagctccaagtcctgggctcatgggatcttcccacatcagcctctggagtaggcaggactacaggcacgtgccaccatgcctcctggcctcaagcaggcctcctacctcggcttcttaaaatgttgggattagattttatcactcttaattaaatatttgagaactttcagtgctgatacttataaaagttctaacttaatccatgcaacatgtcagaattctgttttccacatgtgccagcacttactccttgatctctagtaagctaaactatctcttaacatattcattagtccttcatatttcttttgggaattaagttttccttttttctgttttacaccatcaggggattgactattatttcagtatatgatgggcattaactaaccattcattttaatgatttataactattttatattcagattgtatttgttttctgacataccagtaagcattaggtattagaatgcattttaggatttgggactgcaatttatgtctttctgatgagtgtagaggaggttacatagttttatggaaatcaagtgctagattctggcctgtgagattttatattatttcataatgtatgttgtcctcctttactttggtcttgaaaacagaaagtagactgacagatttgtaaaatattttgtttacattagagaaaaaagcagagatcgtgaaagggaacgagagcgggaaagagagagagagagagaacgagagcgagaacgagaacgggagcgagagagagagcgagagagggaacgggagcgagaaagagaaaaagacaaaaaacgggaccgagaagaagatgaagaagatgcatacgaacgaagaaaacttgaaagaaaactccgagagaaagaagctgcttatcaagaggtaagttgagaaaatgcctttattcttaaatcttggtatcccttaataggttaatcaatatttatagaatgctatgtataaatttttaaagctttgaaaatttaatttttttagcgccttaagaattgggaaatcagagaacgaaagaaaacccgggaatatgagaaagaagctgaaagagaagaagaaagaagaagagaaatggtaagattctaggctaaaataagtgatttttcaggtaaaaagtcagattgtatctttactgctaactacaagtaacttaataattgaaatgcacaagcttctctattcatgtataatttaatttttatgtattttgagtaattttgagccaatttaagtacaccaaaatcttttttcctcttcaaatttttgctgcatctaaagttatctttttgtataccatcaaagtaaatttgtcatatagtaatatttaagtcaagaatttattaacttatttttaagaatctgcatatttttaaaattgttgaactgttgttattagatataatagttgcatttgaaattccgtaagttaagagattcattttatctcatggattgtttactattggtttagagttggggggcattacctttaaattgattgatgaacatgatttaaatttctgcgtttcttaaaaactatttcttatagtatcatctaccttaaaaatggaattaaaaaccatatacatatacacatatacatacatgtatacatatatatgtatatactttttttttttttttgtggagacggagtgttgctctgccacccaggctggggtgtgatctcggctcactgcaaccttctcctcccaggttcaagcgataagcgattctcctgcctcagcctcccgagtagctgggattacaggcgtgtgccacaacacccagctaatattttgtatttttagtagagacggagtttcaccatgttggccaggatggtctcaaactcctgtcctcaaatgatctgcctgccttggcctcccaaagtgctgggattacaggcgtgtgccaccacgcccagccatattttttcgtttaataagataatctccagttttgttggtgtgcttaggtattgtattttgaagattatattcaaagagcatatttattgtagcgtagcgtatatatatagtttgcattttacagatgcgtcctcattcagacttttcttagaggtaaaaaatttaaaatgtctaatgtgacctatacttaatatatggagtatatgaaaactaaaatttaagaggacaagaaaaatcttttttttaaccaaagtattattatatttattatggcatagagtggtattttatacatatctcattttacagtaaaaacattttatgtacaactgtagagagatagctgcacagatagctccaacttaaattagaaaatattttctctatagaaaataataaaaacaccgtttcccaggctagcccaacaagtttatttaaaccaaatagctgaatacatatacatttataaatatggtttgaattctgggatccaggagaaactttagtttcatttattgaaacggccatgtttgtcttaaaattatgtgaagagaaattcctataagtctccctcttactcttggtttatgtctgggtcagaaaaatctgtttacacaaaaaagggaagagtaatctttattacttgtatgttaattttatacattgtccttatttcctcaaaggccaaagaagctaaacgactaaaagaattcttagaagactatgatgatgatagagatgaccccaaatattacaggtaaagaaggcttgttctgtggattcatacttggttttttattagctgtgtttttccatctgcacagttgataatgcatgttcactaagtggaataagaaaaacaaactttcacattctgagtaattattaattctatagctaatacactgttttcgttgggagaaaagagctatcagaaaaggataaacatttctatgcatcttttgtgcagtgggggagcccatgatagtattatatcaaacaatactatttttttctttgtgtgttgtaaataggtctgatttttaaaattttttcttgattcttttagagacagggtcttacctcggctggaatgcaggggcatgatcatagttcactgtaaccttgaactcttgggctcaagcagtcctccctctgcagtctcttgagtaggttggactataggtgtgggctaccacacctgtgtgctaggtccaatttttatagcaagttacaacgaatctctgtaactatctgggtttttctagaaattttggtcttctagcaatttgacctcccgtctctcaccccatctccaaattgatacattattgtgaagtaacagttgtgacaactgccttctctcattctttgttcccatggcattttcaaactactctcattctagtatttgtgacattatgccaaaattgcttgttttgttcttccttccatccaaactgtaagttccctggggatgtagacagtgtcttgatactattttatctctaatttgtctgacatgatacaatcatagtgaagatatttaatatagttaaatttaatacagtatagccaaaataattaaaacattggaattagtagcttaaatctcaagggtgccagggatttggctttgtagaaagtgccatgaaatcagtaaaatattgaaggctagaagcataaagtggcaatgtataacgtcaacattctgagaagtaatgaactgctagataggagagaacctctgctttctgttgattctacactactttctgagataatttttacaagtgaataaattgaggatacagaactctcagtgctactaatgctacttgatatatttttttaggttggtatctaggaaaacgaaaattatttgttgggtattccttgtgaaataggcacaaagtgtgagctctctttctgaaagtgactattttacttgtttagacacttattagaatgactttaagaatgaagggaacatagtgataaatgacaagataatgcttgttatacatttacatgtagagagcacactctggtgtgttccgtagatacagaacattaagacattctttaacctcttagcatgcaggttgtaatgttgaaaagaggtgctgttggagatgtcatgtttacttctcaatgatcggagtattaaatgaagccttttatcattcacttttacagaggaagtgctcttcagaaaaggttgcgtgatagagaaaaggaaatggaagcagatgaacgagataggaagagagagaaggaggagcttgaggaaatcaggcagcgccttctggcagaagggcatccagatccagatgcagagctccagagggtaagatactgtaccatctggtcgggcgcggtggctcacgcctgtaatcccagctctttgggaggccgaggcgggcggatcacgaggtcgggagatcgagatcatcctggctaacacggtgaaaccccgtctctattaaaaatacaaaagattagccgggtgtagtggtgggcgcctgtagtcccagctactcgggaggccgaggcaggagaatggcgtgaacccgggaggcggagcttgcagtgagccgagatcgcgccactgcactccagcctgggcgacagagcccctgactcctgggttcaagcgattctcctgcctcaggtacccgagtagtagtacggattacaggtgtgtgccacctcgcctggctaatttttgtatttttatttttatttatttatttttttgagatggggtctcgctgtgtcgcccaggctggagtgcagtggtgtcatcttggctcactgcagcctccacttcccaggctccagggattctcgtgcctcagcctcctgagtagctggggttacaggcacgtgccaccactcctgactaatttttgtatttttagtggcgacggggttttaccatgttggccaggctagtattaaactcctgacctcaagtgatccgcccatcttggcatcccaaagtcctgggattacaggagtgaaccaccgtgcccggccttttttttttttccctgagacagagtctggctttgttgcccaggctggagtgcagtagcggaatctctgttcactgcaccctctgcctcctgggcaagtggtcctcaggcctctacctcgtgagtatctgggacacttacaggcatgagcagaatgcctgactgaatactttatgcttttttgtagagatggggttttcctgtgttacccaggattgagccactgcccatgtccttttttttttctttttctttttctttttttttgagatggagtcttgctttgttgcccaggctgtagtgcgattctgcaaggctcactgcaacctccacctcccaggttcaagcgattctcctgcctcagcctcctgagtagctgggattacaggcgtgcaccaccacacctggctaatttttgtattttcagtaaagacagcgtttcaccatgttggccaagctggtctcaaactcctgacctcagatgatctgcccaccgcggcctcccaaagtgctgggattacaggcatgagccaccatacctggccttttctcttttcataaagatattttacaagaggtaatgtaaaacaaaaatcaagttgaatggtgtagagttgtagttaatcagattattgtttgggttttagatggaacaagaggctgagaggcgcaggcagccacaaataaagcaagagccagaatcagaagaggaggaagaagaaaagcaagaaaaagaagaaaaacgagaagaacccatggaagaggaagaggagccagagcaaaagccttgtctgaaacctactctgaggcccatcagctctgctccatctgtttcctctgccagtggcaatgcaacacctaacactcctggggatgagtctccctgtggtattattattcctcatgaaaactcaccagatcaacagcaacctgaggagcataggccaaaaataggactaagtcttaaactgggtacgttagcatttccttccttctttattttcttcccttcacccctgcaaatacctgtattgtgctttaaagaaaaaaatttatatttgtgcttggttaggtagatagaagattactaaaaaatgcctttctagctcacgattgttttcatagttttactagtgctcctatatctgcagctgcctcgagttctgagaagaagtgaaaagtttaattttctagcacttgtgagtagtgagttattttttacagttgggatctttctctaagatttgtggaagtatattttgcattgcttttgagggatggtgggttataaaatgaaacatttggaaattaagtcatcttgctaagagagtgtttttactgtaggtgcttccaatagtcctggtcagcctaattctgtgaagagaaagaaactacctgtagatagtgtctttaacaaatttgaggatgaagacagtgatgacgtaccccgaaaaaggaaactggttcccttggattatggtgaagatgataaaaatgcaaccaaaggcactgtaaacactgaagaaaagcgtaaacacattaagagtctcattgagaaaatccctacagccaaacctgagctcttcgcttatcccctggattggtctattgtggattctgtgagtaggaaattatatttcatcatattattgggaacagttggaatatgccatacaaattcatttgaagaaaaaaaaacctcatttgattctattaatgacaaataagtagggatgatcatcttgacaccaactcaatgccatggtcaagaaattagtaataatggaaattttttttgtgctacttgaagacttactaaaagcagatgattgtatcttgatacatatctgtcttagttcaacttgtgaaataacattatattttagtctcaggaaaaatcatgaagctttaataactgttatagcaagttacaattctttaattcagtaaccgtggtttgttttgcagatactgatggaacgtcgaattagaccatggattaataagaaaatcatagaatatataggtgaagaagaagctacattagttgattttgtttgttctaaggttagtcttctattctcttccatgccagcatttattttatatattaaaatattagacacttcttaaaagagcagaaattttacagagtcaagttccatgatggtttaggttcagttaagtgatttatatctgcttttttaaagttatttttatttttggtgtgtttttttttattcactgcagtggatgcagatttatgtctgctttaatgaacctttccatccaacttcagactcctcacaccacatgtttttatttcagtggtcgaggaggatggaattgctggttactgccaattgtgtgctgtctttctgcccctgagaatgctgtgccatcttcttcttgtcttggttggaataattatgttgagattttttggacgtagccaatatcttttcccaactcctttgtcagtcacccatcctttggataggatcaaaatagttcctttcatatcgtagtaacgatcagtgtttattgactgacaggctgtgttctcggcaggtattgtgttagttttgtttgttttgttttgttttgttttttgttttttgtttttgttttttcttttgagtcggagttttgctttgtcctacaggctggagtgcagtggcgcaatcatggctcactgcagctttgaacgcccagcctagactgatcttcctgccttagtatcctgagaagccggaactataggcatatgccaccacaccctgctaattttttttttctttttttgttttaaattatactttaaattctaggatacatatgcataacgtgcaggtttgttacataggagtacatgtgccatggtggtttgctacacccatcaacctgtcatctacattaggtatttctcctaatgctctccctcccctagctccccacccgccgacaggcccagctgtgtgatgttcccctccctgtgtccatgtgttctcattgttcagctaccacttatgagtgagaacatgtggtgtttggtttacaccaggctaattttttgtatttttagtggagatggggtttcaccatgttggccaggctggtcttgaactcctgacctcaagtgatctgcccaagttggcctcccaaagtgcggggattacaaggcgtgagccatcacaccagccgaagataaagttctataaaatgttaacaagacagtggcccacgccttgtaattcccgcactttgggaggccaatggggcagaacacttgtggtcacgagtttgagaccagcccggccaatatggtaaaaccccgcctctactaaaaagtcaaaaattgggtgcgctgggtggcaggcacctgtaatcccagctactcgggaggctgaggcaggagaatcacttgaacccgggaggcggaggttgaagtgagctgtgattgcgccattgcactccaagcctgtgtgacaagagtgagactctgtctcaaaataaaaaaaaagaaaaaagaaaaacttcttttaacctaacacttagaatctgtctgtcatgaatgttatacccattttatacatgaagaaattgaagtttaaggagagattgtgtcttggctatgttttatactgagtctagcctctgaaacccatgctcttaaccactaaggtatatcttcccattgtctcctgaaaacatagtcttaactttaataaaacagttaacatagtagaaacaccatatttctataaaggtatagctatggtatttttttgccagtagtgctcttttgatattatgaacagtaaatttactctgtcttctctaacttgtaattattgtggcattaaaacttgtgtgagatttgacttaaaattagactacagaccactatggagattaatattccaggttttggtgcctctttcgttgaagaatgatattctgaaaattaaaacatttatagaatggttccttagccgcaagaagttcctgtatgaatttgaggattcataccttaaaatttcttgactgtattgttaattttttatttatttttaatgtgacaattatttttctcttttaggttatggctcatagttcaccccagagcattttagatgatgttgccatggtaagttagaaattcactatttttatttcttttaatttaaaaaaagtttttggttttttttgtcttaaaatatagatggggtctcaccacgttgcccagggtagtcttaaattcctaggcttaagtgatcctcctgcctcagcctcccaaagtgttgagattacaggcatcagccaccacacctggccagaaatgcactattattaatattttaattaacatctatataaactcacttttgaatttgattcacttcctgcctgtctttgttccagaatcttttttaggcctgaattaaaacttgagtaatcccagtacttgggaggctgaggcgggtggatcacaaggtcaagagatcgagaccatcctggccagcatggtgaaaccccgtctctatgaaaaatacaaaaattagctgtgcgtggtggcgtgtgcctatagtcccagctactcggggagtctgaggcaggagaatcacttgaacctgtgaggtggaggttgcagtgagccgagatcatgccattgcactccagcctggtgacagagtgagaccccatctctaaataaataaataaggcttcattcttttccaccagttccattcatgttttccctatgcccagcacaatgtgctagaagcataaaagtagaacaaatgacctgtagtagcagagagataggtatacaggtactggaaccttgatgtacttgtttgaattagatatgtagaaaggataatggaggtagaggagatagaacatctgatggcattgatagcagttaggttaagcatcacaaggattactacaggaactgatacgtgtgtgtgtgtgtgtgtgtgtgtgtgtgtgtgtgttttaagtcggatacatgtgcaggtttgttacataggtaaacttgtgtcatgggggtttgttgaacagattatttcatcacccaggtgttaagcctagtactcattagttatttttcctgatcctctccctcctcccaccctctgccctacgataggccccattgtgtgttgttcccctctcttcgttcatgttttttcatcatttagctcccgcttataagtgaaaacatactgtatttggttttctgttcctgtgttagtttgctaaggatagtggcctccagctccatccatgtccctgtaaaggacactatttcgttttttatggccacaagattgtacatatgtgctgctttttggacaggtatccaaacacctgttgtattgacagtaaacatcaaatccccgttgcatttaatttgggattacagtcagtggtagcatgtagttaacactgtgattttgtgagacaaggaaaggagaagaaaattgatggtaaaggttgagcaagagattgaactatgatctccaagttaggaagagaagaaaatagtatctgaatagagctggtggtttgaatgaattaaggactagtggttccagtgaagttgtggaaggcgaattgtaataaaacaactgaaaggagaggttatggtcagagtgtagaaagttcaagtctatatgtgataggtcagcccagacgatggcaaggtgcatagtatgactatgggaaattcctgggtattgggagtcagattggagagaaatactggaaatagttgccagagcactcatttaagtggggggaaagactagatacttgccagatagctgctcttacagtggataaggtggtgagagctcatgaacgtccatggagttgtttttttttttaccaagaaagaaacagtgaagacccacaagtcattcctgtggagattaagacattgagagtgagagactgcctgagaagtgccggggctctaggagatagaggagggtttctgttaagaggaaaaacctaatttagttgttgatgtgtagtataaaatggaatagcggtccaaagggcagagcgggaagacagcaatgggaagatgagtaaggaaggaaaaatcatcaagcatgatatgaaatggtagatgactgggagtacttgcacttggaactgccaccagagatgtcagggagggacatcgtggggtttatagtcaaaaagaaggattgtgaggtctagctgctttgtgtccaggcattttatggtgtctaaagccagataacattccttttctgctgcctagctagcttgatgcagctgtcatttagaacacctgataaaacatttgtgaaaacttcattgcctcagaggaaaggagaaatgtgaatagatttcagtccttggggctgaattctgaactttcctgaagcttccagccccgtttttcttggagtagagggtgtcgtagttaggcctgagtgaagacattttttaaataaaactgtgttctagcgtttggcctcagcagagttcctatcatacatagtaaagatttcatgtcagtgttaattttagattttttgatctgttgtaatatattgatatttgaagtgtatttagaccactgtttatgattttgtggctcgttgattagaatgagaggaaaccagttgagctagtgttgtcaaacagctctgctaaaaagctcatggggccttgtaaatatttcttgaataaatgaggagactgaatttttagcctgagtactgtttcactcttaacaaaagtctgacttctttatattatacctttttcattttatgtaaattaaatgaagtttggttgcattttgtgcctacatctctctgaagtgtgactcagatgtgaattagtgttacaacagagttcttcaactaaagtcaaatctggctcatagaaatctgatcaaaagttctttaattaattattgctatcattgagaaagtgacagaaatttctttcttttaatttctttcttcttttcttttttttttttttttttttttttttttttttttgagacagagtcttgctctgtttcccaggctatatggagtgacagtggcgcgatcttggctcactgtaacctccacttcttgggttcaagcaattctcctgcttcagcctcccaagtagttgggattacaggtgcccacccgcacgcctggctaatttttgtatttttagtattgacgggtttcaccatgttggcccggctggtctcaaactcctgacctcaggtgatctgcctacctaggcctcccaaagtgctgggattacaggcgtgagccactgtgcccagtctcttcccaggtatttattaagcacttgttatataccagtcagttgtcagagcacttaactacataccaactcttttaattcccacttagtacctactgctatggtgtgtagctacatcgcctccactttagaggtgagggaactgaggctcaggttaagtaacccaaccaaggacctatcgctagtaagaggcagcagtgcaatttgaacctatgtagcctgactagagaatttgaaccaatgtagtctgactagagattgagtactctaaattcctaccccaaacttcctctatgaagacctggcaacactagaccacatttctggagcacagtcatagctgcccccttcagaagggagcagagtaggccatttcacctcatagcagccataatgtagaggggcagatgtgtgtatgggatgatggcaggaatagtgatggggacacaaggaccctataactcataagtagagaggaagacaatttcctcatccaccactggaagaagacttgttactcagtagtcatgtgtgccccgtgatgattgtatttgcttattgtgtttactgtattctggacactgtactaaatacttatattctcatttaatgttcactttagtgtcacatacacaataaatgctagttaagatggtacggttgggctgtgcacagcagctcaaacctgtaatcccagcactttggaaggccaaggtgcgcagattgcttgagcccaggagtttgagaccagcctgggcaacatagtgagaccctgtctctactaaaaagcacaaaaatgtagccaggagtagtggtgcacacctgtagtcctagctactggtgaggctgatgtgggagtatcacttgagcctgggaggtcaaggctgtagtgcaccatgatcatgccactgtactccaggctgggtgacaagagagatcctgtctccagaaaaaaaaaaaaaaagtttgtgaggttgtgtttttggagataaatgaaattctgtattgttattatgtaattgtatattatttagttcttcttaaattactgtgttctttatgaaaagcgtatggtttccttgggaagtagttttgtcagacatgtataattgcagtatctgtaaaggtaaaataaaagaataaaaggtggatcacaaaaatatggtactctttgtgtttagtaagccatggaattttgaatgatttttttttgttgtcgttgttaatttacatttactatttatttatttatttagagacggagttttgctcttgttgaccaggctggagtgcagtggcatgatcttggctcactgcaacctccgcctcccaggttcaagcgattctcctacctcagcctcccgagtagctgggattacaggtgccggccaccatgcccagctaatttttgtatttttagtagagatggggtttcgtcatgttggccaggctggtcttgaactcttgacctctggtgatccacctgcctcagcctcccaaagtgctgggattataggtgtgagccactgtgcccggtccatttactatttattaataatacatttctcacactggacaaattttctttaagtcattttactgaaagcaaaactacttcctaaggaaaacaaatacgtattataaagaacgtagtaatttaagaagaactaaatatacaactatgtaataacaatacagaatctcatgtatcccctcaaaacaaccttaaaacttttttgttttttttgtttttcttttttgagatggagtcttgctctgttgctcaggctggagtgcagtggcgcgatcttggcaagctccgcctcctgggttcacgtcattctcctgcctcagcctccccagcagctgggaatacaggcgcacgctgccatgcccagctagttttttgtatttttagtagagatggggtttcaccatgttagtcaggatggtcttgatctcctgaccttgtgatccgctcgcttcggcctcccaaaatgctgggattacaggcgtgagccaccacacccggccactaaaacaaccttaaaatcttaactagcatttaagtaataagtgcttattgtcagtggatgaaaaacttttttatactggccactgtttttggcagatgttgatgattgcttctcttacatgtgttgctgttttgtttcctctttaggtacttgatgaagaagcagaagtttttatagtcaaaatgtggagattattgatatatgaaacagaagccaagaaaattggtcttgtgaagtaaaactttttatatttagagttccatttcagatttcttctttgccacccttttaaggactttgaatttttctttgtctttgaagacattgtgagatctgtaattttttttttttgtagaaaatgtgaattttttggtcctctaatttgttgttgccctgtgtactcccttggttgtaaagtcatctgaatccttggttctctttatactcaccaggtacaaattactggtatgttttataagccgcagctactgtacacagcctatctgatataatcttgttctgctgatttgtttcttgtaaatattaaaacgactccccaattattttgcagaattgcacttaatattgaaatgtactgtataggaaccaacatgaacaattttaattgaaaacaccagtcataaactattaccacccccactctcttttgatcagaaatggcaagcccttgtgaaggcatggagtttaaaattggaatgcaaaaattagcagacaatccattcctactgtatttctgtatgaatgtgtttgtgaatgtatgtgtaaaagtctttcttttccctaatttgctttggtggggtccttaaaacatttcccaactaaagaatagaattgtaaaggaaaagtggtactgttccaacctgaaatgtctgttataattaggttattagtttcccagagcatggtgttctcgtgtcgtgagcaatgtggtttgctaactggatggggttttcttattaataagatggctgcttcagcttctcttttaaaggaatgtggatcatagtgatttttccttttaattttattgctcagaaatgaggcatatcctaaaaatcctggagagctgtatttaatgcatttttgcactaattggtccttagtttaattctattgtatctgtttatttaacaaaaaattcatcataccaaaaagtgtaagtgaaaaccccctttaaaacaaaacaaaaaaatgaaataaaattaggcaaattgacagacagtgagagttttacaaacatgataggtattctgctcggcaatttgtaagtttacatgttatttaaggataaaggtaaatcattcaaggcagttaccaaccactaactatttgttttcatttttgtcttgtagaaggtttatatcttgttttaccttggctcattagtgtttaaaaatgtactgatgatgtgcttagagaaattcctggggctttcttcgttgtagatcagaatttcaccagggagtaaaattacctgaaaacgtaagaagttttaaacagcttttcacacaaattagatgcaactgttcccatgtctgagtacttatttaaaagaaaggtaaagattggcctgttagaaaaagcataatgtgagctttggattactggattttttttttttttaaacacacctggagaggacatttgaaaacactgttcttaccctcgaaccctgatgtggttccattatgtaaatatttcaaatattaaaaatgtatatatttgatcctggggactcatattctttcagaatcatgtaaataaatggcatcatgttgtaa

SEQ ID NO: 598 - DNA, 27316 bp, Homo sapiens
aggtcagcggagagtaggcatgtagcttctgcagttgctcctcctcaccctccgcgacctgatttcctagaagggctctgtcacccgaaaagattttccactggcttagaggagggagggcccgccttcccccgttatccattggctgctcgttccgccgcaagttgggggcggggttagggcgcctttcgattgcatcagctggtccagccgaggccaagtcccgggcgctagcccacctcccacccgcctcttggctcctctcctctaggccgtcgctttcgggttctctcatcgcttcgtcgttcgccaatgtttgaggagaaggccagcagtccttcagggaagatgggaggcgaggagaagccggtgagcaaacttggtgggacccagagaccagcctgggactctagtgggtgcagacgctacgctcgcggcgggagcggggggcaggaagcaggaagcggccgggaccgcgtgggtcggagaagtgggggatggtgggactcctggaaagtcggaaccccctttgggaaccatccattcataaattagggtggggccttgcagttcatctgtgggtccattctctttacagatgaggaaacagaccttgagtgagcgacttgttcagagcctcacatctacagtagttagacgcggagacagaatcagaatcttaggcttgaggcttccaaacttgcgtttatggcttactgtaagcgggaaacacattgcagagccttatttaatcaatctcctaagatcctgcgggggtaaagagctccattttaaggaaaggaaaaccgagtgcccgagatctgacccagcttgtccaagtttgggtggttaagtatacattttgcccggcactgatctgggcggtgcatgtgggaagatgaatagggcccagttccccgactttgagggcctcacaggctgatgtgtaagagacaggaaaacagccctagtgctttgtgatcaaccttgtggtattacagaagaggaagtttaggaaggcactttagaatttagtttggaagaatgatttcaccaggtaaacaggcaggacggggcttcccacgtaaaggtagggaaggcagtgaaaaggggcacgcaggtgaattgtctttcgggttgtttgcaagagatatgccagaagggttaaaggaacagtaatcagaaggatcttaggcaacaaggatgtttgaaacttgtattctatacatgaaggatcttaagcaggaagattgtatttgtaaaagtcacgctggcattgggatagaaggttaggccacatgcagaaggctgttgtaatagtccaagtgagaagtggtgacgtcttcagctaagggatcctctatcccaagtctgtgacaggacagttcacttaaaagccaaatttttttcttgattgtccactcgagattgaatggagaaactgcatacgggcacattctaactatgtaaatttaattctagatgataaatggtgactatacgtagatttttttcacataaaatgatatttttactgttttgtaacttttttttttttttttttttttgcttaatagaatgtggtcaacaactttccatgtccataaatattctcctgtgctattcttaattggacgtgatatgtatggttaacacatatgtaatttttccttcctgtaataattatacaatagttaatatttattttgagtactaaatacgagtttggcactgtattaatgcattccatgaattaactcattcagtcttcttttttttgagacggagtctcgctctgtcactcaggctggagtgccgtggtgcgatctcggctcactgcaagctccacctcccgggttcatgccattctcctgcctcagccaccaggcctggctaattttttgtatttttagtagagacggggtttcaccgtgttagccaggatggtctcgatctcctgacctcgtgatccgcccgtctcggcctcccaaagttcttggattacaggcgtgatccaccgcgcccggcctcattcagtcttcttaataacgctgtgaagtgggttctgttattatctccattatacagatgagaaagcaggcgtaggaacagtaacttgctcaaacccagtatccccgtttttttccttcctcaaacccagtatcctatagccaatactaataacccctgtgctgttctgagtgagtcagggacagatcattcctgagaaaggtaattctgtagcttctcttcacaatccggttctgtttcccaacttttgggttgagattttagattacttgtatgtagatgtacataccatatatactcagggaaatagagaacagttgcctactctcttcccagtgttgtagaaaaggggtcataggcctcagggttccagagagacctgttgtaatttcccagctctattacttaatgatacaaatgggcaagttacttctttgagccagtgttcttgtttgtaaaatggagccgtatttagaaccagaaaacctttgtggtgattccctctctctctctccctctctctctctctctctctctctctctctctctctctctcactacccctgttcatttggcaaatggtcaaaaccaaaataatcttatcagaaatataaaacttattttatcatctttccattttaaacctgcacagacctgcaatttttctttctttttttttttttttttgttgtcgttgttgttgttgaaatggagtcttgctctgtctcccaggctggagtgcagtggcgcgatctctgctcactgcaagctccgcctcccgggttccagccattctcctgcctcagcctcccgagtagctgggactacaggcacccgccaccacgcccggctaattttttttgtattttttagtagagacggggtttcaccgtgttagccaggatggtctcgatctcctgacctcgtgatctgcccgcctcggcctcccaaagtgctgggattacaggcatgagccaccgcgcccagccgcaatttttctttttacccagtatacttgatcagttacatcacttctgcagtataacaaaggctctattgaatctaaatgaacctttaaagtttattaaatccagacttctggagtaggggggattttagctcagcatgaaattaggagtcatattttaaaattagttttttttttaattatacaagtaacgcattttataggatttaaaagacaatggccaaaatgtccatcaactgataaatggataagtaagcaatggaatattatttgataataaaaaggtacaatgacaagtattgatgcatgttacaacctgatgatcttgaaattattatgctaactaaaagaagcctgtcacaaaagaccacataatgtgtgattctatttatatgaaattcccagaataggcaaatctatagaaacagaaactaggttaatggttgccagggtctggagatgaaggcaacagggagtaaactgctaatgggtacaaggtttctttttgagggtgatgaaaatactctaaaattgatggtagtgatagttgcaaaacagtgaatacctaaaaaccattgaattgtgtactttacatgggtaacttgtatggtatatgaattgtatcttaaaacttaagaaaactaaaggtcacaaacatgcaaactaattaaaatccctgtttacattcctggcacaggatttattactttaaaactttctatgacttcacttgcttctaattgaagtctgtattccttatggtaacttttagttcttgcttctgtgagccttagtctgtcttaccttgtattactttctaaaacaatccttcattaatcagcctggtttagtcattttttctctctttaaattttaacatttctgacaacaagcttatgtgtacacataggacacatttcctgtattctcagaatccacctgttgaaatgcattccatcctttaaaacgctagtcctagcttatttgacatctaatcgtagcgttactactgtgttttctcctccgggagtttctcacacatgtatgccttactttccctggagagactaggtttacacatggtagggattgggccttatgtttgcttcttccatggcttttgttagcactggtggaattcatgggcacactttgcattcagtttttttttttttcccctggaaatatgcttactgaatcaactgcgtgcttccttgtggccatatgtttggtatgtggtccaagtaaacctgaagcgagagtcacaagaatagttaaaataaaataaatgaaatttgaggagttaaacatcgttagtaactccttcctactttttaaagacttgcctttattgtaagttgttaacctgtctttgccagtgatgaaattgttcagtctttcaatatcagatttccattttttttaaattaaataacaaatactaaaataacattctcaacacttcctggggcatcacaggatggaggtgtcacattagattaaaatataaaacgttttttgcttatttagattggtgctggtgaagagaagcaaaaggaaggaggcaaaaagaagaacaaagaaggatctggagatggaggtcgagctgaggtaaaagttatcatcacagagggctctgttatcagaggttggcaaatcgcagggaactttctgagactttcctaatgtgtaagggttctaatggtttacatggtagtgtaagatggtactggttggaaaaatcaggaagaagaattaggaaagggtaatctgagaggggaaaaaagactttcagttgttactgtaaaaggaagcaactggcgtatgattgtataagatgatctgattgtagggttgaatataaaaatcagagaacaaaagttgaagaggagactggtaattattcagttgccagatgtgatgccagctctgacatttcattaaatgagatgttagggaatagagacttggtgtttgggcttacactgaatacaatgaaaaccaaagaaagccagttttttgaccccctccttgccctttccatctggacctgccctagggttggcttctaagccaggacagatccccttaaggcctctcaagtctgcagaaaatgctttcacttctccaggctcacactgaaaggaactggcatatcaaaagccagccctaaatcaacctggttcctgagtattttgcttttacaggcagttaagcttgcctttctactttatttttactgctgtgaactgtgcttcactttttgctttagtcattacagctgttttattggagactctttagaaagctaccagaaggaagaagcacaaaggaacagcctttttagaagtagcacagtaagctggcttttaagagccacttttacaaatgctgcaattgctaaatttatagtgccgtcatttactttagggtaagtttatagatgatcaagtgtagtgttgcttagaaccctacctaaccatttatcttacggctgatcagttgatcagtctcccgaccattatacccccactgtaattgtgaagaaaattgttgattgtgaattttaaaatttgcaagccaatggaaaaatgcatatgttccctaatttcttttttatactttcaatacaaacatacgtgctgttccatcacagcttgagaaatgacctggaaataagacaaagagtataattagaagactcttctgaacagagaattttaagtgggacatgtgattatttatgtttaacgattggtctggaaaaaagagtgtacagtgaactgtccaagaccttggtcttcccctccaagggcaacttgcaggttttattcatctctgcaatcacagagactgacacagagggtatctgctgaatgaatgttgaagagattttgacacgaaattctaattgggacattgcaagtggctatgatgataaactgcagttaagatacagagggtggtgcaggtgggtaggattataatgatgctttagagtggatggaactgggtactgtgcattagtctgaggggttcagattatggttgtagaatgacaggctctgtctgagcttttagttaattcatgggttcttcaccattgaaggttatggaccgttgtgataatttgatgaaaagctctcaacaactgaacgactaaagaaagggagggactgctgtgggtgggaattacaaagatattagggcctgatacggtggtaggaaccaatcacttgagactgagtgggagaatcactggagcccaggagtttggggccaaaatgcgctgtgactgtgcctgtgaatagtcactgcgctccagccagcctaggcaacatagtgaaaccctgtcgttaaagaatggaaagaaggagggagggaaggaattactgggcagacaattaatctttttcatttgatattattttctattatctccagtcaattttgttttgttttgttttgtttgagacaaggtctcactctgttgcccaggttggagtgcagtggcccaatcttggctcactgcaacctccacctcccaggttcaagcaattcttatgcctcagccccacaagtagctgggactacaggtgtgcgccaccacacctggctaatttttgtatttttagtagagataggattttgccatgttggccagggtggtatcgaactcctggcctcaagtgatccatctgccttggcctccctaagtgctgggattacaggaatgaaccaccatgccctgccccagtcagtttcttaaggattagatattcccttgtactcctttcaaattgtggtatgttgatatatatggagacatatgtatggagacgttggtagcattatcaacattgaataaatgttaaaatctgtattgcagtaagtcattttatatctgatagattgaaattcatttgaagatagaaagtcatggcaaaattaagcaatctcctcttcacttttgtatgaagtgttaatgttcatgtaatttgaagatgatgaatgctgtagatgttagtttgactgttttgttaccacagattcactgcctttttgaaatgttccatagattatagagtgacagtagaagaagtcagctctctgattgctgtctctttttctttctttgccaaacctctagaaacctaagtgggtgttttatatagaatatttttgttaattttatctgctatagaaagtagtagtgtgttgttttatatagttgctaattacatactccaagctgatcatggcatctttgaattcagtaaatactttccttgaaggggagaccttaagtcaaagaaatttgtgattggttgtgagtggacatataggctgacccgctgcacagaccatcacctggacatgaatgaaacaaaatagaaaagccagtttattgtttttatttccagtattgtttatagctctatttgtaaaataatttagttagaaaagatcctaagaagacatcttaaaagagaaaagaccacttgctgtaaatagtagcaaaatggtaattgtcgattcagcataagaatagggcatttaattccttcttttaccttcatttagaaccaaattgaggtaatgccgggtgattttggcagtgtttatttaccacattgaatcaatagtcctgggtttctgtattgtttttattatttctttcccatttctaaataggaaagcaatatttactgatcatttatttcctgatttgtttgttgtcttgcagttgaatccttggcctgaatatatttacacacgtcttgagatgtataatatactaaaagcagaacatgattccattctggcagaaaaggcagaaaaagatagcaagccaattaaagtcactttgcctgatggtaaacaggttgatgcggaatcttggaaaactacaccatatcaaattgcctgtggaattaggtataagctacacccatcatgaccttccatagtttgtggtctaactaaacttccttttattatcttgccatgttttattcttataatatttttatgttaccattcagtgtttttaatctgtttaatttgcctacttgagattttttaaaaatcaaaatgatacagagctttgtagtcaaaattcaaagttaatttctgaaagagtttactttggtcttatcttttggggcattgtatatttttagtcttactatgattataaatgttacaaaaccgactagacagtgtttacctatttcgacttaaatgtcttggttttgaagttaaaaatgaagctacataatctcacatggaaaggttaagaaacttcatataacacatgaaaaaaatgtactatttttataaattcaatgaaagactattcctagtcttaaaacttttattggggtgggaagaagttatttcaattaactgagaattagatgcatattttgtaataggggagaggctttcttaatctgatatgattgggatcaataattggtcagtttatcaaaataagagttggtaaaacatatatatgtgtatatatatacgcgtatatatacacgtgtatatatatatatcttaaactgggtattgggaaactctagtcataatctgtttgtgtatgtcctgaaagcgaaaaataaaaatgattctttttttctttctttttttttttttttttttttttttgagacagagtcttgctctgttgcccaggaggctagagtgcagtggcgcgatcttggctcactgcaagctccacctcccaggttcacgccattctcctgcctcagcctcccgagtagctgggactacaggtgcccgccaccacgcccggctaattttttgtatttttagtagagacggggtttcaccgtgctagccaggatggtctcgatctcctgaccttgtgatccgtccgcctcggcctcccaaagtgctgggattacaggcgtgacccaccgcgcccagccaaaaatgattcttaaatttttaaatagttggaaaaaataaaacaactaagaatatacaacagagaccatgtttggcctgcaaagtgtaaaatatttgtgtggccttttacagaaaaagcttgccaatcttggtcttaaacacttcaacttaaaatatgtgaatatgtatgtattcactaactttatatacatacataaaacagtgaatatatatatgtatggcaaggtttgggggatagcgagtgctaattagagttcttacattatcttaacacatacgagaagtagtctgagcacagaatccttgcagattttcatgtagttgtagagttacacctaacttgacagtgtttttgtgtgtgtgacttggatttatcaagccttctcaaacattcaacttggttttcatagaatccataattcccttattgtgttattttataattatatatttttgaagtttatttataagtgttatgtattgaattgaaccatttggaatcaccatatgaattgtcatgtggttgattatcatcaattttgtattgttgaaccaaacacgtaaaagaacaagcacaaaaacagtttggggaaccaacgtggctgattcttggtaagcgtattatacaactagtagaagcagaaccagttaggcctatgagccatgagcatctactgtaccacagacattagttagtactttttacaaagtgaatggagtgtttccattcatttgacaagtgcttctacctacaagttcttctaccttactccaaaggaagtaaaaagttgtaataccatgcaagtttctatgtgagagcatagagaactggatagacctttacgtatcagttcaacctttcattttagagataattttgaaggtcaggttgattaatagattcctctgttgtcacacaatgagattgtagccgtgtcattaaaatttaggcttctgttagtttgggaactttttcctctaccttctacaatgttgatctagattacattgtaatttatcaagtcttcagttgaaaaatattcttcaagaactataaaattctaagttgaattacatagctgggcgtgttggctcacagctgtaatcccagcactttgagaggccaaggcaggcagatcacctgaggtcaggagttcaagaccagcctggccaacatggcgaaaccctgtctctactaaaaatacaaaaattagccagtcatggtggcgcacacctgtagtcccaactacttggaggctgaggtgggaggatagcttgaactcgggaggtggaggttgcagtgagccaagattgagccactgcactccagccttggtgacagagcgagagtccgtctccagggaaaaaaataaaaggttgaattacataaaacattgatgggctttagctctggagttaagtcactgatctgcactgagaatactttatgaaatttttacaaaagtccagaataactttttgttctgtgaaaaattataacattgataacaggctatttaaagattcacataattagtggtgaatatgaaagggaaggacaaaaaagacatgttccatttgcgtcaaaaggtttttctttgaagttttgttataaatcttttttttttttttttgagacggaggagtctcgctctgtcgcccaggctggagtgcattggcgccatcttggctcactgcaagctccgcttcctgggttgacgccattctcctgcctcggcctcctgagtagctgggattacaggcgcccgccaccacgcctgcctaatttttgtatttttagtagagacggggtttcactgtgttagccaggatggtcttgatctcctgacctcgtgatccacccgcctcggcctcccaaagtgctgggattacaggcgtgagccactgcgcctggccgttttgttacaaatcttaaagattattttacccttctttgaaaaattgaaatgatccagtatggcccatgtgtaatctacattttcagagtaactctattcttagaatcttggggctccatattggatcataagataaaagtcatgttcttcccaaagaatatagagaatatgattatcctttttatcagttctttaatctcctgaaaactgttttacaccaatatgatgaaatacatttctctctgccaaattcatgttatgttttgtgaaatgcatgtatttattttattgactccatctgatctcaggaggaaagaaaacattgtttataacctatggtaaagttagtaggagcattgaaaatagaaaggagtttgttgtttactttctgtttggttcttttctcttgatcctcagataggagttgtatacattttgttgtaaacccttagacatagagagccaccaacacagcaagcctggctagcttaaagccttctagtggtaggtttctttgagatttacagtgtaaagggtgtatactttttcttcacagtgtagaatgttgcctaccttcgttgagatgtccaggctgttatagactattatttctctagctgtgcatttagatgtataatctggctcacctactcaactctgctctagtcacacagcttcctgcaaaaacctctcttcacttgcatctctgcttgcatctgtggccattccctcatctggaatgccatggcctcctcttttcttcctgtgagtgctttatcctcaaagcctttccagatgactctgacctgtactgctttccctcctcagaactcctgtagcttttacactctgtgtgctctgatatttcatcacttgatgatactttatgttcgatgttgtatattgggtgtgtaatgtttttactcacattatatggaaagttttattaaatagtctttcattttacctctatatttgttataaatattatcataggcatttgcagaatttattctgaggttagcattgtctgtcaaagaaaggatctggtgtacattttaagcaggaagaggaacagagaagttatttagtaggccttttttttttcctttggagtctacatagcttagctttgtagaaagagaaaggtgggtgtattaagagaaaactcggtgtggtgacttgtgccagttgtcccagctactctagaggctgatgttggaggattgcttcaggccaggaggccagcctgcgcaacatagcaagaccctgtcgctaaaaaattaaaaaaaaaaaaacttatttgttggagaaattaagattattcaaaccattggaaattgatagtgcttatttatcagagttgccatatctgcttaaacaggaggcattcaatgtcaaatgataatgttctgcattttcaggatcttccagttaggttcttaggtacatttttggaatttgttgtttttatcattatatttcagaaaaatagagatacatcaatataaaaaaacaatatataataaaaatagtgtttattttcctgttttcaaattagattcgtgtgtacttatatatgtgtggacttttttttttttttttttttttaagtcaaggcctggccgacaacaccgttattgctaaagtaaataatgttgtgtgggacctggaccgccctctggaagaagattgtaccttggagcttctcaagtttgaggatgaggaagctcaggcagtaagttgctgattagtattcattgaattttaggatgcagattcacatttgaagtcttttccagctcagtcctgctgcgattgggtggctaacatttattgttgtctcactgtcatatttgaaatcttcattttgtccttcatttagggaacataataaaagtgcttgccttagaaaataaaggggtgaagctgaataagtcttttcattactagacacttcaatagggaaaatgttttgggaattgtattaaacattgattaagcaagtaaaaattgttttctaaactgtgaacactattttattttaattttttttttttttaatgatggagtcttgctttgtcactcagactgtagtgcagtggtgcgctcttgcctcagtacaacctccacctcccaggttcaagctattctcctgcctcagcctcccaagtagctgggattataggagcgcactaccacacttggctaatttttgtatttttagtagagatggggtttcaccatgttggccaggctggtcttgaactcctgacctcaagtgatctgcccacctcggccccccaaagtgctgggattataggtgtgagccactgtgcctggcctctaagctatgaacactctagcaagatatgtacatttgacaaataaatttgaaccttacttcaaagcactgcctttattggataatttctgtatttttttctcatcttaagatgcaaatctgctggataacactataaaagtcaacctgcatgtgatgacaagattttctttttaattctccatggctgtgtatcatataaggggagacaaagtattttgttttagtgatgattgttcacttatgtatgtggattagtggttttcaaatgtattttggagccctcaagtttcttacgagaattttttaatgtcactttggtaccttaatactaaatcttgaaaacattgctttgggtgtattctgactcatcccagtgattactttaaaaccaagtactgccatttgatttcagtgtacagatgtttgtcctcgtgttttgtcattgtgttgtggggtcgggttgtaccacctttgttttgggccagtaacaacatgtaatttctaagtgatgttccatagccagctaaaggccagatcacagtgtctgagacatggtgctgtgggcacattgactcaaaagaacctgggccattgcaatcaatgagttagtcacattgtgagtagcagttgttttcagagaacaaagtctatgtcatttaattagtgatgccaagtttagtttaatttgtttgaaaacagctaaaccagatgatttccaaaataaaaatacactagtaattggaagccttttgaattactttggctatggatagaaacagtagtttatagatttagaaatttaggattttatatattgggtttacttgtagtaaatattatcatctgtctctttcagacaaccacattaattggcaacttgtatgccaagactcagaccatgccatttttctttaaattttcaggtgtattggcactctagtgctcacataatgggtgaagccatggaaagagtctatggtggatgtttatgctacggtccgccaatagaaaatggattctattatgacatgtacctcgaagaagggtaagccatcaactagataaagaaaactgaagtcaatgactatggatccataagttattcttaagagttctcagtaagggaggaatgatatagatctcactgcttcttcatcaggtatgcccattatcagtacttgaagtgttgcaatttacctgaagtaatagaggatttgatgagacctctgttctagattgatggaggtagagtcctaaggtattttgggaaattcagggagactggtcctcccctctcctttaaaacctggtgatagagttgcgggaaggggtcactagtgagaaaggtctccatggatgaccaaggtagaagctactgaaaatataaaatgtaaaaattacttatgaaaaatgttttgtttagaattctaagatacgatgcaatagtctaattttttaatattaaaacccttgaagtattccaaatactatttccaaatgaacatttttcgaagccatggtgtgattcgaatggaatgaaaagattatactttcttctccttcaggggtgtgtctagcaatgatttctcttctctggaggctttgtgtaagaaaatcattaaagaaaaacaagcttttgaaagactggaagttaagaaagaaactttactggcaatgtttaaggtaaattgaaccatagtgcgtggcccccactgttaatatcatttattcatgttagttgaagtgacaccactggcgttccgtgtactaagctgaagtctaattggttctttagcaaaaattaagtgtttttattatttttttaatttcatttttttcctagcaaaccattccttcaacatgtttttaaaacatgaagtatcaacatttatattcatacagtgctacgttttagctatagtacttagaagtaaaaattaaaggacagttttttaaaataataatttttcctgttttcagtacaacaagttcaaatgccggatattgaatgaaaaggtgaatactccaactaccacagtctataggtaagaatattagatgtcattaaatgtatctggtatgtatgtcattttgtctttgttaaaattcctttcattttatctttagatgtggccctttgatagatctctgccggggtcctcatgttagacacacgggcaaaattaaggctttaaaaatacacaaagtaagtaatgtaactttaaagactgtgaatgtatctgtctagaatagatatatgtttaaactttcactgatttctctttaccattttctgttgcacatgaaaggatggtattttctcatgctctctattaactgggagctgtatgccatcaggattttataattgaaatccctcaaggggtgactgacttgctgtcattgccagagcaatcacaggggatggagattttacaaaatcatacagcatgggccatcctggctctataaaagctttgagactcactgggagtatgtgcttttgccctttatatgtctaaattaataatttcccaagttgttgtttttaacagaacccagttttatactagttcataaacattttatggaggtttttaaaatgcactttaaatcaagagaataattgagtcatttcaagattttttttttattggctcatttctatttttgctcattttgtgagaaatgcctttgcaggcaaagtaatgtttgtggaattgtggttgagtattgaggggtgggcagttttgggggtattggggtgtagaatgggtctcactctgttgccccaaaaagacagagtggaggaccacttgagcctgggaaatgaggttgcagtgaatggagatcgtgccactgcactccaggctcaagcagtcctcctgccttagcctcctgagtagctgcgaccataagcgcacaccaccatgcctgggtaattttcttttttttaaataaagaatggggtctccctgtgtttcccaggctggtctcgaactcccaggctcaagcaatcctcttgcctcggcttcacagagtgctgggattacaggcatgagccactgcacccacctgcagattgagggaggggcatttttgaggatagaaaacagccaactttgtgctgcagaatgagtaactactctaacaaggcctcaaagcaattgggagttaaaataagtgagatgtttacaaatttgaatgttgtttcatggttaatccttgttttcagaattcctccacgtactgggaaggcaaagcagatatggagactctccagagaatttatggcatttcattcccagatcctaaaatgttgaaagagtgggagaagttccaagaggaagctaaaaaccgagatcataggaaaattggcagggtatgttcaagaacaatgatgtgtcttgactgagttttcttcaacttcatttgaagtttgaaattcagctgcatgaagtactaggaattttgttttgaagagatgttgtggctttttagtaactggtgctatgtcctgtacaaactataaacacttactgattgtccacattatctgcctggagtatgctcagtaccgcacaaaaatgcatttgaactacttttattgagagcaaacactgatgatctacggttttctgtaaaagaagtataacagcttctcatagagctgggagaactatggaaaccctctagtttcactgactcatttaaaatgtggaaacagagtcccacaaagattaacctacttgttgcccaaggtttagcagcatgtcgcacatggatcctgtgctatcatttcctctacccattatctctgttactgctgaatgtcctctaaactggaagttaggctagataaaacattcccccttaaaataggcactctgtgccaggggtccttggctattaggttatgaagcttgagctggaggtagcagccactgccttgcacccctgactacctgacattccagctatgaggcagccagcaatgattgatgggcccttccctgagggcttttgggcacttggggaggcggatgttggcaaggaggtaggagggtgtgtttctttcaccatgacccaaagtcagccaactttaccatcatctatttcattatcagtgtctttttcccagtctccttcctgatactcttactaagaaaataaatacatacataaataaaatgaaaaaagatccagatcttggagctttaaggaatttaagaaccatgagaggtactgcagtggatagttaaagaactgaagggacccttattccctgccactgttggggaaacttgactggattgaggaatataacaggcagggcatgtgttacacgtctgccaaattgtaaatcagctgcaattctataacatcagaaacactgacatggtttctttgattcaggagtggcactgattgaaatatgggacatcatgaccatattctgagctcaagaacactgaaatttatgtatatatacacacacgtatacgtgacgtacataaacattcttttgcttttcttttacccaggaccaagaactatatttctttcatgaactcagccctggaagttgcttttttctgccaaaaggagcctacatttataatgcacttattgaattcattagggtaagtcatatttattgctttcttctttagatttaggatatgtgatcattttattaaataaggtctactaaaaggaaagataatctgtatttgagaagaaatatataagacgataagtaaaagtagaagtctgtggcctcataaatcatccctaatagttgattttgcccatatacacatagaaactggtgagcttgaagggggacctgtggtccttgacataggagctctgtgccctctttgactttgatcatttatttgtattttctttgaaaaaacggtttttacattgcttttttcctttgtaaattatgaaatgtttcaagtataagtttatagagaatagtatatccaatatcttgtacttaactacccacatttaacaaatattcacattgggctatatttgcttgagattttttcattcatgatattaaaaaaaaaattagttgtttaaaaagcctctctttaggacccagttttgatccatatacctccatatactggtatatatatccatatactggtatatcatataccagttttctagaagaaactactgttttgaagttggcatggattctttttgtccatgttacttatatctagcccatgtatttgtacccttaaattatttatgtatttgtgtgttacatataggaagcctcattgtgtatcagactgccttgtgatttatttttagagacatgcaaatcaagtttattttcacttgctacatattattttgttatataactaccacaatgcactcatccctgtattgatggacactgatgtataattgtcccttattatcagccatgctgcagtagcatcacttttataagcctccttaggtacatgtgccaagagttttctctctggtatatacttagaagtgggatttctgaatcatggcatgtgtccatctttttcatgagagagtataaaatcactctttaagtttttactcccacttgaagtatgagcatttatttgcctacacatgtttctgtttattttctatcagagcgaatataggaaaagaggattccaggaggtagtcaccccaaacatcttcaacagccgactctggatgacctcgggccactggcagcactacagcgagaacatgttctcctttgaggtggagaaggagctgtttgccctgaaacccatgaactgcccaggacactggtattcggcagctttgaatttctactgaagattttcacatgctacaattcatcctgggttcttccctcctttaacaacattttcattaaaaacaaattatgtgatcagaagagcatttaaacgcaacatctttgtattatatcttctgcacctgattagatccccactttttttttttttttttttaaagaggtcttccaactggagtgcaggtatgcgattatagctcactgcagctgggactgcaggtatatgccaccatgcccagctaatttttaaaattttatttctgtagagatgaggtcttgccacgttgctcagcctggtctcaaactcctggcctcaagcggtccttcaaccttggcttcccaaagcgctgggattacaggcatgagccactgtgcccagccagatctccagatctgtgggcattcagtaatggtactgggatcatagcaatgaccaaggcagactataaaacaggaagatgaaatatgggggtgtaacaaattacctagtgtgttgttgttttaaagaaacctgttctgtcaaaacctgctaatgactcagcattcttggaaaatgttccttgtcatgaggccgctctgctttctatctttgaaagttgggtgaagaacagcttaagggaagacacaggagagctgtggatacaggtagcttagtgtctgcagctcctactagccaggcctggagggcagaggaggtgagagaagaatctttgtgaagaagctgtattataggctaggggaccaaccaagttcattcttaattttcccagattcttcagttgttggaatacgttttttaattcttcactgtggttcattgagttataacttatttgctgttttattcatgcaagtgcttttactgctgtatgtagcccagaatttgagaaatgttgcttggatggacagctagaatcagtggctttttgacaacctttcgtgtaattaaatatagcattacagaagcagttttattcttaagtgtccgtggacttttctttttctcttcagccttatgtttgatcatcggccaaggtcctggcgagaactgcctctgcggctagctgattttggggtacttcataggaacgagctgtctggagcactcacaggactcacccgggtacgaagattccaacaggatgatgctcacatattctgtgccatggagcaggtatgagaccctgggaataaaatacttagaaagaagagtcaagaaagtcaaggaaaataactactgtttctttttttgttttttaatttgaagattgaagatgaaataaaaggttgtttggattttctacgtacggtatatagcgtatttggattttcttttaaactaaacctttctactcgcccggaaaaattccttggagatatcgaagtatgggatcaagctgagaaagtaagtggtgtttttcagcgtgcttttgaatactgtttgaaattggcttgttctgagatgtaagaaagccaagcctctttaaatggataaaagcaaaatgaaattggaaatggttcctaggtttgtgtaagctagtttttttctttatgattgtgtatttttgaaatggttgaatgttttcatgacttttttcagttatcaagctataagctttaaaaaggggttggtatgagcatatgttcaggtggacaaaattctaaagcagagaatattgatctatgaaagtaattactgtatttttagtctcaaattaggctaaaagaagggaaattgcgatgaaaaaaataaaaatcattttgctttatcctcagcaacttgaaaacagtctgaatgaatttggtgaaaagtgggagttaaactctggagatggagctttctatggcccaaaggtgagcactaaagtacatttgggtaatatgattttcacttgtggatgaagaagatacgacttcgaaaaaagttggaaaaaagaaaatcagccctaatccaactattgagctccactttagtatcactggcattttataataacccagtctttgcttcttagattgacatacagattaaagatgcgattgggcggtaccaccagtgtgcaaccatccagctggatttccagttgcccatcagatttaatcttacttatgtaaggtgagtttctggtgtctgctctgaatattctccagggatatataagagaaaatatatataataagacaaaacaattttttttttctttatagccatgatggtgatgataagaaaaggccagtgattgttcatcgagccatcttgggatcagtggaaagaatgattgctatcctcacagaaaactatgggggcaaatggtaatttttgtcactgtcttttttttctgattagtataaattggctacaagaaatgtctacttttcgatttaattatcagatggaaagggagaatgattccaatcggttgcttctaactaacgacaagtgttcattaaaaaataaggaatcacaatctaaacacaaactttttagcattaagaacaattgctaatagtaattactttaattccagaacttgatttgtttggatgttgtgtaatactttctaattaggaattagtattctgtaagaagtatacttactgttttggatgcttttctagtaactttgttttgggatttagatggctttgctggttttacatagataaatgaggaggcttatggctttcttcgttcagccttgctaatcataacaagcaggtatttggacatgttttaaaagccaagcattttttaaaacagatgccaaaccgatcaacatttgtgattcatttctgtgaggttaagtaagtttttgtttccaagatacatggccacataactttcatcttaattcttaagcagttttttctggacccacagtgcatttgaaagcagcacagggttataaaagcacccgtgtgtagagccttccatattaatcatattgatttaaaacttttgtaaaatgacgtacattggtttaatcttacacattactgtcatttcagttttatttgaacttggttacttcagaaattaggacagtttctcattctgatcaatgatacaagataatctctagatttctcaaagtcagataaaatgtgagacacattctctgcaaggtatttcaagaattaagggagtcctcagctaattgctctgctaaacctgttttaggtggggaaaagtccatgattagggtagaatttagtgcctactttagccttttgcctgatacaacagaacaactgaaaatagaggaatgatggagaaaaacattagcctgatgtttgcagcatcagaagcatttgacacttgtattgcttcaaagggagaattggatgggcttattttttaataagtagtgaaaactctgatttttaccaagtgccataaccagttattatcaattacaatttgctgaatgatacaaaatggatgttgagtaaactgagggcactgtgtccccgtgaagaataagtaataaaatgaacaattaatcactacatgcagttattaaatcatttgttacctcctctcacagccaatacacagtgttttgtgatgtattaaagtgtgaggcctagtcctatcctcaatttgctttgctatctacttagcaagacaaattgtagttacaggctttccttacgtagggttagttttcttctcctgcatctcctcgccttaatctttattggataggtcttttcattttggggttttttaaagccaagttttaaaagtagtcgttacatgttccaggaaaagatactgaagagtagagtaagaaatatgctgtccctgtttagtgaatatgcccacatctacactgaatatttttattctcttccaaaggcccttttggctgtcccctcgccaggtaatggtagttccagtgggaccaacctgtgatgaatatgcccaaaaggtaagccttagatatgaattttctttcaatttaacatctgttgttcagcttttcaaatcacataagccctgtattcttggtgaatcgagctgttgtgataaagagaaatgttactatttttaatctttgttaagcctgaatagattatattacttctttaatgcttttctccatgattccataatcagaagacatatttggatagtgttttatgtacacttgtatattttattgtatttgttttaagagatgggatctttctcttgccccaactggagtgcagtagtacagtcatggctcactgtaacctcaaactcctgggctcacgcagtcctcccaccttggcctcccgagtagcagtgactacaggcaggagccaccatacccagttacacttgtatattttagtatttagtattttaaaaaaccagattagcagatatcaggtacttcagtatggtaggtaaattcccgttcaaaatacagtttaggctgctctttgactcagtgagtaattttgcttcattttaatgtaaatttcttcaggtagttgaaattttttcaggttaatagtatagcagaccaatgtcttgcctctctaccaaaaaaactaacttaccaacaaatgtatagccattcataacttcactttaaagcattgttctgccatagtgaaaattccatactaaggaatttcaaattattaaaagttgatgagtgaacaatactgtaacatcaaaaccatcatgtcttcagaccatcagaataaaccacactcagttcttaattacccttaagaaataaatgaacttgagcatggagatgcatacctgtagtcccagctacttaggagcttgaggcaggaggatctttgagggttcagggtgtgatgattgtgcttgtgagtagccactgcattccagcctgagcaacatagtgagaccccatctcttaaaaaaaaactgaagtgggccaggcgtggtggctcacgcctgtaatcccagcactttgggaggccgaggcgggtggatcacgaggtcaggagatcaagaccatggtgaaaccccgtctctactaaaaaatacaaaaaattagctgggcgcagtggcgggcacctgtagtcccagctactcaggaggctgaggcaggagaatggaatgaacccaggaggcggagcttgcagtgagccaagatcatgccactgcactccagcctgggtgacagagcaagactccatctcaaaaaaataaataaataaaaacaaataaataaataaaaaaaatgaagtgaacactaaaccatctaatagataaaccattcagactattcctgttactgcactcagtagttttagttacaaatgatgacaatcaaagttatgttccatggttgagtgcactttgtcttatttgtatgtgaaaactcacacagtaggaagaagttctgtattggttaactgagttctcaactggagacagcactgacttccccatttccctttgcgggtaggtggcattccagattatgtggtggtaagcttttcttttgcggggagagaagacagggcagtactcctgatacctaataactatagagcagacatgttaaacaccctgtaattatcaggccacttccccaactgcagaattgcccatctcacgtgcacacacaggacccatgttgagaaaaatgaagaaactgatgccttattctttaaagtagttataagttgaagatgtagacctatcttggcattctaaaattctgtaacaacccttctgaaatgggtgtaataaaatgtcaacaggttaattggttcgtgatcactgtggcttaaaaatctagttaaaatgctaagacttgtgcacagtataggcaaagtcacttagattgtttcaaaaagtatgccttatagaaataaacatttgacatacataaataacccttggtttacacataactcgcatttgagaaatgaatgtgttgtagatcatttagaatctttttcaatcaaaaattgaaagaaatatttcgtcacccaggtcaaccagagattgctggttttactcatgatacttaagtagagtatgatagttactatttcaccttcagctgtacttaagatgttttcctggaaaaattcattctgctttctgaccaggatttccagaaactctgacccttctaagaggtctgggtggaattgtgatggtgattctgctagtagacagtgtaacttctgcgtctacaaaaagaggataggccgtcactgctcacatggctttgcgtgaaagcccaatggtactgtctctatggcagagatgaggaaggaacaccagcgtcctccaactttcctgttcttcctttgggttaatggccactgtaaggaaacagttttctgccacgtgtggggtgatttgaatgtaaaatgcccaactctcatagcaggctgaacagaaacattttttatactcattgttaatttgttctaatctaaattacttttagactattaaatattattctattttaaagttaagggactaatgcctctgataacctgattaaaaaaaaaaactttctgatactcagaagttaagatttattcagttgaagatcatttctttcaggtgttgatcgtgtgatatttttcacatctgtaatctgaggttcatatgaaatgatagtgaaataaaattgttcatttaggtctttttgtcatgttaatatgttatcaggttaatgggaagtttaatctagttaatgtaaaattaataaattgtaatctagtttattgcttttttggaaaagaatactgaaaacattgtttacttaatacacatgacctgaggtaataaagaggagctggcctttttgaggggggaataatggcagtgaataatattatctaagacagttttgccagctttaaattcctggaagttcatccaagaagtcctgatccctgtgttcagtaaaatcatgtgagatcaaaatataattctgattttagatctgacaaattctgtatctctgttacaataggtacgacaacaattccacgatgccaaattcatggcagacattgatctggatccaggctgtacattgaataaaaagattcgaaatgcacagttagcacagtataacttcattttaggtaagaatggaaacttaccaaagaaaatttgccacacctcaggaaaatctactgaaaccttgagacaggtttaagtgaattgtaatcaagaatttatttagttccttccagtcctgattttttttctattatatattttaatatataataactataaaaataggctcatgcatacatactgggtttttttttttttcacttaaatcatggatgtctgtgagaaaatattttgctattataacaagaatgaagacgcattgcttttaaacacatctattggattactttctcaagataatgccttatgtgggattacttgaaaaaagatattcatgatgtttggggttttattatttggttgttacgttgtctagattgactccataagcacagtagttttagatattgcaaagagtttcttttaaatatcaacacatggtcacttgtaccttttaatgtatcagaagctatggggtaggttttgggtcctaggatcatttcttttcagatgttcagtgtgaattcttccatatctttagattaagtctgacaaagctttgtgtgtttgttttagttgttggtgaaaaagagaaaatcagtggcactgttaatatccgcacaagagacaataaggtccacggggaacgcaccatttctgaaactatcgagcggctacagcagctcaaagagttccgcagcaaacaggcagaagaagaattttaatgaaaaaattacccagattggctccatggaaaaggaggaacagcgtttccgtaaaattgactttgtactctgaaaacgtcaatttatattgaacttggaggagtttggcaaagtctgaataggtcaacctgcaggcgtaactatttttgacctagtcagtttttaaacaatgtgcatttgaaggagttaattaaaagagagccaataaaatgattttactcattcagtatctgagtactggaagtgaaacatgaggaatgctttagtgtaatgtgggagaacttttttgtaaatttaatgcaattgaaaaagttttcaaattcaattaagataactagaattggattatggtgtaaaaataaaaaaaaaatttattcacataa

SEQ ID NO: 599 - DNA, 27316 bp, Homo sapiens; identical to SEQ ID NO: 598

SEQ ID NO: 600 - DNA, 27316 bp, Homo sapiens; identical to SEQ ID NO: 598

SEQ ID NO: 601 - DNA, 27316 bp, Homo sapiens; identical to SEQ ID NO: 598

SEQ ID NO: 602 - DNA, 27316 bp, Homo sapiens; identical to SEQ ID NO: 598

SEQ ID NO: 603 - DNA, 27396 bp, Homo sapiens
catgattgttccacataaagtcagaagggaggaaaggcgcacgcgcattggggacttgactctggaaagcgtccagaccaaggtcagcggagagtaggcatgtagcttctgcagttgctcctcctcaccctccgcgacctgatttcctagaagggctctgtcacccgaaaagattttccactggcttagaggagggagggcccgccttcccccgttatccattggctgctcgttccgccgcaagttgggggcggggttagggcgcctttcgattgcatcagctggtccagccgaggccaagtcccgggcgctagcccacctcccacccgcctcttggctcctctcctctaggccgtcgctttcgggttctctcatcgcttcgtcgttcgccaatgtttgaggagaaggccagcagtccttcagggaagatgggaggcgaggagaagccggtgagcaaacttggtgggacccagagaccagcctgggactctagtgggtgcagacgctacgctcgcggcgggagcggggggcaggaagcaggaagcggccgggaccgcgtgggtcggagaagtgggggatggtgggactcctggaaagtcggaaccccctttgggaaccatccattcataaattagggtggggccttgcagttcatctgtgggtccattctctttacagatgaggaaacagaccttgagtgagcgacttgttcagagcctcacatctacagtagttagacgcggagacagaatcagaatcttaggcttgaggcttccaaacttgcgtttatggcttactgtaagcgggaaacacattgcagagccttatttaatcaatctcctaagatcctgcgggggtaaagagctccattttaaggaaaggaaaaccgagtgcccgagatctgacccagcttgtccaagtttgggtggttaagtatacattttgcccggcactgatctgggcggtgcatgtgggaagatgaatagggcccagttccccgactttgagggcctcacaggctgatgtgtaagagacaggaaaacagccctagtgctttgtgatcaaccttgtggtattacagaagaggaagtttaggaaggcactttagaatttagtttggaagaatgatttcaccaggtaaacaggcaggacggggcttcccacgtaaaggtagggaaggcagtgaaaaggggcacgcaggtgaattgtctttcgggttgtttgcaagagatatgccagaagggttaaaggaacagtaatcagaaggatcttaggcaacaaggatgtttgaaacttgtattctatacatgaaggatcttaagcaggaagattgtatttgtaaaagtcacgctggcattgggatagaaggttaggccacatgcagaaggctgttgtaatagtccaagtgagaagtggtgacgtcttcagctaagggatcctctatcccaagtctgtgacaggacagttcacttaaaagccaaatttttttcttgattgtccactcgagattgaatggagaaactgcatacgggcacattctaactatgtaaatttaattctagatgataaatggtgactatacgtagatttttttcacataaaatgatatttttactgttttgtaacttttttttttttttttttttttgcttaatagaatgtggtcaacaactttccatgtccataaatattctcctgtgctattcttaattggacgtgatatgtatggttaacacatatgtaatttttccttcctgtaataattatacaatagttaatatttattttgagtactaaatacgagtttggcactgtattaatgcattccatgaattaactcattcagtcttcttttttttgagacggagtctcgctctgtcactcaggctggagtgccgtggtgcgatctcggctcactgcaagctccacctcccgggttcatgccattctcctgcctcagccaccaggcctggctaattttttgtatttttagtagagacggggtttcaccgtgttagccaggatggtctcgatctcctgacctcgtgatccgcccgtctcggcctcccaaagttcttggattacaggcgtgatccaccgcgcccggcctcattcagtcttcttaataacgctgtgaagtgggttctgttattatctccattatacagatgagaaagcaggcgtaggaacagtaacttgctcaaacccagtatccccgtttttttccttcctcaaacccagtatcctatagccaatactaataacccctgtgctgttctgagtgagtcagggacagatcattcctgagaaaggtaattctgtagcttctcttcacaatccggttctgtttcccaacttttgggttgagattttagattacttgtatgtagatgtacataccatatatactcagggaaatagagaacagttgcctactctcttcccagtgttgtagaaaaggggtcataggcctcagggttccagagagacctgttgtaatttcccagctctattacttaatgatacaaatgggcaagttacttctttgagccagtgttcttgtttgtaaaatggagccgtatttagaaccagaaaacctttgtggtgattccctctctctctctccctctctctctctctctctctctctctctctctctctctctcactacccctgttcatttggcaaatggtcaaaaccaaaataatcttatcagaaatataaaacttattttatcatctttccattttaaacctgcacagacctgcaatttttctttctttttttttttttttttgttgtcgttgttgttgttgaaatggagtcttgctctgtctcccaggctggagtgcagtggcgcgatctctgctcactgcaagctccgcctcccgggttccagccattctcctgcctcagcctcccgagtagctgggactacaggcacccgccaccacgcccggctaattttttttgtattttttagtagagacggggtttcaccgtgttagccaggatggtctcgatctcctgacctcgtgatctgcccgcctcggcctcccaaagtgctgggattacaggcatgagccaccgcgcccagccgcaatttttctttttacccagtatacttgatcagttacatcacttctgcagtataacaaaggctctattgaatctaaatgaacctttaaagtttattaaatccagacttctggagtaggggggattttagctcagcatgaaattaggagtcatattttaaaattagttttttttttaattatacaagtaacgcattttataggatttaaaagacaatggccaaaatgtccatcaactgataaatggataagtaagcaatggaatattatttgataataaaaaggtacaatgacaagtattgatgcatgttacaacctgatgatcttgaaattattatgctaactaaaagaagcctgtcacaaaagaccacataatgtgtgattctatttatatgaaattcccagaataggcaaatctatagaaacagaaactaggttaatggttgccagggtctggagatgaaggcaacagggagtaaactgctaatgggtacaaggtttctttttgagggtgatgaaaatactctaaaattgatggtagtgatagttgcaaaacagtgaatacctaaaaaccattgaattgtgtactttacatgggtaacttgtatggtatatgaattgtatcttaaaacttaagaaaactaaaggtcacaaacatgcaaactaattaaaatccctgtttacattcctggcacaggatttattactttaaaactttctatgacttcacttgcttctaattgaagtctgtattccttatggtaacttttagttcttgcttctgtgagccttagtctgtcttaccttgtattactttctaaaacaatccttcattaatcagcctggtttagtcattttttctctctttaaattttaacatttctgacaacaagcttatgtgtacacataggacacatttcctgtattctcagaatccacctgttgaaatgcattccatcctttaaaacgctagtcctagcttatttgacatctaatcgtagcgttactactgtgttttctcctccgggagtttctcacacatgtatgccttactttccctggagagactaggtttacacatggtagggattgggccttatgtttgcttcttccatggcttttgttagcactggtggaattcatgggcacactttgcattcagtttttttttttttcccctggaaatatgcttactgaatcaactgcgtgcttccttgtggccatatgtttggtatgtggtccaagtaaacctgaagcgagagtcacaagaatagttaaaataaaataaatgaaatttgaggagttaaacatcgttagtaactccttcctactttttaaagacttgcctttattgtaagttgttaacctgtctttgccagtgatgaaattgttcagtctttcaatatcagatttccattttttttaaattaaataacaaatactaaaataacattctcaacacttcctggggcatcacaggatggaggtgtcacattagattaaaatataaaacgttttttgcttatttagattggtgctggtgaagagaagcaaaaggaaggaggcaaaaagaagaacaaagaaggatctggagatggaggtcgagctgaggtaaaagttatcatcacagagggctctgttatcagaggttggcaaatcgcagggaactttctgagactttcctaatgtgtaagggttctaatggtttacatggtagtgtaagatggtactggttggaaaaatcaggaagaagaattaggaaagggtaatctgagaggggaaaaaagactttcagttgttactgtaaaaggaagcaactggcgtatgattgtataagatgatctgattgtagggttgaatataaaaatcagagaacaaaagttgaagaggagactggtaattattcagttgccagatgtgatgccagctctgacatttcattaaatgagatgttagggaatagagacttggtgtttgggcttacactgaatacaatgaaaaccaaagaaagccagttttttgaccccctccttgccctttccatctggacctgccctagggttggcttctaagccaggacagatccccttaaggcctctcaagtctgcagaaaatgctttcacttctccaggctcacactgaaaggaactggcatatcaaaagccagccctaaatcaacctggttcctgagtattttgcttttacaggcagttaagcttgcctttctactttatttttactgctgtgaactgtgcttcactttttgctttagtcattacagctgttttattggagactctttagaaagctaccagaaggaagaagcacaaaggaacagcctttttagaagtagcacagtaagctggcttttaagagccacttttacaaatgctgcaattgctaaatttatagtgccgtcatttactttagggtaagtttatagatgatcaagtgtagtgttgcttagaaccctacctaaccatttatcttacggctgatcagttgatcagtctcccgaccattatacccccactgtaattgtgaagaaaattgttgattgtgaattttaaaatttgcaagccaatggaaaaatgcatatgttccctaatttcttttttatactttcaatacaaacatacgtgctgttccatcacagcttgagaaatgacctggaaataagacaaagagtataattagaagactcttctgaacagagaattttaagtgggacatgtgattatttatgtttaacgattggtctggaaaaaagagtgtacagtgaactgtccaagaccttggtcttcccctccaagggcaacttgcaggttttattcatctctgcaatcacagagactgacacagagggtatctgctgaatgaatgttgaagagattttgacacgaaattctaattgggacattgcaagtggctatgatgataaactgcagttaagatacagagggtggtgcaggtgggtaggattataatgatgctttagagtggatggaactgggtactgtgcattagtctgaggggttcagattatggttgtagaatgacaggctctgtctgagcttttagttaattcatgggttcttcaccattgaaggttatggaccgttgtgataatttgatgaaaagctctcaacaactgaacgactaaagaaagggagggactgctgtgggtgggaattacaaagatattagggcctgatacggtggtaggaaccaatcacttgagactgagtgggagaatcactggagcccaggagtttggggccaaaatgcgctgtgactgtgcctgtgaatagtcactgcgctccagccagcctaggcaacatagtgaaaccctgtcgttaaagaatggaaagaaggagggagggaaggaattactgggcagacaattaatctttttcatttgatattattttctattatctccagtcaattttgttttgttttgttttgtttgagacaaggtctcactctgttgcccaggttggagtgcagtggcccaatcttggctcactgcaacctccacctcccaggttcaagcaattcttatgcctcagccccacaagtagctgggactacaggtgtgcgccaccacacctggctaatttttgtatttttagtagagataggattttgccatgttggccagggtggtatcgaactcctggcctcaagtgatccatctgccttggcctccctaagtgctgggattacaggaatgaaccaccatgccctgccccagtcagtttcttaaggattagatattcccttgtactcctttcaaattgtggtatgttgatatatatggagacatatgtatggagacgttggtagcattatcaacattgaataaatgttaaaatctgtattgcagtaagtcattttatatctgatagattgaaattcatttgaagatagaaagtcatggcaaaattaagcaatctcctcttcacttttgtatgaagtgttaatgttcatgtaatttgaagatgatgaatgctgtagatgttagtttgactgttttgttaccacagattcactgcctttttgaaatgttccatagattatagagtgacagtagaagaagtcagctctctgattgctgtctctttttctttctttgccaaacctctagaaacctaagtgggtgttttatatagaatatttttgttaattttatctgctatagaaagtagtagtgtgttgttttatatagttgctaattacatactccaagctgatcatggcatctttgaattcagtaaatactttccttgaaggggagaccttaagtcaaagaaatttgtgattggttgtgagtggacatataggctgacccgctgcacagaccatcacctggacatgaatgaaacaaaatagaaaagccagtttattgtttttatttccagtattgtttatagctctatttgtaaaataatttagttagaaaagatcctaagaagacatcttaaaagagaaaagaccacttgctgtaaatagtagcaaaatggtaattgtcgattcagcataagaatagggcatttaattccttcttttaccttcatttagaaccaaattgaggtaatgccgggtgattttggcagtgtttatttaccacattgaatcaatagtcctgggtttctgtattgtttttattatttctttcccatttctaaataggaaagcaatatttactgatcatttatttcctgatttgtttgttgtcttgcagttgaatccttggcctgaatatatttacacacgtcttgagatgtataatatactaaaagcagaacatgattccattctggcagaaaaggcagaaaaagatagcaagccaattaaagtcactttgcctgatggtaaacaggttgatgcggaatcttggaaaactacaccatatcaaattgcctgtggaattaggtataagctacacccatcatgaccttccatagtttgtggtctaactaaacttccttttattatcttgccatgttttattcttataatatttttatgttaccattcagtgtttttaatctgtttaatttgcctacttgagattttttaaaaatcaaaatgatacagagctttgtagtcaaaattcaaagttaatttctgaaagagtttactttggtcttatcttttggggcattgtatatttttagtcttactatgattataaatgttacaaaaccgactagacagtgtttacctatttcgacttaaatgtcttggttttgaagttaaaaatgaagctacataatctcacatggaaaggttaagaaacttcatataacacatgaaaaaaatgtactatttttataaattcaatgaaagactattcctagtcttaaaacttttattggggtgggaagaagttatttcaattaactgagaattagatgcatattttgtaataggggagaggctttcttaatctgatatgattgggatcaataattggtcagtttatcaaaataagagttggtaaaacatatatatgtgtatatatatacgcgtatatatacacgtgtatatatatatatcttaaactgggtattgggaaactctagtcataatctgtttgtgtatgtcctgaaagcgaaaaataaaaatgattctttttttctttctttttttttttttttttttttttttgagacagagtcttgctctgttgcccaggaggctagagtgcagtggcgcgatcttggctcactgcaagctccacctcccaggttcacgccattctcctgcctcagcctcccgagtagctgggactacaggtgcccgccaccacgcccggctaattttttgtatttttagtagagacggggtttcaccgtgctagccaggatggtctcgatctcctgaccttgtgatccgtccgcctcggcctcccaaagtgctgggattacaggcgtgacccaccgcgcccagccaaaaatgattcttaaatttttaaatagttggaaaaaataaaacaactaagaatatacaacagagaccatgtttggcctgcaaagtgtaaaatatttgtgtggccttttacagaaaaagcttgccaatcttggtcttaaacacttcaacttaaaatatgtgaatatgtatgtattcactaactttatatacatacataaaacagtgaatatatatatgtatggcaaggtttgggggatagcgagtgctaattagagttcttacattatcttaacacatacgagaagtagtctgagcacagaatccttgcagattttcatgtagttgtagagttacacctaacttgacagtgtttttgtgtgtgtgacttggatttatcaagccttctcaaacattcaacttggttttcatagaatccataattcccttattgtgttattttataattatatatttttgaagtttatttataagtgttatgtattgaattgaaccatttggaatcaccatatgaattgtcatgtggttgattatcatcaattttgtattgttgaaccaaacacgtaaaagaacaagcacaaaaacagtttggggaaccaacgtggctgattcttggtaagcgtattatacaactagtagaagcagaaccagttaggcctatgagccatgagcatctactgtaccacagacattagttagtactttttacaaagtgaatggagtgtttccattcatttgacaagtgcttctacctacaagttcttctaccttactccaaaggaagtaaaaagttgtaataccatgcaagtttctatgtgagagcatagagaactggatagacctttacgtatcagttcaacctttcattttagagataattttgaaggtcaggttgattaatagattcctctgttgtcacacaatgagattgtagccgtgtcattaaaatttaggcttctgttagtttgggaactttttcctctaccttctacaatgttgatctagattacattgtaatttatcaagtcttcagttgaaaaatattcttcaagaactataaaattctaagttgaattacatagctgggcgtgttggctcacagctgtaatcccagcactttgagaggccaaggcaggcagatcacctgaggtcaggagttcaagaccagcctggccaacatggcgaaaccctgtctctactaaaaatacaaaaattagccagtcatggtggcgcacacctgtagtcccaactacttggaggctgaggtgggaggatagcttgaactcgggaggtggaggttgcagtgagccaagattgagccactgcactccagccttggtgacagagcgagagtccgtctccagggaaaaaaataaaaggttgaattacataaaacattgatgggctttagctctggagttaagtcactgatctgcactgagaatactttatgaaatttttacaaaagtccagaataactttttgttctgtgaaaaattataacattgataacaggctatttaaagattcacataattagtggtgaatatgaaagggaaggacaaaaaagacatgttccatttgcgtcaaaaggtttttctttgaagttttgttataaatcttttttttttttttttgagacggaggagtctcgctctgtcgcccaggctggagtgcattggcgccatcttggctcactgcaagctccgcttcctgggttgacgccattctcctgcctcggcctcctgagtagctgggattacaggcgcccgccaccacgcctgcctaatttttgtatttttagtagagacggggtttcactgtgttagccaggatggtcttgatctcctgacctcgtgatccacccgcctcggcctcccaaagtgctgggattacaggcgtgagccactgcgcctggccgttttgttacaaatcttaaagattattttacccttctttgaaaaattgaaatgatccagtatggcccatgtgtaatctacattttcagagtaactctattcttagaatcttggggctccatattggatcataagataaaagtcatgttcttcccaaagaatatagagaatatgattatcctttttatcagttctttaatctcctgaaaactgttttacaccaatatgatgaaatacatttctctctgccaaattcatgttatgttttgtgaaatgcatgtatttattttattgactccatctgatctcaggaggaaagaaaacattgtttataacctatggtaaagttagtaggagcattgaaaatagaaaggagtttgttgtttactttctgtttggttcttttctcttgatcctcagataggagttgtatacattttgttgtaaacccttagacatagagagccaccaacacagcaagcctggctagcttaaagccttctagtggtaggtttctttgagatttacagtgtaaagggtgtatactttttcttcacagtgtagaatgttgcctaccttcgttgagatgtccaggctgttatagactattatttctctagctgtgcatttagatgtataatctggctcacctactcaactctgctctagtcacacagcttcctgcaaaaacctctcttcacttgcatctctgcttgcatctgtggccattccctcatctggaatgccatggcctcctcttttcttcctgtgagtgctttatcctcaaagcctttccagatgactctgacctgtactgctttccctcctcagaactcctgtagcttttacactctgtgtgctctgatatttcatcacttgatgatactttatgttcgatgttgtatattgggtgtgtaatgtttttactcacattatatggaaagttttattaaatagtctttcattttacctctatatttgttataaatattatcataggcatttgcagaatttattctgaggttagcattgtctgtcaaagaaaggatctggtgtacattttaagcaggaagaggaacagagaagttatttagtaggccttttttttttcctttggagtctacatagcttagctttgtagaaagagaaaggtgggtgtattaagagaaaactcggtgtggtgacttgtgccagttgtcccagctactctagaggctgatgttggaggattgcttcaggccaggaggccagcctgcgcaacatagcaagaccctgtcgctaaaaaattaaaaaaaaaaaaacttatttgttggagaaattaagattattcaaaccattggaaattgatagtgcttatttatcagagttgccatatctgcttaaacaggaggcattcaatgtcaaatgataatgttctgcattttcaggatcttccagttaggttcttaggtacatttttggaatttgttgtttttatcattatatttcagaaaaatagagatacatcaatataaaaaaacaatatataataaaaatagtgtttattttcctgttttcaaattagattcgtgtgtacttatatatgtgtggacttttttttttttttttttttttaagtcaaggcctggccgacaacaccgttattgctaaagtaaataatgttgtgtgggacctggaccgccctctggaagaagattgtaccttggagcttctcaagtttgaggatgaggaagctcaggcagtaagttgctgattagtattcattgaattttaggatgcagattcacatttgaagtcttttccagctcagtcctgctgcgattgggtggctaacatttattgttgtctcactgtcatatttgaaatcttcattttgtccttcatttagggaacataataaaagtgcttgccttagaaaataaaggggtgaagctgaataagtcttttcattactagacacttcaatagggaaaatgttttgggaattgtattaaacattgattaagcaagtaaaaattgttttctaaactgtgaacactattttattttaattttttttttttttaatgatggagtcttgctttgtcactcagactgtagtgcagtggtgcgctcttgcctcagtacaacctccacctcccaggttcaagctattctcctgcctcagcctcccaagtagctgggattataggagcgcactaccacacttggctaatttttgtatttttagtagagatggggtttcaccatgttggccaggctggtcttgaactcctgacctcaagtgatctgcccacctcggccccccaaagtgctgggattataggtgtgagccactgtgcctggcctctaagctatgaacactctagcaagatatgtacatttgacaaataaatttgaaccttacttcaaagcactgcctttattggataatttctgtatttttttctcatcttaagatgcaaatctgctggataacactataaaagtcaacctgcatgtgatgacaagattttctttttaattctccatggctgtgtatcatataaggggagacaaagtattttgttttagtgatgattgttcacttatgtatgtggattagtggttttcaaatgtattttggagccctcaagtttcttacgagaattttttaatgtcactttggtaccttaatactaaatcttgaaaacattgctttgggtgtattctgactcatcccagtgattactttaaaaccaagtactgccatttgatttcagtgtacagatgtttgtcctcgtgttttgtcattgtgttgtggggtcgggttgtaccacctttgttttgggccagtaacaacatgtaatttctaagtgatgttccatagccagctaaaggccagatcacagtgtctgagacatggtgctgtgggcacattgactcaaaagaacctgggccattgcaatcaatgagttagtcacattgtgagtagcagttgttttcagagaacaaagtctatgtcatttaattagtgatgccaagtttagtttaatttgtttgaaaacagctaaaccagatgatttccaaaataaaaatacactagtaattggaagccttttgaattactttggctatggatagaaacagtagtttatagatttagaaatttaggattttatatattgggtttacttgtagtaaatattatcatctgtctctttcagacaaccacattaattggcaacttgtatgccaagactcagaccatgccatttttctttaaattttcaggtgtattggcactctagtgctcacataatgggtgaagccatggaaagagtctatggtggatgtttatgctacggtccgccaatagaaaatggattctattatgacatgtacctcgaagaagggtaagccatcaactagataaagaaaactgaagtcaatgactatggatccataagttattcttaagagttctcagtaagggaggaatgatatagatctcactgcttcttcatcaggtatgcccattatcagtacttgaagtgttgcaatttacctgaagtaatagaggatttgatgagacctctgttctagattgatggaggtagagtcctaaggtattttgggaaattcagggagactggtcctcccctctcctttaaaacctggtgatagagttgcgggaaggggtcactagtgagaaaggtctccatggatgaccaaggtagaagctactgaaaatataaaatgtaaaaattacttatgaaaaatgttttgtttagaattctaagatacgatgcaatagtctaattttttaatattaaaacccttgaagtattccaaatactatttccaaatgaacatttttcgaagccatggtgtgattcgaatggaatgaaaagattatactttcttctccttcaggggtgtgtctagcaatgatttctcttctctggaggctttgtgtaagaaaatcattaaagaaaaacaagcttttgaaagactggaagttaagaaagaaactttactggcaatgtttaaggtaaattgaaccatagtgcgtggcccccactgttaatatcatttattcatgttagttgaagtgacaccactggcgttccgtgtactaagctgaagtctaattggttctttagcaaaaattaagtgtttttattatttttttaatttcatttttttcctagcaaaccattccttcaacatgtttttaaaacatgaagtatcaacatttatattcatacagtgctacgttttagctatagtacttagaagtaaaaattaaaggacagttttttaaaataataatttttcctgttttcagtacaacaagttcaaatgccggatattgaatgaaaaggtgaatactccaactaccacagtctataggtaagaatattagatgtcattaaatgtatctggtatgtatgtcattttgtctttgttaaaattcctttcattttatctttagatgtggccctttgatagatctctgccggggtcctcatgttagacacacgggcaaaattaaggctttaaaaatacacaaagtaagtaatgtaactttaaagactgtgaatgtatctgtctagaatagatatatgtttaaactttcactgatttctctttaccattttctgttgcacatgaaaggatggtattttctcatgctctctattaactgggagctgtatgccatcaggattttataattgaaatccctcaaggggtgactgacttgctgtcattgccagagcaatcacaggggatggagattttacaaaatcatacagcatgggccatcctggctctataaaagctttgagactcactgggagtatgtgcttttgccctttatatgtctaaattaataatttcccaagttgttgtttttaacagaacccagttttatactagttcataaacattttatggaggtttttaaaatgcactttaaatcaagagaataattgagtcatttcaagattttttttttattggctcatttctatttttgctcattttgtgagaaatgcctttgcaggcaaagtaatgtttgtggaattgtggttgagtattgaggggtgggcagttttgggggtattggggtgtagaatgggtctcactctgttgccccaaaaagacagagtggaggaccacttgagcctgggaaatgaggttgcagtgaatggagatcgtgccactgcactccaggctcaagcagtcctcctgccttagcctcctgagtagctgcgaccataagcgcacaccaccatgcctgggtaattttcttttttttaaataaagaatggggtctccctgtgtttcccaggctggtctcgaactcccaggctcaagcaatcctcttgcctcggcttcacagagtgctgggattacaggcatgagccactgcacccacctgcagattgagggaggggcatttttgaggatagaaaacagccaactttgtgctgcagaatgagtaactactctaacaaggcctcaaagcaattgggagttaaaataagtgagatgtttacaaatttgaatgttgtttcatggttaatccttgttttcagaattcctccacgtactgggaaggcaaagcagatatggagactctccagagaatttatggcatttcattcccagatcctaaaatgttgaaagagtgggagaagttccaagaggaagctaaaaaccgagatcataggaaaattggcagggtatgttcaagaacaatgatgtgtcttgactgagttttcttcaacttcatttgaagtttgaaattcagctgcatgaagtactaggaattttgttttgaagagatgttgtggctttttagtaactggtgctatgtcctgtacaaactataaacacttactgattgtccacattatctgcctggagtatgctcagtaccgcacaaaaatgcatttgaactacttttattgagagcaaacactgatgatctacggttttctgtaaaagaagtataacagcttctcatagagctgggagaactatggaaaccctctagtttcactgactcatttaaaatgtggaaacagagtcccacaaagattaacctacttgttgcccaaggtttagcagcatgtcgcacatggatcctgtgctatcatttcctctacccattatctctgttactgctgaatgtcctctaaactggaagttaggctagataaaacattcccccttaaaataggcactctgtgccaggggtccttggctattaggttatgaagcttgagctggaggtagcagccactgccttgcacccctgactacctgacattccagctatgaggcagccagcaatgattgatgggcccttccctgagggcttttgggcacttggggaggcggatgttggcaaggaggtaggagggtgtgtttctttcaccatgacccaaagtcagccaactttaccatcatctatttcattatcagtgtctttttcccagtctccttcctgatactcttactaagaaaataaatacatacataaataaaatgaaaaaagatccagatcttggagctttaaggaatttaagaaccatgagaggtactgcagtggatagttaaagaactgaagggacccttattccctgccactgttggggaaacttgactggattgaggaatataacaggcagggcatgtgttacacgtctgccaaattgtaaatcagctgcaattctataacatcagaaacactgacatggtttctttgattcaggagtggcactgattgaaatatgggacatcatgaccatattctgagctcaagaacactgaaatttatgtatatatacacacacgtatacgtgacgtacataaacattcttttgcttttcttttacccaggaccaagaactatatttctttcatgaactcagccctggaagttgcttttttctgccaaaaggagcctacatttataatgcacttattgaattcattagggtaagtcatatttattgctttcttctttagatttaggatatgtgatcattttattaaataaggtctactaaaaggaaagataatctgtatttgagaagaaatatataagacgataagtaaaagtagaagtctgtggcctcataaatcatccctaatagttgattttgcccatatacacatagaaactggtgagcttgaagggggacctgtggtccttgacataggagctctgtgccctctttgactttgatcatttatttgtattttctttgaaaaaacggtttttacattgcttttttcctttgtaaattatgaaatgtttcaagtataagtttatagagaatagtatatccaatatcttgtacttaactacccacatttaacaaatattcacattgggctatatttgcttgagattttttcattcatgatattaaaaaaaaaattagttgtttaaaaagcctctctttaggacccagttttgatccatatacctccatatactggtatatatatccatatactggtatatcatataccagttttctagaagaaactactgttttgaagttggcatggattctttttgtccatgttacttatatctagcccatgtatttgtacccttaaattatttatgtatttgtgtgttacatataggaagcctcattgtgtatcagactgccttgtgatttatttttagagacatgcaaatcaagtttattttcacttgctacatattattttgttatataactaccacaatgcactcatccctgtattgatggacactgatgtataattgtcccttattatcagccatgctgcagtagcatcacttttataagcctccttaggtacatgtgccaagagttttctctctggtatatacttagaagtgggatttctgaatcatggcatgtgtccatctttttcatgagagagtataaaatcactctttaagtttttactcccacttgaagtatgagcatttatttgcctacacatgtttctgtttattttctatcagagcgaatataggaaaagaggattccaggaggtagtcaccccaaacatcttcaacagccgactctggatgacctcgggccactggcagcactacagcgagaacatgttctcctttgaggtggagaaggagctgtttgccctgaaacccatgaactgcccaggacactggtattcggcagctttgaatttctactgaagattttcacatgctacaattcatcctgggttcttccctcctttaacaacattttcattaaaaacaaattatgtgatcagaagagcatttaaacgcaacatctttgtattatatcttctgcacctgattagatccccactttttttttttttttttttaaagaggtcttccaactggagtgcaggtatgcgattatagctcactgcagctgggactgcaggtatatgccaccatgcccagctaatttttaaaattttatttctgtagagatgaggtcttgccacgttgctcagcctggtctcaaactcctggcctcaagcggtccttcaaccttggcttcccaaagcgctgggattacaggcatgagccactgtgcccagccagatctccagatctgtgggcattcagtaatggtactgggatcatagcaatgaccaaggcagactataaaacaggaagatgaaatatgggggtgtaacaaattacctagtgtgttgttgttttaaagaaacctgttctgtcaaaacctgctaatgactcagcattcttggaaaatgttccttgtcatgaggccgctctgctttctatctttgaaagttgggtgaagaacagcttaagggaagacacaggagagctgtggatacaggtagcttagtgtctgcagctcctactagccaggcctggagggcagaggaggtgagagaagaatctttgtgaagaagctgtattataggctaggggaccaaccaagttcattcttaattttcccagattcttcagttgttggaatacgttttttaattcttcactgtggttcattgagttataacttatttgctgttttattcatgcaagtgcttttactgctgtatgtagcccagaatttgagaaatgttgcttggatggacagctagaatcagtggctttttgacaacctttcgtgtaattaaatatagcattacagaagcagttttattcttaagtgtccgtggacttttctttttctcttcagccttatgtttgatcatcggccaaggtcctggcgagaactgcctctgcggctagctgattttggggtacttcataggaacgagctgtctggagcactcacaggactcacccgggtacgaagattccaacaggatgatgctcacatattctgtgccatggagcaggtatgagaccctgggaataaaatacttagaaagaagagtcaagaaagtcaaggaaaataactactgtttctttttttgttttttaatttgaagattgaagatgaaataaaaggttgtttggattttctacgtacggtatatagcgtatttggattttcttttaaactaaacctttctactcgcccggaaaaattccttggagatatcgaagtatgggatcaagctgagaaagtaagtggtgtttttcagcgtgcttttgaatactgtttgaaattggcttgttctgagatgtaagaaagccaagcctctttaaatggataaaagcaaaatgaaattggaaatggttcctaggtttgtgtaagctagtttttttctttatgattgtgtatttttgaaatggttgaatgttttcatgacttttttcagttatcaagctataagctttaaaaaggggttggtatgagcatatgttcaggtggacaaaattctaaagcagagaatattgatctatgaaagtaattactgtatttttagtctcaaattaggctaaaagaagggaaattgcgatgaaaaaaataaaaatcattttgctttatcctcagcaacttgaaaacagtctgaatgaatttggtgaaaagtgggagttaaactctggagatggagctttctatggcccaaaggtgagcactaaagtacatttgggtaatatgattttcacttgtggatgaagaagatacgacttcgaaaaaagttggaaaaaagaaaatcagccctaatccaactattgagctccactttagtatcactggcattttataataacccagtctttgcttcttagattgacatacagattaaagatgcgattgggcggtaccaccagtgtgcaaccatccagctggatttccagttgcccatcagatttaatcttacttatgtaaggtgagtttctggtgtctgctctgaatattctccagggatatataagagaaaatatatataataagacaaaacaattttttttttctttatagccatgatggtgatgataagaaaaggccagtgattgttcatcgagccatcttgggatcagtggaaagaatgattgctatcctcacagaaaactatgggggcaaatggtaatttttgtcactgtcttttttttctgattagtataaattggctacaagaaatgtctacttttcgatttaattatcagatggaaagggagaatgattccaatcggttgcttctaactaacgacaagtgttcattaaaaaataaggaatcacaatctaaacacaaactttttagcattaagaacaattgctaatagtaattactttaattccagaacttgatttgtttggatgttgtgtaatactttctaattaggaattagtattctgtaagaagtatacttactgttttggatgcttttctagtaactttgttttgggatttagatggctttgctggttttacatagataaatgaggaggcttatggctttcttcgttcagccttgctaatcataacaagcaggtatttggacatgttttaaaagccaagcattttttaaaacagatgccaaaccgatcaacatttgtgattcatttctgtgaggttaagtaagtttttgtttccaagatacatggccacataactttcatcttaattcttaagcagttttttctggacccacagtgcatttgaaagcagcacagggttataaaagcacccgtgtgtagagccttccatattaatcatattgatttaaaacttttgtaaaatgacgtacattggtttaatcttacacattactgtcatttcagttttatttgaacttggttacttcagaaattaggacagtttctcattctgatcaatgatacaagataatctctagatttctcaaagtcagataaaatgtgagacacattctctgcaaggtatttcaagaattaagggagtcctcagctaattgctctgctaaacctgttttaggtggggaaaagtccatgattagggtagaatttagtgcctactttagccttttgcctgatacaacagaacaactgaaaatagaggaatgatggagaaaaacattagcctgatgtttgcagcatcagaagcatttgacacttgtattgcttcaaagggagaattggatgggcttattttttaataagtagtgaaaactctgatttttaccaagtgccataaccagttattatcaattacaatttgctgaatgatacaaaatggatgttgagtaaactgagggcactgtgtccccgtgaagaataagtaataaaatgaacaattaatcactacatgcagttattaaatcatttgttacctcctctcacagccaatacacagtgttttgtgatgtattaaagtgtgaggcctagtcctatcctcaatttgctttgctatctacttagcaagacaaattgtagttacaggctttccttacgtagggttagttttcttctcctgcatctcctcgccttaatctttattggataggtcttttcattttggggttttttaaagccaagttttaaaagtagtcgttacatgttccaggaaaagatactgaagagtagagtaagaaatatgctgtccctgtttagtgaatatgcccacatctacactgaatatttttattctcttccaaaggcccttttggctgtcccctcgccaggtaatggtagttccagtgggaccaacctgtgatgaatatgcccaaaaggtaagccttagatatgaattttctttcaatttaacatctgttgttcagcttttcaaatcacataagccctgtattcttggtgaatcgagctgttgtgataaagagaaatgttactatttttaatctttgttaagcctgaatagattatattacttctttaatgcttttctccatgattccataatcagaagacatatttggatagtgttttatgtacacttgtatattttattgtatttgttttaagagatgggatctttctcttgccccaactggagtgcagtagtacagtcatggctcactgtaacctcaaactcctgggctcacgcagtcctcccaccttggcctcccgagtagcagtgactacaggcaggagccaccatacccagttacacttgtatattttagtatttagtattttaaaaaaccagattagcagatatcaggtacttcagtatggtaggtaaattcccgttcaaaatacagtttaggctgctctttgactcagtgagtaattttgcttcattttaatgtaaatttcttcaggtagttgaaattttttcaggttaatagtatagcagaccaatgtcttgcctctctaccaaaaaaactaacttaccaacaaatgtatagccattcataacttcactttaaagcattgttctgccatagtgaaaattccatactaaggaatttcaaattattaaaagttgatgagtgaacaatactgtaacatcaaaaccatcatgtcttcagaccatcagaataaaccacactcagttcttaattacccttaagaaataaatgaacttgagcatggagatgcatacctgtagtcccagctacttaggagcttgaggcaggaggatctttgagggttcagggtgtgatgattgtgcttgtgagtagccactgcattccagcctgagcaacatagtgagaccccatctcttaaaaaaaaactgaagtgggccaggcgtggtggctcacgcctgtaatcccagcactttgggaggccgaggcgggtggatcacgaggtcaggagatcaagaccatggtgaaaccccgtctctactaaaaaatacaaaaaattagctgggcgcagtggcgggcacctgtagtcccagctactcaggaggctgaggcaggagaatggaatgaacccaggaggcggagcttgcagtgagccaagatcatgccactgcactccagcctgggtgacagagcaagactccatctcaaaaaaataaataaataaaaacaaataaataaataaaaaaaatgaagtgaacactaaaccatctaatagataaaccattcagactattcctgttactgcactcagtagttttagttacaaatgatgacaatcaaagttatgttccatggttgagtgcactttgtcttatttgtatgtgaaaactcacacagtaggaagaagttctgtattggttaactgagttctcaactggagacagcactgacttccccatttccctttgcgggtaggtggcattccagattatgtggtggtaagcttttcttttgcggggagagaagacagggcagtactcctgatacctaataactatagagcagacatgttaaacaccctgtaattatcaggccacttccccaactgcagaattgcccatctcacgtgcacacacaggacccatgttgagaaaaatgaagaaactgatgccttattctttaaagtagttataagttgaagatgtagacctatcttggcattctaaaattctgtaacaacccttctgaaatgggtgtaataaaatgtcaacaggttaattggttcgtgatcactgtggcttaaaaatctagttaaaatgctaagacttgtgcacagtataggcaaagtcacttagattgtttcaaaaagtatgccttatagaaataaacatttgacatacataaataacccttggtttacacataactcgcatttgagaaatgaatgtgttgtagatcatttagaatctttttcaatcaaaaattgaaagaaatatttcgtcacccaggtcaaccagagattgctggttttactcatgatacttaagtagagtatgatagttactatttcaccttcagctgtacttaagatgttttcctggaaaaattcattctgctttctgaccaggatttccagaaactctgacccttctaagaggtctgggtggaattgtgatggtgattctgctagtagacagtgtaacttctgcgtctacaaaaagaggataggccgtcactgctcacatggctttgcgtgaaagcccaatggtactgtctctatggcagagatgaggaaggaacaccagcgtcctccaactttcctgttcttcctttgggttaatggccactgtaaggaaacagttttctgccacgtgtggggtgatttgaatgtaaaatgcccaactctcatagcaggctgaacagaaacattttttatactcattgttaatttgttctaatctaaattacttttagactattaaatattattctattttaaagttaagggactaatgcctctgataacctgattaaaaaaaaaaactttctgatactcagaagttaagatttattcagttgaagatcatttctttcaggtgttgatcgtgtgatatttttcacatctgtaatctgaggttcatatgaaatgatagtgaaataaaattgttcatttaggtctttttgtcatgttaatatgttatcaggttaatgggaagtttaatctagttaatgtaaaattaataaattgtaatctagtttattgcttttttggaaaagaatactgaaaacattgtttacttaatacacatgacctgaggtaataaagaggagctggcctttttgaggggggaataatggcagtgaataatattatctaagacagttttgccagctttaaattcctggaagttcatccaagaagtcctgatccctgtgttcagtaaaatcatgtgagatcaaaatataattctgattttagatctgacaaattctgtatctctgttacaataggtacgacaacaattccacgatgccaaattcatggcagacattgatctggatccaggctgtacattgaataaaaagattcgaaatgcacagttagcacagtataacttcattttaggtaagaatggaaacttaccaaagaaaatttgccacacctcaggaaaatctactgaaaccttgagacaggtttaagtgaattgtaatcaagaatttatttagttccttccagtcctgattttttttctattatatattttaatatataataactataaaaataggctcatgcatacatactgggtttttttttttttcacttaaatcatggatgtctgtgagaaaatattttgctattataacaagaatgaagacgcattgcttttaaacacatctattggattactttctcaagataatgccttatgtgggattacttgaaaaaagatattcatgatgtttggggttttattatttggttgttacgttgtctagattgactccataagcacagtagttttagatattgcaaagagtttcttttaaatatcaacacatggtcacttgtaccttttaatgtatcagaagctatggggtaggttttgggtcctaggatcatttcttttcagatgttcagtgtgaattcttccatatctttagattaagtctgacaaagctttgtgtgtttgttttagttgttggtgaaaaagagaaaatcagtggcactgttaatatccgcacaagagacaataaggtccacggggaacgcaccatttctgaaactatcgagcggctacagcagctcaaagagttccgcagcaaacaggcagaagaagaattttaatgaaaaaattacccagattggctccatggaaaaggaggaacagcgtttccgtaaaattgactttgtactctgaaaacgtcaatttatattgaacttggaggagtttggcaaagtctgaataggtcaacctgcaggcgtaactatttttgacctagtcagtttttaaacaatgtgcatttgaaggagttaattaaaagagagccaataaaatgattttactcattcagtatctgagtactggaagtgaaacatgaggaatgctttagtgtaatgtgggagaacttttttgtaaatttaatgcaattgaaaaagttttcaaattcaattaagataactagaattggattatggtgtaaaaataaaaaaaaaatttattcacataa

SEQ ID NO: 604 - DNA, 1021 bp, Homo sapiens
tctatgaactcaattccaaaaataatttacacctggatgaatctttttggaaaattttaccaaacagcatcatcttcagtgcttttctaaaccaaggatagaaaaatgcataaaccattggattaaatgtagagttcaagtagccaaaccaaatcaatacatcattcaaagtaggtggaataatgtagtgaagaaaagggtccatgactgtacagataaagaaagggcaccagcatattaggaaaactcccatcacaatccccaatgtcttcacagctttcctttctttgctttgtgaaattccatttttcatttccaatccaatttggagcttctgattggcatcactaattaatcttgcctgttctttagcgataagatatattctgtaatagacacataacataatagatccaggtatataaaaagaagtcataaaggtcagtaccccagatattttgctaaagaagacagagcaacctcctctgcagtgaacatgtttgtaatatatctcttcagcgcctttgaagtttagctccagaaagatcattccaaatgcaaaaacagcagggacactccaactaatgaagatcatcacacaaataaccaagatattcatcttggctttatatctcagtggatcacacacagcatagtagcggtcaatggagatgaaagacaaatggaaaatggaggctgagctcagcataatgtcggtgcttgtgtgaattttacagaagacttctccaaaataccaacagtgctcagcagatctcaccatactgtaaggcatgaccagacaccccagaagaaagtccacagtggccatggaatgaatgagccaatttgttggggtatgaagttgtttgaagtgtgatatagaaacaataactatcagattgccaacgagtgtggtcagaattatgagcaccattaaactgtacagggaagcacggacatcatttgaccagttgtttttcacacaggaaatattaattatattgtggcaaaagggcatcat

SEQ ID NO: 605 - DNA, 98099 bp, Homo sapiens
tgacgggagctctgctcaggcttcaacatggcgggccgtttcggttgacttcgcctgtggaaaccgaattccccctccatggtttccccaggatatgagttgggggcctcacctcgcctataagggtcaggcgagctttctggatgctcgagggacctttcggcctgcgcagccggagcagcttgtcccaatgccctgccatttctgtgagggcccacgaggcctggaggagcctcggagcccccgcaggccctcgcgtcactgcctcaagagggtgctcggagccctgctcgggagctggtccccaacgaggtgtggaaccccttcttgctggaactccacggagagactggtaataagatagtaataagaccgactactgtttattgaacctccgctagtcactggctgtcacgggttgggcgagaggtggaatataaggcccagagttcctctattatagccatggagagccattaatacctgcttaatagagttgtggtgagacatggaatgggcaagaaaggcactcgatttatttgatttttagaatcatgattattattattattttgagacggagtcttgatctgtcgcccaggctggagtgcagtggtgcgatctcggctcactacaagctctgcctcccgggttcaagcgattctcctgcgtcaccctcccgggtagctgggatgacaggcgcgcgccaccatgcctggctaatttttgcatttttggtagagacgggttttcatcatgttggccaggctggtctcgaactcctgatctccactaatccacccgccttggcctcccaaagtgttgggattataggtgtgagccacctcaccagaaagtgccaagaaaggcactttagacagtgccagagttgaggatttggcctctgactcgctgcagttgccacactgcagttgccacactgtggccttagaacagtcttatccagtcctgaaaaccccagtgccttggaaacatcaggattggtcagaaggacagtaagtccttaaggcgccagcccctgctcctccccccagattgaggggtaagtattccaagctctatgcaggaccctaatcctggatgtggacacccacagtcctgctaggacctgcttccagaagagttgatcccagccgtgaaagtgcatgatgccttcagcgaagcaggcaggaaaggctcaagtgatcctcctgtatcaccctggtgagtagccagtagctgggaccacaggcgcgcaccaccacgcctgcctaatttctttgtagagacggccttcgtcatgttgcccaggctgctctggaagtcctgagctcaagcgatgcgcctgccttggtcttccaaagtgctgggattacaggcgtgagccaccacgctcagcccaatttgtgatctttcatgcactctttcatgtagcatgttttcaaggttcatccaacttgcagtgtcttaatgctgaataatatttcattgtgtagatataatgtatttttcaagttttgtttatttttaattggtacacaacaaatatttgtacatatttgtgtggtacatatgtacatgtgatatgttgttacatgcatagaatatgtaaggatcaatcagggtatttaaggtatctgtcactttgagtatttgtcattgccatatgttgggaacatttcaagtcttctcttacagctattttgaaatatacaatacattgttgttcactgtagtcaccctactctgctatagaacattagaacttaactccttctatctaactgtattaaccaaccactcttccctgccaacccacacacccttcctagcctctggtatctatctgtccaccgtcaacttttttagctcctacgtatgtgataacatgcaatatttgtctctctgtgcctggcttacttcacgtaacaatgacttccagttccatccaggttgctgcaaacgacatgatttcattctttttttatggctgaatagtacttgattatatatatcgcattttctttatccatttgtctgttgatggacacttaggcagattctatatttttgcttgtgaatagtgctgcggtaaacatggaagtacaggtatcatccctttgatatactggtttttttcctttagataaacagccagtagtggcattgctggattgtatggtagctctattttcagtttcctgagaaatctccatactgttttccatagtgactgtactcatttacattcccacacataagagttcccctttctctgcatcctcgcccacatccattattattttgtctttttaatcatagccgttctcattgggtgaagatgatatctcattgtggttttaattttcatttcccttattattagtgacgtcgagcattttttcatatacctgtgtgtcttctttggagaaatatctatttatgtcctttgcccacattcgttcattcatttattggagtcagggttttgctctgttgtccaggatggagtgcagtggtgcaatcacgagtcactgcagcctccacttcctggtctcagatgattctcctgcttcagcctccagagtagctgagaccacaggcacgtcccactgtgcccagctaatttgtatgtgtgtgtgtgctttttgtttttgtttttgtatttgttttttttttggagacaggatgggagtgcagtggtgctatcactgctcattctagcctcaatctcctgggctcaagtgatcctcccacctcgttttttgatttttgtagagatgaggtctcactatgttgcccaggctgggcttgaactcttgggctcaagcaatcttactgcctcggcctccccaggtgctgggattacaggcatgagccaccaaacccagcctaatttttgtatgtttttgtagagacggggttttactatgttacccaaggtggtctcaaactcctgggctcaggcagtccacctgcatcagcctcccaaagtgttaggattacaggcatgagccatcatgcctgacccttttcccacttttaaatggaatgattattattttttactgttgaggtgtttgagtttctcgtgtattctagatattaattccttgttggatgaatagtttgcaaatattttctcccattcaacaggttgtctcttcactctgctgtttcctctgatgtgcagaagctttttagtttaatatagtccaatttgtctacttttgtttttgttgccgtgcttttgaagtctcagccataaaatcttttcctagtgtcctgaagtggttcccctaagttttcttctggtagttttatggttttggggcttatgcttaagtctttaatccatcttgagttgatttttgtgtatcgcgaaaggtaggaggttagttgtgttcttttgcatacatatggatatccaattttcctagtaccatttattgaagaggatgtcctttccccaatgagtgtccttgacacctttgttgaaaatcagttggctgtaaatgtatggatctatttctgagttttctattctgtttcattttatacctgtttttataccaatactatgccgttttggtcactagagccttgtaatatatgttgaagtcagatagtataatgtctccagctttctttttacttaggattgcttctctattcgagctcttttttggttccatatgaattttaggattattttttctacttctgtgaagaatgacactggtatgttgatagggattttattgcatctgtgtattgctgtgggttgtatggtcattttaacaatattgatttttttctgatccatgagcatgagttgtcgttccatttctttatgtccttctcaattgctttcatcaatgttctgtagttgtccttgtagaggtttttcacctacttcgttaaatttttttcctaggtattttattttcttgagctatgataaatgggatttccttcttgatttctttctcagctagtttattattggtgtgtagaaatgatactaatttttgtatgttgactttgtatcctccaactttttttttttttgaatggagtcttgctctgtagtccaggctggagtgcagtggtgccatcttggcccactgcagtgtccgcctcctgggttaaagccattctcctgtctcagtctcctgagtagctggaactacgggcgcacgcaaccaggcctggctaatttttgtgtttttagtagggatggggtttcaccgtattggtcaggctggtcttgaactcctgacctcgggtgattctcctgcctcggtctctgaaagtgctgggattacaggcatgagccaccgcacctggctgtatcctataactttactgaacttacttatcagatctaagagtttttggtggagtctttaggtttttctagatacaagatcatgtcatctacaaagagggacagttttacttcctcttttccaatttggatgtcttttatttgtttctattgtctgattgctctggctaagacttccagtactgtgttgaataggagtggcaaaaatagacatccttgtcttgttccagttcctagaggaaaagctgaaagccacgataggatggtgttaactgtgggtttgtcatatgtagcctttattatgtcgaggtattaataggctccttcaatgcctagtttgttgagagtttttatcatgaagatcttttgaattttatcaaaccctttttctacatctcttgaaatgatcatatggttttgttcttcattctgttgatgtggtgtgttatctttgttgattgatgtatgttgaactacatttgcatttctgggacaaatcccacctgatcctggtatgttatcttgttgatatgctgttggattcagttggttagtattttgttgaggatttttacatctatgtttatcagggatattagagtgtaactgtttttttttgttgcattcttatctggttttggtatcagggtactgctagcctagtagaatgaggaagaattccctccttttcaattttttggactagtttgaggagaactggtgttagtttgtctttgtaagtttggtagaatttggtagtgaagtcattagcagtgaagccattgggtcctgggcttttcactgtttggattcttttttattatggattcaatttcattactcatgattggtctcttcaggttttctatttattcctgattcaatcatggtaggttatatgtgtcaaggaatttatgcatttcctctaagttttctagtttattaatatatagttgttcataatactgtctgatgacttttggtatttctgtggtgtcagttgtaatgtctacttttattcgtttatttatttctttattttttgacacacggtctcactctgtcacccaggctggagtgcagtggtgtgatcatgactcactgcagcctcaagctcctgggccgacgagatcttcccaccccagacttctgagtagctgggactacaaacatatgccaccatgcccagctaatttttgtattttttttttagagacagagtttcgccatgttgcccaggtttgtctcatactcctgagctcaagcaatccacctgcctcagcctctcagaaatgctgggattacaggcattagccactgtgtctggtaatgtcttatttttcatcttggattttgtttatttggatcatctttttcattttcttgtttagtctaactagccgtttattgattttgcttacctttttgaaaaaggaactttttgtttcattgattctttatattgtttttgaaatctatttcatttagttctgctctgatctttattatgtctgtccttctactaatttgaggtttgctttgttcttgcttttctagttctttgaagttatcattagtttgtttatttgaaatctttctacttttaaaatataggtgtttattgctataaacttccctcctagcactgcttttgttgtatcccataggttttgttatgttgttttcaattttcacttgtttcaagacatttcattttttgagacagggtctctctctctatcactcaggctggaatgcagtggcgtgatcttggctcactggaacttccacctcctgggctcaagcaatccttctgcctgagccttctgagtagctgagattacaggcacacactagcatacctggctaacttttgtatttttttgtagagacagaatctcactatgttgcccaggccagtctcaaactcctgggctcaagcaatccacccaccttggcctcccaaagtactaggattacaggcatgagccaccacacccagcctgtttcaagacattttttgatttcctctttaatgtcttccttgagctaaaggtcattcaggagcatgttgtttaatttccacgtatttgtacagattccaaagtttctttgttattgatttcctatcctatgtcactgtggtctgagaagatactggtatgattttgatttttgaaaatttgttgagacttattctatgtcctaacatatggtctatcttggagaatgtttcatgtgctggtgaagaggtatgtgtattctgtaactgttgaatgaaatgttctataaatgtctgttagatccatttgttctaaagcacagtttaaaatcagtgtttctttgttaatttcctgtttagatgatctgtctaatgctgagtagagtgttgaagtcctcatctattattgcagtctatctctccctttagatctaatgacatttgctttatatatctgggtatcccagtattgagtgcatatatgtttagaactgttacatcctcttgctaatgtatctccatgtcattctgtagtgaccatctttgtctctttttactgttttgtttgtttgtttgtttttgagatggagtcttgctgtgttgcccacgctggagtgcagtggtgtggtctcggctcactgcaacctccgcctcctgggttcaagcgattttcctgcctcagcctcctgagtagctgggattacaggtgcctgccaccatgcccagctaattttttgtatttttggtagagatggggtttcaccatgttgaccaggctggtctcgaactcctggccttgtgatctacccgcctcagcctcccaaagtgttgggattacaggcgtgagccactgtgcctggcctctttttactgtttttgacttaaagtctgttttatctgatataagtatagctgctcctgatcacttttggtttccctttgcacagaatatctttttccagtcctttcctttcagtctgtgtgtctccacaggtgaggtgagtttcttgcagttggcatatatttgggtcatgtttattttttaaatccgttcagccagtctgtgtcttttcagtggaaagtttaatctatttacattgaagactatttttgatatgtgagggttattcctgtcattttattaattgatttctggttgctttatatgtcctttgtccctttctttctctcttattgttgatcattgtggattggtggttttctttagtgataacttttgaattgttcttcttatttatgtgcttgctctaccagtgggttttatactttcatgtgtttctgtgatggtagatatcatccttttgcttccagctgtaggactgccttacatgtttcttatatacctggttgagtggtgatggaaaaccaacggctaccattaaacttagtggtgaaagtcttaaagcttttctcctaagatgaggaacaagccaaggatgcctgctcttgctttttctattcaacattgtactggaggttctagccaggataattagacaaaaaaaccaaaacaaaaccaacaacaaaaaagaaaaagcatctagattggaatggaaaaagtgaaactgtattttttgcagataaataatgttgtatatagaaaatctaaggaacccacaacaacgataacaacaacaaacctgccggagcaacagttgagttcacaaaagatataagatcaatgtgcaaaaagttatatttagaaacactagcaatgagtagcctgaaaatgaaattaagaaagtaattttatttacaatagcattaaaaaataagactaaaacaaaagaaatgtaagactacaaaacattattgaaagtgattaagtaaagacctaaataaatagatacacattctgggtttattgaatggaagacattactgttaagatgacagtactccacaaattgatctacatattcaactcagttcctatcagaatcctagcttctattttgcagaaattgacttgctgatcctaaaattcatttgaaaatgcaagggactccgaagaagcaaaatgatcttgaagaagaacaatgaagttgcagagtccacactttattatttcaaaacttacttatagtggttaaaattgtgtagtactggaataaggatagacatgtagatcaatggaatagaattgagagtccagaagtaaattcatacatttaaggtcaattgattttccacaagggtatcaaggccattcagtggaaaagaacagtctcttcagcaagtggatgaagttagatctcttcctcacatcatacagaaaaatcaacctcaaatggaagaaatatctaaatgtaagatcccaaaccgtactcttagacaaaaacataggtgtaaatttttctgatactgacttagtaatgatttctttttttcctctccttttatgtgggacaggaaaactagaggggtttagagttgtcttactgcttttcccctatgtcagacaaggccctgataaagcagtttttctttagggcagggctttcacacagagaatagaatgctctgggcatatttcaaaatggttgctgtacccactcactctatccaccaactagggtatattttgaaatggttgcttttcccttttccttgcctaaagagcctgaggaaattttcttcagccttcatcatgagaaccagctagggtttctggaagtaacattcatgaaagtataaggggttcccaaggcgggacttcaacaagtttttaactctcaagctagtccacactcagccaccggtaattaattgactagcatttaagtgttcctaccaattactggctcctgtggcttctgctctcaggtaaactgtgatgttctgtagtcacgtgtctctctagtttttgaggaagtggtttgccctgtgacctctattctctgacagatctaagaaaagttgttgattttcagtttgattatcttttttcctgttgtgaagatgggagtgatgacttccaagttctctgcatgttggagtgggaactggaagacctaattaacttcttaagaaactgccaaactgttttccaaagtggatctagcactttacattcctggcattgtatgagagtttcagtttctctctatctttgtcaacacgccatctttctaattttagatattctaataggtatctagtggtttcttattgtagtttgaatctgcatttctctaatagctagttatgatggccctcttttcattggcttgtcagttgcaaatctttattagtgaagtatctgttcacatattttgcccattttttaaaagttgggttgttttcttacatttgaagtttattttttcttataatcaaaattttaatgtatacataacaaattgtacatatgaggtacagtgtgatgtttcagtacattttacatggtataatgatcaaatcatggtaattagcatatccattgccttaaacatttaccatttctttgctgtaagaacactcaaaatcctctcttctaactagaatatgggtgtattttaaatgtacacctatttattttctcacaatcctagaaaatgatagcttgagtcaatgaagtttcccctgcaagtcctatcaaccttgcttactttagtgaaatttaatatggtctagaaaacactgagccctctggttattctctctaacccacaaaggaagccgaacacttgataaaaagttcatcagcgtaaataagaagaatcccctccattacatacaaaagaaaaaataactggagagatcatctctgctctaaggtgattatcctgtggtctttggttttggtacgttctccccgaccccatgcccttttccctcatctttaatgagtatctgtatgtgtggcagaacagcgtgtttttaagtctctgcagtcttggaccaagctcgttttattccctactctacgagaatctcaagagcaccaggattctgtttggagttgccatggacacagagttcttaatccagtactggcttattctcaatacgaggtaaagacctagaggtgagggtctctgagcaaggtagtcccatcccatcctctgccctctctgttggctaatgttgtcctctcatcctcatcaggagaattaaaatcatgtaaagttttggtgggggaactaggtggtggtttctggggcccacagacaggaaagtttgcttatagccagttggggggaccactaattgatattcctttcccctcccagggaccttacggagtccccttatcctcagggtactgggggacaactagtgggtgtagggccaaatagtaataaccttgttatttgccaggaatggggtaaagatttgatctaacaagcttggttttgggaattaaaaaatgaaaaaaggaaaagctataatcctgaaaggcaacaggagagaaaagtgctaacaggatcttgaataaatttctccctcttagagaaagttgtactgaagacacgagacctgagacttgtgtcattttagcggctgaaccgaccccaacttcttctgagcggcagtggcgccagaagcagtctggctttcaggtaagcaggtccagggcttacagggagaaactcccaggtatccagctctgccttgggttgccctggttcacatccaaaggtgtgcttgggccacatctctggagcagaaggtggtagactgagagctttgatatttctatttctattgcacatgagctggtataaccccaaaggtatggaatttgctgctgtctgtgacccagcaaatagaaataggaaagtaatgaggtagaaaaataatagaaatagaaaaaaaattgtaaaaataaaataagcttcattctatgcctgttaatgtccttaaaaataggacatttttaggcagtgtgataacatgcatctactggttgctttcatatttcctataggggtggctgcttgccctaatggtggatgctctgttcaggatggtgacctagtgctcagctctggaagccactccacagagatggccaccgaaagggcttcagtggtcccatctcaacacctgaaacattgttaattattacagtgaaggccacaaatgggcttttattagtgagattggtgacttacaaagcagcatgatggttgttacaattatatgacattttaagatctgtgaatcagctaaagtgttttggagacagcccacccttgcataaacaggataaaggtttatgaatatggcctgtagtgtatacttagagatgacaccccaggcttgatcctcatatggtcctatctccaggaaggtttaggaagattttggcctctggaatattaggattctgttgagaatgaacctttcatgcttggagcacctaaagtacagaaagcttacagaagcttatgtaccgtgcctgcttgctactgaatgttttgttaaatgaatatctgtatgtgtggcagatttgattggagagctgcttttcattataacctggtagcctgattataaaggtgtagctaaccttcacctaactcaaacttctgtggtttctcctgtctaccaaaaagcatttaagaattctgcgtgatcacgttattttaggatagtttgccattctcaccttccttagaaggcaatttagctagctacttatgcatgtcccatgagggaagtcagtctgtgctcccaagcagcttatcaaagtatgatttcagacttcatgcaatactctccctgaaaggagttcaggtaacatgtatggatgtcttgtgtcctttttggagattagtttcccaaggaactcgcttagcagtcctggcttgtcacctggatctgaagagtaatttgagtgtcttcccattctcttcctcggtagaagatatctgaaaaatccagtaatcattcaataaggctgcttatgtcagaaactcaaattcttatgtttttggcgttttgaacattttcccctgttatgacttattagtgtattctgcatagacaacccagttgtccttcctgcagaaaagcagcagatacctctagatgcctttctttttgtaaaaggtattgtttttcctgagacctggatgaatttccatgagccattcaagggcatgagaacacccacttagaacttgagaggttcccttcatggccctcagactgggctaacgagatttgataatttgaactccagcactcctttcctcacaggctgaaagaatagcacagtattaatgtctatctgcgcttaaaggtttgagctatcgaccacagtccaaaattagtttgtgtaggagaacttttacttaaagacataaaaagataccgtttaatatattgcttctaaaatgtgtttctcacacatttccactgtgagaacgaggttctgtggtcaaataagtccagaaacctcagcatgctctagggaatcccagtttttatcagcagcagccaaaaaaaaaaaagcgtgcaatcagtttctgaaacttatttaaacatttgaaaagttagcaaattgtggcaaagagcattaattcttgagtcttgggagtgtattactttgataagcatgtttgtgtatttgaaactaaaactatgtatcagcttatattgccacatactgatttttatgacataatatatggtgtagagaacaggtggtctaaaaaccaatatttgcaaaatgctgaatattcagcatggttttatgaagttgacagatgtggagtgtattctgcatgtgtcttaacttacagatgaggaaatgaagttgtagagagattaaattagctaagccagtggtttgggtgctaggaagtcttgattttgtaaaatatagccatataatttaaaaaaaccgagaatccagacaaaaagaaaacaaaatcagggcaacagcgattttcagggaagaaaggagttaactataaggtctgactgcctgcggggccgggcagaacagagtcttatttctcttcttggagaaagcaagtaggagaagtatcactgagttcttttcccagcaaggaataaccctgggaaaggaatgcattcccagggagaggtctataaatggccgctctgggagtgtctgtcttacgcagttgaagataagggatgaaatactccctggtcttctgcagtgccctcaggcttgctaggattaggaaattccagcctggcgaattctagtcggacccattgtctgctctggaaccctgtttcctgttaagatgtttatcagtgacaatgggtgcccagtgggacatggaacctcatcagtaattctaatttcgccctggccttgtgatcttgctctgcctgtcttcccttgtgatcttttattggcctttcaagcatgtgatcttgtaacttactccctgttcctacccccctccccttttgaaatccctaataaaaacttgctggttttgcggctcaggaggcatcactgaacctgccaacatgtgatgtcagccctggaggcccagctgtaaaatttctctctttgtactctttctctttatttctcagactggctgacacttagggaaaatagacaagaatctatgttgacatattgggggctggttcccccgatgacaactaggatgggtgaaaactgaggaggtgattggaggtaatagagaatgaggtactcagatgaaattataagaaggggacttaatactaaagttgaactggaattaactgccctcgaaaaaggttgttacacattgaggtgaagttgcagttacttagtctggatgcatcgctatgttcacagcccaagatattcactgttggcacataaaacctcatttctaataagaaaaaatttcatcccagttcaatgagtgtatgcaaggaatcactcatagagttagtgtagctctttgattcaaagcattagaataatgtgtcctgtctgactctgatcatatttgtcccacagtccccatcctgttgacctggtggaagtcatcattgatagagacaccgatgacatgtgagttataaaggatgtacacacaaacatacacaaacaaaacagtgacagagaaagatattcagattagtgggatttgctctcaggagtgtccatggcaatacagagtgtcttggacacagttcatcttctcactgtagcacctatagttaaacatccacatttttacaattgttttggataaaagaggaacagagtatctggctgttactgtcttttcaccatttgttagtagcagccaaatgccttgaaaactcagattttctgtgtatgagacatactagagtgggccgagggaagagaaaatcctatttggagcaaggaagaggtaggagtacttgggtaactgtgaagtcctcagcagaaaggaacagagctaagagacttggaggtgttctccagcctccagaactctgccaccatggaggctggtgctccggaccttatatcaccaccatatcgggttgtgcccctgtgaaaaacctctagttacttgatgcgttttgtggggctggggagacgcccatgctgggtgaaagtaatgaggtaatggaggatttttgaagcaggacattcaatggattaagaggggtgactacctaaaaattggagttgagtttgaaataactgccaccacaaaggctgtcacacgttgggatgaggttgtaatgaaaaggttcacttaaatctggaagcattactattttctccatcctaagatggtggtagccatcatataaatcctgatttctgataaaaaatgatatttcaggtccacatagtgctgtacacatgaatagtcagaaattaaccagtttatgtttagagtaatgaaagctagtttttcccgaaaagtaaatttcgaattatgtcacctgtctgactgtattcttttatcatcctctagtccccacacaagtgaactgacaggaggaaccaaggaagcatgtatctacgaaaggtgagttataaatagataaataaagacacatgtatgcgtaagtgtgcatagaagtatatacacatgcacaggcatgtaaacaaatctgtccatccatctatacacacttctctcaacacacgtacacaaacaaacccatgcacacaattgaatcttaaaacaaggagacagatggacatttgtggaattttctctcaggagcctgcatggccatacagtgttttttaacagggtttccagttcttctcgttgtagcatttgtaggtaactttgcatccttttttgatggagttatataaagaggagcaagtcatagaaggttgcttcttcctgttagtgtattcatcacctttagttcttagtaagcagttttttaagggactcagagttcctgagttcgagagcctaccagagtggcccaggggaggcgagaatcctatttgcgacatggaggagatagcagcagacaaggagcagtggagccctgggcagaaaggaatggagctaatggaacatggacttgtccctcaccgtccagacctctgtcaacatgtgaggttggtgcccagacccaaccccaaacccaccagctcattggatgcagcccttctttaggcccacagctacttgcctgtgtctcatggacaggaaagactagcatgatgggtgaaaggaaggacatgatggatggttttcacaggcatattcagacttctactggaaataaatcataaaaaatgtaagttacagggaaaacctgatgcaagttaattatagtgtaatgctcaagaaaatttacaaaattaattagatgttacagaagctataaaaagattgtgtttgatcagtgactaatttttaaagaggttctttgtgctacgtattaccacttcttttgcaaggaaacatcaagattgtgaattctgtaattgctcattaagcagtagtacatcagttgaatatgtagtattgatttcttaagccagtaaataaaaattttctctattcattttatggtacagtggaggcatgggtgaattaaaatgtatttctaatatgtagataggtttaatttttatatagtcatttaattgtttaattaattggccattgaaaaatgagtctttgttaattgttggaatttacttactggacttacgtggtaggatttgcataccctcacccattacatatgtgtatagttgatattttatttttatggaaaaactacttttggtgcaaaaattgtttttgctactagtgtcaaaaaaagagaaaatcatgtggtgtttatatggctctgtacctttttactccatgagcactgccttcagtgaaatgacaataactcatgcagcatccttcaacaaaaagtgaggtctaaataaattaaaagctagatgtaaacatatatatgtaaatatacacatagacacacacacacaaaagcatacatgtacagaagagagattcagatttggcaagttcattgtctggagcatccataagaatacagagtgtcttagacactgttttctaaagtctaattactgtagtacctgcagttacctttctatcctttttggatctagttggataaaaaaggaacaggtcataagagcaatgcttcttattcctattgcattggtcactcttatttagcagtagccaaaaaccttaggaaaatatgagtgagccaagagaggagacagtcctatttttagcatggaggaggtagcagtgggcagggagctgaggagctcttaacagaaaagaacaaagctagtagaaccctgatctcttcctctattaccacatgaggttactgtcccaaaggcaaacccaccatcagattggatggagcccctgccttaggtctgcagttacttaaccgtatctgaggggcagaaaagacatccatgattggtgaagagttattggtatttgaacttgagaaggcagaaacttacaagtgcaagcaaggtgggtgtttacaaactgaagttgaacttatgtaaattttgccagaaatggtaacttggggattagggttaggagtaaagaaatgtatataaacttcactcattaagtttttttccacaggcctaagaatttcattgcaaacatctgaaacctcgtttctagagaaaagttaaataccaggtttcaaataaataactgattaagatgtcaatttttagggtaactaaattataaattgtagagtaattattactcatttgtgtcagaaaaatagtctaggaagacatgtggagtcttcctatattcatttttaatcatttagctattaccccattgaactaaaaagagtagtctgtggtagagtcatcaatatatggggagaaagaaaagagggagataatgagattggtaagattcactcacaaatgaagtaataaagaattgtacttaaattttgattcactaggctgtttgttaaggcccaaaagcttttttacattatgtaaggctttcttttagggaaaaaaaatgatatattaatactagattccaagtaattaattgacatatacgttttcagagttcaaccagtttataaatgcagtagaacaattgtacataacttcaaccagaaaagcaagtctctgaagtcgcttgatctggcatgtacctttttaatccttagcactggcccagataaaatgacatcagtagtctttcactactttgatatatctgctgtaactcacctttcaatggtggtgtcattgaagacaactgatgttattaatctgggtcattgctaaagaatatatctatacacacacacacacatacacacacacgtgaatatatgtatgtgtgtatatatatatataggtatatcctttatatatatatttagtatatatagatacctacatacatgtatgtgtgtatatgtatgaacatatctatatacatatatctatatgtgcatatatagatatatacatatctttatgtacatatatgtatctatatagatatattctatagcactgaccccaattaataacatcagtagtcttttatgtataatactttagcatatagacatgcatgtatatatatagatacgtatatgtagatatattgtttagcatatatgtatacatatacagtatatatgtacacgtgtgtgtgtatacatgtataccttatgttattgtgctttactttattgcccctcagatattacttttttataaactgaaggtttgtagcaaccttgcattgagcaagtctcttggtttcatttttccaacaacacatgctcactttgtgtctctgtgtcacattttggtaactcttgcaatatcttaaactctttttttgagacagactctcgctctgacacccaggctggaatgcagtggcacgatctcagctcactgcaacctcagcctcccgggttcaagcgattctctgccacagcctcctgagtagctgggattacaggcacctgccaccacgcccggctaatttttatattcttagtagagacggggtttcaccatgttcgtcaggctggtctgaaactcctgacctcgtgatccgcctgacttggcctcccacagtggtgggattacaggcgtgagccaccgcacccagcctattttaaacttttttgttgttatcctatctcttatgatctgtgatcagtgatcgttgacgttactattgtaattgtttgggggcaacatgaacatgaaccatgtcctataggacaactaccttaatcaatgccatgtgttttttgactgctccactgagtagccattccccatctctctccctcttcttgggcctccctacttcctaagacacaacaatattgaaagtaggccatttaataagtctatgagggtttctaagtgtcctagtgaaaggaagagtcagaagcctctcactttaaactaaaagctaaaaatgattgtgaggaaggctagacttcttgcaccagtcagacaagttgcgaatgcaaaatacgtgtatatattctcaaagaaaattaagactgctactccagtgaacatacaaatgatgaggaagcaaaacaggctgattgctaatatggagaaggttttagcggtctggatagaagatcaaagcagccatagcctttccttaagccaaagcctaatccaggacaaggccccctctctctgcaattcagtgatggctgagagaggtaagtaagttgcagaagaaaagcttgaagctaacaggttggttcatgaagtttaaggaaagaagccatctccataacataaaagtgcaaggtgaaacgcaagtgctgttatccagcagcagcaagttatccagaagatgtagctgagacaattgatgaaggtggccaagttatccagaagatgtagctgagacaattgataaaggtggccacacgaaacaacagattttcactgtagacaagatagccttttattggaagaagatgccatccaggacttttatatttggagagaagtcaatgcatggtttcaaagcttcaaagcacaggccaattctcttttaggggctaatgaagctggtgactttaagttgaggccaatgatcattgactgttctgaaaatcctagggcccttacgagttatgctaaatcaagcaagatgggtgactagagatgccttgtgctcatctcccctgcaagaaaacccaggaacaaatacacatctaaggtctgattagagtatcaaagggatagtcctggagtgcagcagaggagtggaggagacacacctgtggtgactggaagaccccacagcatggaagcactcagcctctgcagccccttctcccccacctgggttgaactggcccagagacaggaaggacttctcactgcagggtgaaggtaagcagaagatccccaccagccccactgccatcacaaacacagcgtcttaaggaaaatctcacagtatttgcaagccctgaggccagtatggagtactgccaggaatttacacagctgcatgtcctggactaggagtacaaggtgaaggcttcccacccccagagacctaagttgcagcaacacagcaccatcttgagaccagagtcatctcttgagtgtgccctcctctgggggccagtagccactgtgcgtctccagcactggagctttaccttcagtataccaagcccacatgggtgggttaaagccacaaccccagctgtgtggaggttggtcccagaattggcggtaactcaagtcctgaagagcagggagaaatcaacccccaccactacacttccagacagagaaataatctgcactcccatccagggtgaactcacccttgagctagccaaaccactacatgccttctctcaagtgggagcgtcccctaagcctctgagcagctgatataccccaaggtcaagagagtgactatgagtgcatgctcaggacctgagaaacagccctgcaggcctcatccaccacagacatgctcctgacctgcccagccgccctccgcctttaataaaggcctgagaaacagtcccacaggctgccgcgagcaggcacagcactgagtgggccttgaacctgtgtctcagacctgagaaacaagcagctgtgtgtgcctgagtctcagggctgagaaacaaccctgggagcttactctggccagcataccctcaggccaaataagcagccacatacctatgtcccagcttgaggaacagccctgtaggccaccccccgcagaaacactcccaggccaactaagcagctgtgcaacctttcatgagcccgagaaacattcctgtacccattcccagcggatgcacctccagaccagccaatcagccatgaatgcccatgtcctggacctgagaaagagccccatgggctactcccagaagacatgcccctaggccagccaagcagccttgtgcccacatcctgggtcatagaagcagccccctgggcttcccctggcaggcaccacccaggccagctgagcagcagtgtgcccacatcctgagctagaatagccctgtggactacccccagcagacccacatccaggacagctgagaaattatttgtatcccaggcctgagaaacaccccctcttggccagccctggcaaagatgccttcggtccagcttagtagccgtgcagctctatatttggcccatgagtttcccccagcagactggcctcgggccagatgaacagctgtgtatccacataccaggcatgggaaacagcccttcaggccactcctggagtgtgtgcttccaggccaggcaaacagctgtgtgcctgcatcctgggcttgagcaactgcatccccatgctcctggccagagtaacagcaccatggccagccccacaaagccatactccaagttttctgacccactgtatacctgcacacacccctaccctgagaaacagtccagagagcccacccctggcaaaggtgcaccaccattaccacaaacttccttagcctaggccactgagaaacttgcaaatgttactagtgtggatcacagcggaatgaactatatggagactacactttactgcatccatgtagaaccaaggccaatataccccaatgaactgacacccaagacccattcatacaagtaaattcatacaagtaacctactccataaaattggaaaaggtgactttttcaccagatgcatagaaatcagcatagaaacacatcaaccatgaaaatgcaagaaaacaggtcacctacaaagggaaataataattatgtagtaatggaccccaatcataaacatatgaaatgccagaaaaagaattcaaaagaataatcctaaggaaactcagtgagatataggtaatacagatagacaagtcaatgaaatcaggaaaacatgatttgaatgagaaattcagtaaagatagagatatcataaaaagaaccaaacaagccctaagagctaaacagttcaataaaagaaataaaaaatgaaatcaatgactttacagacaagaacaagcagaagaagtaatttctgaacttgaagagaagtcttttgaaataacacaggcagagaaaaaagaataaaaaataatgaaaaaagcctacaggatttattggacactgttaatttgaacaaatattcctattatgggcattccagaaggaaaagtgaagagaaatgtgaggaaaacatatttaataaagtgatagcataaaacttcccaactcaagagagagagatagacatctagttctaggaagatcaaagaaccccaaatacattcaacccagacacaaagacaaagattttttaagatagcaagagaaaagcatgaaaacgcttataatggaattcccgttagacgaacagctgatttcccggcagaaaccttaggctggaaaagaatgggatgatatatgcaaagttctgaaagaaaaaaaaaatctttcaaccaagaatattatacccagtgcagctatcttttacaaatgaaggagacataaaatctgtgacagataaacaaacaccaagataattcatcaccactagaccagccttacaagaaatgcccaaggcagtcttacttctggaagtaaaaagatgataaccaccatcataaaaacatgtaaaactttaaacgtcactggtagagtcaatacatagaaagagaaagggatgaaaccttatcactacagaaaactacccaactacaaaagtaaacagagaggcagaaaggaacaaaacatatacaaaccaaccagaaaacaataaaatgtcgcaaataactcctcacctaccaataacaactttgaatgttaatagattaaataccccaagaaggatatagacttgctgagtggattaaaaaataagacccaactgggtgcagtggctcacgcctgtaatcccagcactttgggaggccaaggcaggcagatccggaggtcaggagttcgagaccagccgggccaatatggtgaaaccccatctctactaaaaatacaaaaaatcagccgggtgtggtggtgggcacctgtagtcccaactactcgggagggtgaggtaagagaatggcatgaacccgggaggcagagcttgcagtgagctgagatcgtgccactgcactccagcctgggtaacagagcgagactctgtctcaaaaaataataataataaaaataagacccaactatattttatctaaaagaaactcaccttacctctaaagaaacacatagactgataatgaagggatggaaaaagatattccatgcaaatggaaaccaaaagtgagcaggaatagctatacttatatcagtcaaaacagactttaagttaaaaaccataaaaagtgacacacaagattattatgtaataataaagggttcagttcagcaagaaatagaacataattgtaatatgtgtataatataattgtaaatatgtatgcactcaacaccagagcacccagatatatatagcaaatattagtagatctaaagagggagctagaccccattacaataagagttgggcacttcattatcccactctcagcactggacaaatcatctagatggaaaatcaacagagaaacatcagacttaaactgcaccatagaccaaatggacataacaaacatttacagaacgtttcacctaacagctgtagaatatacattcttttcatcagcacatggaacattatccaagatagaccatatgttaggccacaaaacaagtctcaacacatttttaaaaactgaaattatatcaggtatcttatcttaccacaatggaataaaactagacatccataacaagaggaacattcaaaactatacagatatatggaaataaaacaacatgctcttgagtgacaaggagtgaagaaagaaattaagtatgaaatttaaaaattccttgaaacaactgtaactagaaacacaacctaccaaaacataagggacacagcaaaagcagtattaggaagcatgttcatagcaataaatggctggatcaaaaaactagaaaaatttccaataaaccacctaacaattctacctcaagaaactagtatggtaagaacaaactaaatcccaaattattaaaaggaactgaataataaagaccagacagaaataaacaaaattcaggcaaaatttacaaaaggttaacaacaaaaagcaggtttaaaaatatcaacaaaccattagctagactaattaagaaaaagagaagacccatataaataaaatcagaaagaaaaaatgggacctcacaacagatatgacagaaataaaaaggattattagagactattatgaacaactctacaataaatttgaaaacctagaggaagtggataaaatcctcgacccatacaactgccaagactaaaccaagaagaaatagaaaacctgaacagaccaaaaagaagtaatgagattgaatcaggaacaaaaaggccttcaacaaagtccaggatctgatgacttcaccacttaactccacctgcttttaaaaatgaactaatatcaattcttacactatttcaaaaaattaaagcagaggaaagtcttcctaactcattctatataagtaaactatggttgataaagtagtggtaggatttgagaggattcactccaattttgaaaacagttctactgtgggtaaaatgctatcaaatggcatcacatgttacagagaaatcacttgtgaaaggaagagtcatttgatatagtgaagttcgttgttgtcttattttaagaaattgcctcagccaccccaaccgttggcaaccacagctctgatgagtcagcagccatcaacatggaggcaacgccctccaccagcaaaaagtttatgacttgctaaaggctcaggtgatcattagcatttttttaaccaataaagtagttttactttaaggtatgtacataatttttttttgacataatgtcgttgcacacttaacagactacagtgtagtataaacataacgtttatatgcacagggaaaccaaaacatttgtgtgagtcacttaatgcagtttttgctttattgcagtggtctggaatgaaacccacaatgtctttgtgatatgtctatacacatttatgtattctataactatatacatattcttttaattacctttatatacatatatagaaagagacagagagagaaaagaagagaaaaatatgcaaaattcagcgttgggagtatctgtgagaatagtttctggttaatgactgtaattttctttcttaaatgtcaggtcttccagtgagctaagtcatgtttactatatcctttagattcatggaattcttgttattcaaataaattcttcatcactgttttgtgtagcaaatatctaatgatatatttttgcatttttttggtggctaaagtgtgtcagaacgactttccaggtttgaagattatgaaaatgctgaatatgtcgcttcatatgagtaagtcagtttgaagtttgaaaggagggagccattgatggatctcttttctttagttgaacagggcttacgctgaggcacaaaggaaaaagggaaactacggaaggatatcaaaatgtatgggtgtgtgggtgggagagtacaccatatttcctccaattgaattcttagacaagtattattttgaaaaaaaattccatccattcaggaataaatgttcttctagcttgaaaatgtaaaaagtatccttagaagaaattaacttcattagaagttttttttttttaaaagaaaacaggaatgcagaatgttacttactcatcaatagtgaacctttctcatttttactggatattgtgcgattcccagttttgtagatttcacctatgagcaagtggtattgatagcaaaagcaaacatgttttgctgactaaagacctctttatgctcactgggattttgttattatttgtttctaatctcactagagtactgagtactcctattgcactgacctgaaggcattttaccatgtactcactgtaacgaaacaacacattcttaaactggcttgtgtctgaactgcagacatattcaggagatttttcttctgcttctttcttgcccagttgtataaccattcaccagcttatgtcaatgttggagaggaagtgctgccatagaggaagttaactcatcatggttataagctgttggtgtctaaacaaagattacatgggaaacagagggcaaatacaaatagttcttcaaattaccctgagttttcattttctagaaatttttatcatgggccatcagtgaagaattcacggcaccacttaattaaactgtgtgtctgcatactagctatacattttctgtaatggagctgcccagggttgaggcaaaattagacagattgagcaaggcaagcatttcctttttctttcccctctccaaacaaaagaaagcaggtttttgttttgttttatttttaagttacaaagtctcattgcataaatataggaggaattggtagtggtccctgtgagaaacactggtgtttcataccagggggatgatcttggatttatagtaaaagctggaatcagtgcttggctttgacatcatgtattcattcatctgatactcaggaagtcattgaacctcttttagttttagattattcaaatgtaaactggttataatgctatctatgtagtggatattgtattgtaaaaaattagtaataaaactaaaataacatgcaaaaacactttgaaaactctgtagctctgtgaataggttttgtgcgaaaaactgaaaataacgtgagagtttattaaaggaaaatcagaaaatccaatcaacaaatctgcccacatgtagtcattcttaaactttgatacatgcacttctgagttctttaagcatatgcattttttgtttacagatacgagaccatacttatattattttgtaaataaccttattacttaatgacatcatgtctatattttcttgttaatgtatattcatgtgcacttacaacattatttgtaatagttttgtaatactgcatggtgtagatgtgctataattcatttaatagtcagatattgctgaacaattaagttttttacaagtttttactgttacaaaaaatatttgaggctaaatctttgcatatcgttggttatttgcttattataaattctcagaagtggaaatcctgtgtcaaagggaatgattatgatgctattggtattgataagtgcttgaacatcaagatgctaaagtgtacatttctcccctcccatacttaacgctagctgtcattgatttctttgatattagtaaatctatttgttctaatgcacattctttgacataccttcatttatgcttttttcagttaatatttcatcatttccaaactacctttggccagttaaaattggggtgtttttctgtctttggactgaaaagttaaatctgttgatcctttttctattttatgtaatataagtagtttctcccagggtgtcttgcttttcactatataaaaatgttgaatcttcatataatcaaatgtacctatacttttctttgtgatttatgcctttaatgttattctcagaaagtccttctctaccccaagattttaaatatattcatcaagatttctgttttgagcttattttcttcatttaaataaaatcgctgccctgaatttactttgtcttaaggcataaagtgtagaaatttacttttctcctgtgtgactaatagttttcacagcatcaaaatatcatccccctgtattgtccttaccctgttttagtgatctagagtgagatcaggaagaccagagagtcagtacagtgttttcattgctttgcatcatggccatctccgtaccgccagagtctgtaccagagaaaaatgtgtccagtgggagagatagcacctgccctcgatacgaatcccatttcattaaaaatggtcttgttagtgtcatgtagcttccaccttctattgataaaaaataaagtcatggtcatagttaatatttgtgctttgaattccactttgatattaatattggaacttatagtattttaaggtttagtatctcatgtctttttctcttttctttttctctttttttttttctgagacggagtctcactctgtggccaggctggagtgcactggcatgatcttggctcactgcaacctccacctcccaggttcaagccattcttctgactcagcctcccgagtggctgggactacaggtgtacatcaccacgcccagctaatttttgatatttttagtagagatggggggtcgcctaggatggactcgatctcttgacctcgtgatctgcccgcctcagcctcccaaagtgctgggattacaggtgtgagccaccacacccggcctctatctctttatttttaaactgtcatttaaatttagtttttgtctcttgtgtatagcatgtaatgcctttgattttaaagttatctgagtgtatttctcatggaatatgggaggaatatgtttgtatttatgatttctggtatgtttggctttattgtctttttctttatgaaaaatactttgatattttctttttaaattagtctatattttgctagtaattgatttgtttttatcccttacattttttactgataggcaagtcagaagcccatttctagtccatcagtttatatttaaatatttagaaaacataattataccatttttctccatcaatatcgagaataaaactggacttgtatctgtagaagataagaaatgcaatctgcctttacttctatcttcttccaaaccttgaatcctagtgtaagaatgcctaaaatttaaatcaatactattattgataattttatattatctttacttttagaatcgtttatttacattttcacctacatttttatgctacattaacagttgttatttagacttacttctgagtttatattatttaccatcttttctctataagtcatgttccttattgctctgttcttcattttgattcattgctcagctgactcaagcactttgagtaattatttttaggaaaggcacatagaggctatgctttgagttgctgcatgttggagtgtctgtctgttgctctcaaatgtgaacagtacttttcctggatatggatatattgagtcatagttatttccctgcaaactctgcatgtaactgcttgaagctgcatttacatagtacacttttttaaccaaaataagtctcaattgtatatttacttggtacagtttcaggggacactgaaacagattgaaggggctaaagccacccaagccactccttcatgccttcatgatctatcaggcttggttctgtatggtgatattgtcaagtgaattcagattgatgacatttccttgatacccagagatccagtagactgtgtgggatcagaggttcttgtaaaaagagaatggcaacttccggagagaattcgcctcttttggccaactgatcctctgtctacatcagccttaactttctaagcctgggtagaggtggtgggtccaggtggatgaggggaagattagaaggattggggatttcctttatctcaggttaacctaacatcattcatcaaaggccaattttgctttttttaacttttattttaggtttcgaggtacacgtgaaggtttgttacataggtaaacatgtgtcagggtggtttgttttacatattatttcatcacccaggtattaagctcagtacccaaatagtgatcctttttgcttgtctctctcctcctactctccccgctttggtagaccccagtgtttgcttccctctttgtgtttttacatccttatcacttagctataccacttacagatgagaacattcagtatttgatttttgctttctgcactagtttgctaaggataatagcctccagctccatccacgttcccacaaaagacaggatctcattctttttttctttttttgagacggagtctctctctgctgcccaggctggagtgcagtggcacagtctcggttcactgcaagttcttcctcctgggttcacgccattcttcctgcctcagcctcccgaatagctgggactacaggtgcctgccaccacgcccagctaatttttttgtatttttagtagagacgagatttcatcgtgttagctggggtggtcttgatctcctgacctcatgatctgcccgcctcagcctccgaaagtgctgggattacaggcgtgagccaccgtgcacggccgatctcattcttttttatggctgcatagtattccatggtgtatatgtaccacattttctttatccaatctgtcattgatgggtatttgtgttgattccatgtctctgctattgtaaatagtgctgcagtgaacattcacatgcatatgctttacagtggaatgatttatattcctctgggtatatactaggtaatgggattgctcagtcaaatagtagttctacttttagctcttcgaggtgtcgccatactgctttttacaatggttgaactaattcacactcccatcaacagtgtataagtgttcccttttctctgcaaccttgccagcacctgttattttttgacactttaataatagccattctgactattgtctggtgtgaaatggcatctcattgtggttttgattggcatttctctaatctgtgatattgagcttttttttgtatgcttctttgccacatgtatgtcttcttttgagaaatgtctgttcatgtcgaaggccaattttggcagtgccccagttctcctcagtgtctgtcctctttttttctccagtcttaggcacaggctgtgagcattgtcttaggattcatgcctcttggggtgaaatttgagtcctgtgttggaggcttcagtatgacagaaacttcctgaaggcttcagtaagacaaaaaattgttcctcatcagctaccttgtcttcagccataaggtaaaatgaggcattactgggggctccatcaaacaggttctcctttcttggattaatggaaggagcccagtctttcaggtgtttctcctttgaagtgtatcttactaaaatgtcttaccgctgcagttcctatgccacctcaaaggcaactctcactaatgtgtatctgttcactaggtgtctagtttgaaagagatgacaagagcatcatttactccctatgcttatccctgaaataccttattttattgctgttgaaactgagatctggccaaagtttgatgacttgcccaggctggcattaaaatacagttctcttctacccctcttttcttttttcatgctatattccttgagttgatgaccacaagtttaagcttagtattgccataaagttggagttggggctttgcatgcaatggaaatattactaaacatccaaagtttactgtcttattcacatatattctggataggaaagtaaaatactcatggagcagaaaagataaaattttaattattagtaaaaagcattttgttatacaacttctgaataattttcttttaaaattgtatttataaaggcctttgttttttggttaaatttataagttagaagaaatctgattgattttatttttgctttgtttttgcagcagcaagattaagaaaattgttcattcaattgtgtcatcctttgcagttgggtatgtgagacatagaaaacaccatgtattaaatatacgtgagacttaatgcataaaaaacaccacgtattaaatatatctgagacttggccaggtgtggtagctcacgcctgtaatcccagcactctgggaggccaaggcaggtggatcacctgaggtcaggagttcaagaccagcctggctaacacggtgaaaccccgtctctattaaaaataaaaaaattagccagacatgatggcgagtgcctgcaatgccagctgctcgggaggcctaggtggaagaatcgcttgaacctgggaggcggagattggagtgagctgagatcacactattgcactgcagcccaggtgacagagcgatatatatatatatatcactctttcaatgagaaagactgaaataaaaaacaaaaccaaaaagcatttcctgtccatcggtttctaagtagccatgtgccccatctaatgtaatctaatttatcatggaaatttggtttaagctggactttaagacttgcaaagaaacggcttttgtataagattaatagtaacatattaatattatttttcttccatctgcacaagtaaagttaatgaaaatcgaatgttaaaattctataattataagtaaagtgttttattaagtaccttatacatctagaattactctttaattctggaaacaatttacttagactcttctctacgtaagagtaagatttcatactatgatatagatttacgcaatatgatatagatttatgcaatataattgtttccttttgaattaatgatattttaacttgagctgcaactttttgaaaagtactttgaagatgaattcatcttcatagattaagcaaatagtataatcaatttatggggaatgtatttagaatatgtaacagcaagtttcaggaggtaccttagagttcaatactataaatatttatggaattgaattctttctcatgtacccatcactgtactagaatcgcccataaatatgtaatcatgtacttgctgaaaatgtcactgacaaaaaaaatcttggtcttttaagagcttatgttactcatgctttcatttggtttttattaataaattcttaagaattatccagattaataagattttattttttatgagaaatgggtgtaaacttcttatgaaattctcaaattttaagaagagtttacaaacagacacaggcaattttagttcagtttcacttttctctcttgaggtgttagtctgatggatctgctataaaagggcatgataacgtcttgtgaagtggtttggtgggaattttatttattaagaactgcttctattgggtgaaaacagtgatttttctgagattctatgacattacagtttttcctgccactgggcagtttaatactaaataataacattttggtacctgattattggcctaaatatagtataactatagggacaaaagcccctttatctttgctgttacttacttatttattcatttatttatttgttgtagaatatttggagttttcctgatcttgttggatgtggctctgatctttgctgacctaattttcactgatagcaaagtttatattcctttggagtatcgttctatttctctagctattgctttattttttctcatggatgttcttcttcgagtatttgtagaagggtaagtttgattatttttataatgcataaagctattttgtacttttctaagaagcactttgggaggctgaggcaggtggatcacgaggtcaggagttcaagaccagcctggccaagatggtgaaaccctgtctctactaaaaatacaaaaattagctgggcatggtggcggaagcctgtaatgccagctactcgggaggctgaggcaggagaattgtttgaacccaggaggcagaggttgcagtgagccgagattgtgccattgcacttcagcctgggtgacagggtgagactccgtcccaaaaaaaaagaggcatattagaataattaacaggagcattcaactcaagctgacttaaaagcctttgggccttaggagaaccttggtggtagtctggcagtaccccccagggtctgtgtttgagtgaggtggccatggattgatgctcctctgcttttggagaggggttgaaagagtagggaggattgcatcttgtggtttgagtgacagctcaaccagcacagccatagcacataaaacaccagggagaattataagtttctgatctaggccctgattcccagcacctttggacccacccggagcctgggagaacttgccatcgtgaagggaaggacacaggcctgactgtttttaccatgtgatgatcgtagagccccagggccttcagcaaacttatgcaatagctagggagtggttacagcaggttttgggcaagacccagtgctgtgctggcttcacgtctgacccaatgcagtcatagtagcggtggccacaggggtgtttgtgtcacggtggctcagaacagagagagagactctgtttgtttgggagaaattaagggaagagaacaagactctctttttggtaacccagagaattatcctgcatgttgtccaagaccattaaggcagtaccactatgagtctgcaggaaccacagagtttaggaggcttggggtgcctcctaaagcagataaaacttagatcacaatatccaagttctttccaatatctggaaagccttcccgagaaagataggtacaaacaagccctgacagggaaaactacaataaatacctaattcttcaatgcctagacaccaaagaacatctgctagcatcaacactgtccgagaaaacatgacctcaccaaatgaactcaataagacaccagaggccaatcctggggaaacagagatacgtgacctttcagacaaatcaaaatagctgtgttgaggaaacacaaagaaatttaagataacacagataaaaaaatcataattctattagataagtttaacaaagagattgaaataattaaaaagaatcaagcagaaattctggagccaaaaaatgtaattggcatactgaagaatgtattagagtcttttaatagcagaattgatcaagcagaagaaagaattaatgagcttgaaggcaggctatttcaaaatacatagaggagacaaaggaaagaattagaaacaatgaagcatgcctacatgatctagaaaatagcatcaaaagggcaaatctaagcgatactggccttaaagaggaggtgcagagagagaggggttagaaagtttattcaaagggatagtaacagaacttcccaaacctatagaaagatatcaatatccaagtgcaagaaggttacaaaacaccaagcagatttaactcaaagaagactacctcaaggcatttaagaatcacactcccaaagatcaaggataaaggatcttaaaagcagcaagagaaaagaaaccaataatatacaatggagttacaatacagctggcaacagactttttaatagaaatgtttcaggccaggagagagtgatatgacatattgaaaatgctgaaggaaacaaaacatttaccctagaacaatatattcagtgaaaatatccttcaaagtgaaggagaaagaaagatttttccacacaaacaaaagctgagggatttcatcaacaccagacctgtcctagaagaaatgctaaagggagtacttcaatcagaaagacaaggacattagtgagcaataagtaactacctgaaggtataaacctcactggtaatagtaaatacacagaaaaatacagaatgttatgacactgtaactatggtgtataaactactgttattgtaagtagagagacaactatgagccaatcaaaaacattgactataacaacttttcaagacataaatggtataataagatataaatagaaataacagatagttaaaaagtagtgagactaagttgtagattttgtattagttttcttattgtttgtttatgcaaactgttagtttataagcttaaaaataatgggttataagatagtgtttgcaagcctcatggtaacctcaaaccaaaaaaaatacaagggatacacaaaaaataagaaacatgaaactaaattatatcaccagagaaaattaccttcattaatggaagacaggaaggaaagaaggaagagaagactacaaaacaaccagaaaacaattgacaaaatggcaggagtaagtccttgcttatcaatgataacattgaatgtcatcagactaaacttttcaatcaaaagacagaatggctgaatggatgaaaaaacaagacccggctgggcacggtggctcacacctgtaatcccagtactttggggagctgaggcgggtggatcacagggtcaagagatggagacaatcctggccaacatggtgaaaccccgtctctactaaaaatagaaaaattaggtgggcgtagtggtgcacacctgtagccccagctactcaggaggctgaggcaggaaaatctcttgatcccaggaggcggaggttgcagtgagccgagatcatgccactgcactccagcctggtaacagagtgagactccacctcaaaaaaataaaaataaaaacaaaacaaaacaaaaaacaaaagacccattgatctgttgcctacaagaaacactcttctcccattagtctgaaaataaaggaatggaaaaatatattccattccagtagaaaccaaaaaagagcaggagtcgctatccttgtatcagataaaatagattgcaagacaaaaacgataagaagagacaaagaatgtcactatatcatgataaagggatcagttcagcaagaggctataacaattttaagtatatattcatccaacatatatagccaatatatatactgagacccaatggcttccctgctgaattttaccaaacatttaaagaagaacgaataccactcctgctttaactgttccaaaaagcagaagatgaaggaatacttccaaactcattccacaaggccagtattaccctgatatcaaaagcagacaaagatgcgtcaaaaaaagaaacaggctgggagcagtggctcccacctgtaatcgcagcactttgggaggctgaggcaggtggattacctgaagtcaggagttcaagagcagcctggccaatatggtgaaaccctgtctctactaaaaatagaaaaattagctgggcatggtagcaggtgcctgtcatcccacctactctggaggctggggcatgagaatcacttgaacctgggaatgaaagttgcagtgagcctagatcatgccactgcactccagcctgggtgacagagtgagactctgtctcaaaaaaaaaaaaaaaaaaagacaacaggccaatatatctgatgaatattgatgcaaaaatcctcaacaagatactagaaaactgaatgtaacaatacattggaaggatcattcatcatgacaaatgggatttatccctgggatgcaaggatggttcaaaatatgcaaatcaaccaaagtgatacatcatatcaacacaataaaggataaaagctgtaagatcatttcagttaatgctgaaaaagtgctggataaaattcaacgtttcttcatgataaacactctaaaaaaactgggtaaagaagtaacacacctcaatataataaaaaccatatatgacagatccccagtcagtatcatactgagtggggaaaaatggaaaagctttcctctgagatctagaacacaagtaggatgcccactttcaccagtgttattcaacatagtacaggaagtcctagctagagcaatcacagaagataaagaaataaagggaataaaaacaaatccaaattgggaaggaagaagtaaaattatccttgtgtttgcagatgatatattttatttggaaaaaactaaagagtccacaaaaaaatattagaattgataaattcagtaaagttgcaggatacgaaatcaacatacaaaaatcagtagtatttttatatgccaacagtggaccatctgaaaaagagttttaaaaagtgatcctatttacaatagccagaaataaaattaaaaatctaagaggtaaccaaagaagtgaaagatctttataatgaaaacgataaaacactgatgaaagaaattgaaaaggacaccacaaaatggaaagagattccatgttcatggattggaagaatcaatgctgttcaaaagaccatactatccaaagcaatttacagattcaatgcactccctatcaaaatagcaatgacattcttcacagaaatagaaaaaaaatcctaaaatttatatggagccataaaacacccagaatagcagctattctaagcacaaagaacaaagctggaggaatcacattacctgactttaaattatactacagaactatagtaaccaaaacagcatggcccttgcataaacagacacgtagaccaatggaaaagcatagagaacccagaaacaaatccacacgcctacagagaactcattttcaacaaatttgccaagaacatacattgaggaaaaggcagtcccttcaacaaatggttctgggaaaactggatatccacatgcagaaaaatgcagctagacccctacctctcaccttatataaaaatccaatcaaaatggattacatacttaaagataagacctcaaactataacaagaaaacattgggaagaatcttcaggacattggtctgagcaaaaatttcttgagcaataccctacaagtacaggtaaccaaagcaaaaatggacagatgggatcacatgaagttacaaaggttcttcaaagcaaaggaaacaattaacaaagtgaagagacagcccacagaatgggagaaaatatttgcaaaatacccatctgacaagggataaataaccagaatatataaggagctccaacaactctataggaaaaaaatctaatactatgatttttttaaatgagcataagatttgaatagacatttctcaaaaggaaacatacagatggtaaacaggcatgtgaagaggtgcttaacattgatcattagagaaaactacagtgagatatcatctcatcccagctaacatggcttatatccaaaagtcaggcaataacaaatgctggcaaacatgtggagataagagaaccctcatacactgttcgtgggactgtaaattagtagaaccgctatggggaacagtttggaggttcctcaaaaaatctaaaagccaccatatgatccagaaatcccactgctgggtatgtacccacaagaaaggaaatcagtagatagaggagatacctgcattcccatgtttgttgcagcactgttcatgagagccaaggtttggaagcaacctgtgttcatcaacagatgaatggataaagaaaatatagtacatatacacaagagagtattatttagctataaaaatgaatgagatcctgccttttgcaacaacatggatggaactggagatcactatgttaactgaaataagccaggcacggaaagacaaacaccacatgttctcacttatttgtgggctctaaaagggttaacagttgaactcatagacatgagtagaaggatggtcatcagaggctgggaatggtagtaggaggttgggggtggggaggtggggatggttaataggtacaaaaaaatagaaaaaaatgaataacacctactatttgctagcacaacagggtgactatagtcaataacaattgtacattttaaaatgactgaaagtgtaattggattgtttgtaacacaatgataaatgcttgaggggatagatacctcatcatctatgataagggtggttaatatgcatttaattatatgtcttgctatacttaaattgccatattggtgttttagtcatatatatgtgtcaaatgatgaatataaatttattgtttgaaaacttcccatgaatgtcatatttttcccttagtctactctagaaaatgcattttaaataatgtatgaaagtagaattcttaatggggatcagtcaatagttgtggtctttaaatatttctatctcttcttgcagggagatgaactcatatttttctgttttatattacaggagacagcattatttttctgatttacttaacattttagatactgccgttactgtgattattctgctggttgatgtcgtttacattttttttgacgttaagtttcttaaggatattcccaggtatgaaatataagactcacttctcttaaaatttttcatttactttttgcattttctgtggcttttattctgtataatcttttcaacttcaaatggctcattttataccaaatatgttgctttaaaatgaaatgtttaggtaaattcccacataggttgaaactaaaagattgtgatatttagggaccagtgaagagtatacacaccaagtaccattcattgaataaaaaagatggagtagccaaagaaggactttacttgtactaactttaacttcactacattttgaagttctcgtcaaattcccatttgtatcatttttggccttttggctaagatcaagtgtgacattcttattagtttcatatgtgatacataaaaaaatttgatattaaaaacaattcccctctgtgcttcaactacagatcccttacacataatgttctgtctgggtttttcccacagccaagagggaatttatttgagcatatgcaaaatttgagtgactttaatcacgattttctttctttttttttttttctagtttggtctttttttttaaatttttttttattatactttaagttttagcgtacatgtgcacattgtgcaggttagttacatatgtatacatgcgccatgctggtgcgctgcacccactaactcgtcatctagcattaggtatatctcccagtgctatccctccccccttcccccaccccaccacagtccccagagtgtgatattccccttcctgtgtccatgaatcacgattttcttttccttttttttttttttcttttgagatggagtctcactgtgttgcccaggctggagttcagtggcatgatctcgggctcactgcaacttctgccccaccggttaaagcgattctcctgcctcggccccccgagtagctgggattacaggcatgcacccccatacctggctaatttttgtatttttagtagagacgagtttcaccatgttggtcaggctggtctctaactcctgacctcaagtgatctgcccacctcggcctcccaaagtactggtattacaagcatgagccaccatgcccagcctcaatcatgatgttctaagaaatagaaaacagaacagaaaactaggagatgacacgtatagcaacacaacagtagagttttgcagtatagttgtggcagaaacaaagaaagctaaggcaaagttagaactgttagggattaggaaactaaagggtgtatgaggacctggtgactctctttttgttcttcttttctactgtgacaatgaggaaaatggaagagcaaacgtatactgggatggagatgtttgtggcttcctaagcttgttcatgggtcaaataccgggtttctttctgtaccctagcttccctggactacaactcaggcaccaactaagcatgttaagtgataggcttttggagttgtttgaaaatcacctcagccaatgtggtcctctgactagaaacctcagcatcacttgagagcttgctagaaatacaagaaaaataccttaggccccaccctggacccactgaatcaatatctctgggatccaacaatctgtagcttaacacgcttttccagatgactcttctttagtccagaccatcagttatctgctttgatgtttctgacggtaggagagataccagctagcacacttgggaagtatctcaatctgttgcctgcctaatgtgcatttgcagctgtagtgaacctctgttacagatgggagtaacagaggtgaacaagaatcctcaatttgttttgatgtggaaaaattgaaaatgctagtctcaaatcccaaaattaaatttacaaattctaagactctattgtttcactatttctctagaccagaatttttcaacctcagcattactaacattttgggccagatcattattgtcataggagggtggtgagcagttatattcattgcaggatgtttagcagaattcctggcttctatccattagatggaagtagcgcatgcatgcgcgcacacacaggcacaccagttgtgaaaaccaaaaatgcctcaagacactgccaaatatcccccatgtaggtgattgaggagaggagggaaaattgtccctggttaacaactgctgctctaaacttaatttatattcataaaattgtctgtttctgaagcaaaaattgatcttttaagtttatttttagatggacacgtttatttcgacttctacgacttatcattctgataagagtttttcgtctggctcatctaaaaagacaacttggaaagctgataagaaggctggtaagtgggcaaaacatgcttacgattcagaaaaatattttgtgttttgggacccattggcaagggttgatatctatactgtataatgttctttatttttatgttgatttatgtttcaccaactaataatggttttaaactctcaggtttcaggaaacaaaaggtgatacgaaagggatggatttgacctagacctcacttatattacaggtttgtgacacttaactgttgatttacttacattaacttcactttttcttgtaattatatttttattttgtttttgcctcatctaagccacattcattcaaagtattctttattcgtgaggctatatgctatgccattgtgatagtgtgacatatttgtggtttagccctggcaaggaagatttccatgtcatctcaattcaggactactcggttgcagcacaaaaacttgaatggattttcagctgactccatttgagtttcagtttattaagttctagtagttatcctgaatcccaaggatcccagagagaccgcttctcttcctagaaccccagagaatgaggtcacagctttgtagatctcaggtgttctgagtcagagggctataaagcacgttgggagttcccaccatcactggtgcccagaactcttggattttctttggtatttaagataagaaataaattccaagaacagggggaacttcagactgaggccaacataagtacatggcatatggtttgaaccagtggagtgttaagaacaccatgccagcttaatggtcattatgttggataatttaatatgttatcttgattaccctgagtattagctcttttctgtcaaccttaatcttaaaaggtatttttctgtgaaaatggagtctgatcatataaaattaacttttgtatgttattttaaatctataataatgtttgtaatagtgatgattttgacttccagaacgtattgtcgctatgtcatttccatcttcgggaggccagtctttctatcggaatccaattaaggtaagggtgtttatcttaaaaatactaatttctcagtgaatgtagactgtgtagtcataagtttaatattgacccagaaatgtcaatgttctttccaaaaggtactctttcaagtaaaacaatcataatggattgataccagttataattgtaccagtggttacaaaccacccccaaacttactggcttataacagcaactatttatttggctcatgatactatggtttgtgaatttgagatgggcttaactgttcaattctgtgctcacagagaggattgcttctctcaactgagttcattcatgcatctgtgggcagctactgagtcatctgaggactggctagtctaaaatgacttggctgtcctcagctgacagagccactgcgtgctccatgcacccctcaaggcccatcccatctggcatccactgctgccaacagctccacccccttgaccagcagagctgccatatgctgcatgcacttctaagaccctgaggactggcctgcctggtgcccaccctgctggtggcgccaccccaccactagcaaagccactgcacctagcatgcatacctctagggccttggaacgaatccgactgatggctcccaccccaagaaaagccataccactgtctccacaaacactcaccatctaggccactgaggcactcagagacacctctaaatgctgattacagccaaagaagtcacatgaagactgtattaccgcacccacctagaaccaaagtcaaatcgccctactccataatgaacactaggagacaactattggaaaaaatatttctctatgaaagctccataacattggaagaggcacctgttccaccagatgtgcaaaaatcaattcagggccacaagaaacataaaaagcaaggaaacattacatccccaaagaaacacaataatcccccattaacagaccctaaattttaagagtatatcaaatggctaagaaggaatttgaaataaggatcttgaggaaactctgtgagatacaagagaatacagatagacaaatcaatgaaattagaaaaacaatttatcatcttatgagaaattcaacaaagatatagatgtcattaaaaaccaaacagagatcttggagctgaagaatttaaggaataaaataaaaaataatcaagagaccagatgcagtaggtcactcctgttatcccagcactttgggaggccaaggcaggtggatcacttgaggccaggagttcaagacaagagtgattaacatggcaaaatcccatatctaaaaaaacacaaaatttagtcaggtgtggtggtgcatgcctgcaatcccagctacttgggaggctgaggcacgagaatagcttgaacccaggaggtggaggttgcagtgagctgagatcatgccactgcactccaacctggttgacagggagggaccctgtctcaaaaaaaaactatatatatatatatatatatatatatatatgtaatcaagagctttaaaaacagacatgggagacatatgggtgaaatctcagaagctcaaaggttctcatatagaatcaactcaagatggtcttctctgaggtgcatgatagtcacactttcaaatgtcaaaaagagggaatattggtcaggtgcggtggctcacacctgtaatcccaggactttgggaggctgaggtgggtggatcacaaggccaggagttcaagaccagcctggccaacatgaagaaaccccatctctactaataatacaaaaaaaacttagctaggtgtggtggcgtgcacctgtagttctagctacttgggaggctgaatcacgagatatgcttaaacccaggaggtggaggttgcagtgagctgagggcacaccattgcacttcaacctgggtaacagagtgggagtgtctgaaaaaaaaaaaaaggaaatattaaaaacagcaagaaaaaaagcatcaaatcacatgtaagggaaactcctttaggttaacagtggattttccagtggaaactttacaggtcagtagacaatgggatgttacagtcaaagtactgaaaggaaaaaaatacaaaaaaactataaactaagaatgctatacccagcagagctatcctctagaaatgagggagaaataaaatatttcccagacaagcaaaacctgagggaattcatcaccagtagactggccttacaaggaatgcttaagggggattctacaaatgaaagcaagaggatggctaccatcatgaaaaacatcaaactataaaactcactggtagagcagatacataagaaagagagagaaatcaaactttatctctacagaaatccaccaaaccataaagattagaaaaaaaaaaaaacaaaggaagaaaagaacaaaggatatacaaaacaaccaaaaaaaaaaaaaaaagaataaaatgacaggataaatcctcatctattaatagtaaccttgaatgtaaacagatcaaattcccaattaaaagatacagagttggttgccaagataaacaaacaaacaaaaaacccaactacatactgcctataagaaactaacttcacttgtaaaggtacacgcagactgcaagtgaagggatagaaaaagatactccaggcaaacagaaaccaaaagtgggcaggagtagccatacttatatcagataaaacagactttaagtcaaactgcatgaggagacaaagacagatattttataatgatgaaaggatcaacttagcaataggatataataattgcagacatatatgtacccaacactagagcactcagataaacaaggcaaatattagatctaaagggaaagacagcctccagtctagtaacagttggggtctttaacaccccgtaacaccctactcgtagcactggacagatcatctagtcagaaaatcaacaaagaaatgtcagatttcagcttacagagaggaataagttttagtattctatagcactggagggtgactacagttaacaatttattgtatatttttaaaaagaaaggctcttgagtgttcccaccacaaagaatgataaatatttgaggtgatggacatgctgattatcctgatttgatcattgcacattgtacacaggtattgagatatcaccctctaccttataaatatgaacaactattatgtgtcagttcaaattgttttaaagaataaaaaaacagtttttttttaaatcaaagaaaagaaaataacatggcttggctgaatggtcccatgtggtctctcattctctagtaggctacttcaggcctgttcacatgatggcagtggcaagagtaccaggagcagcaagcaaaacaatgtaaatccttttaaggcccaggctcaaaattagtataatattacttctacccgattttattggacaatgcaaattatactacgattctgaatctgaatccagatacagaatagaaaatagactccaactcctggtggaaggaattgtaaagaatcatggctgctgtttttttgttttttttttttttgagatggagtctcactctgttgcccaggctggagtgcagtggcacaatcttggctcactgcaagctctgcttcctgggttcactccattctcctgcctcagcctcccgagtagctgggactacaggcgcccgccaccacgcctggctaattttttttttttaatagagatggggtttcaccgtgttagccaggatggtctcgatctcctgaccttgtgaaccacccgccttggcctcccaaagtgctaggattacaggcttgagtcaccgtgcctggccgagatcctcaattatagtggcagcatactgctttaggctccatggatgactaaactaatttcaaacatataatgctgtttactgtgaaatgccaactgaaagtcattgtttaattttatgtaatttacaatacttactatacctcaataaaactataattattaagggctggcatcggttgctgagaggtggaaggagtacctctctgcagcgtgttagctcaggttcaaacaggacagggcctcaatttcagcagcttttcagaaaatggcctggatccccagcctgaatcatcatcccatggctggagaatgtggacaggttatttaattaagaaactaatgataaaccaagggctatgggaattaagaactatggctaaaaaagaaatgtttagagtgatgcagaatggccgattaaaagcagctgcactccccagcactcaaggagaggaatgaaaaggggcaggtgaattcagcaccttcaactgagatacccaggttctcccattgggactgactggaagaacagctcgccccatggagaatgaagaaaagtggagagagggtgtgatggcccagctgagagcagcgtggagccaaaggaacccccactcccagccaagggaagcagtgagtgattgtccaatcctgctcaggaaacagtgcttctcctattgatctttgcaacccatggatcaggggatccccttgtaagcccatgccaccagggccttgtgtctgatacacagagctgtggagtctcagcagatcagctgctcaggcacacacagaaacccagacgttttacgtactctggccccgagatcctcagcaaggtgggaaatctgtccatacatattttggaaaggggctgaatccagggagccaagcagtgtcactctgtgggctccatttccacggtacctcacaagttaagacccattggcttggaatcctagccaaccaagagcaacaggttggattccacctcagatgggtctgagttccccgggaggtggagaggggcagccagcatcactgcagtttgtagactcagccactcctgcctgccagctatggaaaatacaggtggtcaggaggaggaagtgttccctgcaacgcagcacacctggtctaccaaaaagcagcgagactgcttctttggatgggtccctgatcccatgtctcctgactgggtaagaactcccccatgggggtctccagccacttcctacaggtgtatgtagacttgctacaggtcagtatccccctgggatggagcttccaaaggaaggagctggctgccatctttgctatttcacagccttcactggtaatacctccaggtagacgggagaaagtcaggcgactggggtcttgaatggaccaccagcaaattgcagaagcactatggtagagtggcctgttaaaggaaaaacaaacacagagaaaacaacaactgctcaaagaaatcagagaagacacacacaaaaaatggaaaaacatcccgtgctcatggatgggaagagtcaatatcatgaaaatggccatattgcccaaagcaatttatggatgcaatgctattcccattaaactgctattgaaattcttcacagaattaaaaaaaaactatcttaaaattcatatagaacaataaaagagcccaaatactcaagacaatcccaagcaaaaagaacaaagcaggagtcatcccgctacccgacttcaaactatactatactacagggctacagtaaccaaaacagcatggcactagtacaagaacagatgtatagaccaatggaacagaatagaaaactcagaaataagacctcacaccaacaaccatttgatctttaacaaacttgacaaaaacaagcaatgggaaaaggactccctatttaataaatggtgctggagtgctggctagccatatatagaaaattgaaactggacttcttccttacaccatatccaaaaattaactctagatggattaaaaacttaaatgtaaatccccaaagtataaaaactctagaagaaaatctaggccataccattcagaaaataggcatgggcaaagatttcatgatcgaaatgctaaaagcaattgcaacaaatgcaaaaattgacaaatgggatgtaattaaactaaagagctacagaatgggagaaaatttgtacaatctatccgcccgacaaaggtctgatattcagattctacgaggaacttaatgaaatttacaagaaaaaaacacacaaccctgttaaaaagtgggcaaaggacatgaacagacacttctcaaaagaagacatacatgcagtcaacaaaaatacgaaaaaaaaaagctcaacatcaccgaccactaaagaaatgcaaacaaaaccacaatgagataccacctcacgccagtcagaatggctattattaaaaagtccaaaaataacatgctggcaaggttgcagagaaaaaggaatgctttttacacggttagtgggtgtgtaaattagttcaaccatgtagaagacggtgtggcaattcctcaaagacgtagaggcagaaatagcatttgacccagcaatcccattaccaagtatagacccaaaggaatataaatcactgtcttacaaagatacatgcacgtgcatgttcactgcagcagtattcacaatagcaaagacatgcaatcaacttaaatgcccatcaatgatagatcagataaagaaaacgtggtacataaacaccatggaatactgtgcagccataaaaatgaagaagataacatcctttgcagagacatggatggaactggaagctgttatcctcagcaaactaacacaggagctgaaaaccaaacactgcatgttctcactcataaatgggagctgaataatgagaacacatggacacatggtggggaacaatgcacactggggcctgtcaggaaggaggggttgggagagggagagcctcaggaagaatagctaatggatgctgggcttaatacatagggatgagatgtctgtgtagcaaaccaccatggcacaggtttacctatgtaacaaacctgcatatcctgcacatgtacccctgaacctaaaataaataatcacattttattgaggtataacatagatggtaagttgcactaatcaagtgtgtatcttgatgatattacacataagtatatatgcatgtaaccaacacctctgtcaatgtattggtgtatgactgatctccgattaattgttgtaaagatataaaatatcaagattaatgtttttcatatagctatcaatgcttcctgtaccacttactgtgaagagcataacttccccaatgaattgtagaggtgtgtttattgcaaatcaagtgaacatatatgtataggtttgtttctcagctttttctccttttattatgacttaatgacttgtctatacttaagtccagaccacagttttaaatattatggctttatagtgagttttgaaaacttgtttataagtcccccaactttgtacttctttgtttaaaaactatcttggctcttctagattttttgaatttccatatacattttagaatcttcttggcaatttacacacacacacacacacacacacacacacacacaacctgctagtattttgacttgggcattcactacattgcttaatttagggagaactgacatgtaaaaatattgagatttccaactcaagaacataatatatctctctacttatgtcttctttgacttctttttgcaatgtttgcagtgtacaggttttacacatttttttttttttgagacggagtcttgttctgtcgcccaggctttagtgcagtggcgcaatctccgctcactgcaagctctgcctcctgagtttgcgccattctcttgcctcaacctccagagtagctgggactacaggcgcctgccaccacgcccagctaatttttttgtatttttagtagagacggggtttcatgtgttagccaggatggtctcgatctcctgacctcatgatccgcccgcctcagcctcccaaagtgctgggattacaggcgtgagccaccgcgcccaccctacacatcttttgttagttttatttctaggcattcgataagtttttatgctgttttaagtaatatttgaatatcttcattttctgattatttgctattggtatataggaacataattaatttttgtatattgactttagttttgtttttaaattttaagttctgggaaacatgtgctgaacgtgcaggtttgttacataggtatacgtgtgccatggtggtttgcagcagctgtcagcccatcatctaggttttaagttgtgcatgcattaggtatttgtcctaatgctctctttcccctttcccccaaccccgacaggcctctttcccctccctgtgtccattctcattattcagctcccacttatgagtgagaacatgcggtatttggttttctgttcctgtgttagtttgctgaggatgatggtttcagcttcatccatgtccctgcaaagggcatgaactcattcctttttatggctgcacagtattccatggtgtatatatgtgccacattttctttatccagtctatcattgatgggcatttgggttggttccgagtctttgctattgtaaatagtgctgcaatgaacatatgtgtgcatgtgtcttaatagtagaatgatttataatcctttgggtatatacccagtaatgggatggctgggtcaaatggtatttctggttctagatccttgaggaatcgccacactgtcttccacaatggttaaactaatttacactcctgccagcgtgtaaaagtgttgctatttctccacatcctctccagcatctgttgtttccagactttttaataatcgccattctaactgacatgagatggtatctcactgtggttttgatttgcatttctctaatgaccagtaatgatgagcttttttttgtatgtttgttggctgcataaatgtcttcttttgagaagtgtctgttcatgtccttcacccactttttgatggggttgttttcttcttgtaatttgtttcagttatttgtagattttggatattagccctttgtcagatgggtagattgcaaaaattttctcccattctgtaggttgcctgttcactctgatgatagtttcttttgctgagcagctctttagttgaattagatcccatttgtcaattttggctgtcgttgcaattgcttttggtgttttagccatgaagtctttgcccatgcctatgtccttcgtggtattgcctacattttcttctagggtttttatagttttaggttttatgtttacatctttaatccatcttgagttagtttttgtataaggtgtaaggaagcggtccagtttctgttttctgcatatggctagccagtttccccagcaccattgattaaatagggaatcctttccccattgcttgtttttgtcaggtttgtcgaagatcagatggttgtagatgtgtagtgttatttctgaggtctctgttctgttccattggtctatatatctgttttggcactagtaccacgctgttttggttactgtagccttgtagtatagtttgaagtcaggtagtgtgatgcctccagctttgttctttttgtttaggattgtcttggctatacgagctctttttggttccgtatgaaatttaaagtagttttttttagttctgtgacaaaagtcaatggtagcttgatgggaatagcattgaatctatgaattactttgggcagtatggccattttcacaatattgattcttcctatccatgagcatggaatgtttttgtatttgtttgtttgttttagacagggccttgctctgtcaccgcaggctggagtgcagtggcacctgggctcatgcaattcacccacctctgtctcccgtgtagctgggactacaagcaggcaccaccacacttggctaatttttttaaaattaatttttgtagacagggagtctcactggtctcactggcccaggctggtctcaaactcctgggttcaagcagtcttcccacctgagcctcccaaagtgctggtattacaggtgtgagccaccacacttggccttgtatattaactttatatctagcctccttcataaattcacacattcattttaataattaatgtgtagattccctgggattttatgtatacaatcataaagttactactttattcccagtttttatacttttttctttccttattgaattatctaggactttcactgtaatactgaatagaaatggtaagaggagacagccttgccttattcccaaactcaggtggaaggaattttatacttcactatttgaaatgatgtttgctataggcttctgtagtcattctttaccagattcagacaatccattttatttctagtttgctaaaagttttcaatcatgaattgctgttgagtagattggatattttttctgcatctatcaaggtaatcaaaatgtttttgtgtttttccattaatgagattttcaaatgttaagccgaccttttttatttttggaataaaatccctttggtcttaatgtattatcgttttatatatcactagattctgtttgctaatattttatttagaacttttcatctatgtgcatgagtgatatgaaattttctttccttgaaatgtctttatctgttggtctacatttaccttagctttggtgtcttggataactcctatctgctaaactcatcttcatcctccatcaggatgaatatgatggatatgtttcagggtaatggcaaaaggaaagagctagagtggaatcttacaagtgcttttgcaaggctctcctttgtgacatcccattgaccaaatcaactcacataatagagcccaaatttagagtgaaagggcactacaaggtgaaatgtgagggccgggattcaggaaaagatgaagaattgggaccactgatggaatctttctaccttattctcaggcagggaagcatttttatacatgcagatagtttacaagaaataactaatatatagtcagaaactcaaggcttcagcagttgtataaaaatgcatttgtaaatacccaaagaccttgaagagaaggatctgacccacatctcacccaggttatgctactcccagctaagacatgattcgaccacacccttggccaattttgaaaattgtttcaaactatttatttgaggtggaattacttttcttctcccataatgggaacagtcatggagcaatgtgaccagggtccattggatgggtcataccacttgagggcagcgatccccaaattcccaattccatctttatgggtaaagcatctcttgattgctaatattgttttttaaagctggttgagctaataactgtgagttaattatggcatgtctaaactgagccaattttcttttagtagttttggtggtgcctaatatcagtttgggaagacttaatattagctggggtgtttttgacagccaaaaacctcacttagcatataaagacattactatttccttgtggggtgatggctagactattgatttctatccgttattaaactgttatctccttagggcattgacaaaagtactaataagtcactgatttctttaccatttttaatcagagtatccaaaaaggaggtgataaatcatgtgttttaataaatgccacaaatcatgagccacccaaaaagtaaatctactgtccatattaatatttagtctttcatctttgccagagcgcagccccaaatctaagctactagttcagctacctggacaggccgagaattaggccatggagcacttcagtcattgcatgttcaatgacaacagcatattctgcacttggagtgcctttgtcatttttgagaaccatccacgatgtatattaaatcaaggttgactcaaaggtacatgattcaaatccgggtatacttaacttctgagaggatgctaaacagtcatgtgattcctctttattcttataagagaataaatttgcagggttacattttgaacaacactgaatatgcaaagcagaccttacaatttcctaagtggtaaatttactagtggagaaatgtcagatgctgccttgaagtagcaaaaactttagagatgttggacccatagagttagtggacaaacaagcactgtggtggaagcatcaagaagtttggccactgctaccacctcatgcaggtacagagggtgtacctttgcttccaaatcaaggaatgtactaagataggcagagagaagagttgagcagatttaggaaaaccgaaggtggaggttgttgcaagaaggctttcacaggaaggggaatatcacactctggggactgtggtggggtggggggaggggggagggatagcactgggagatatacctaatgctagatgacgagttagtgggtgtagcgcaccagcatggcacatgtatacatatgtaactaacctgcacaatgtgcacatgtaccctaaaacttaaagtataataaaaaaaaaaaaaaagaaatacggaaaataagaaaaaaaagaaaagaaggctttcacagagtagcattttctacttttgcatcacaaggaagttgcatcagaaagtataaacttagtaagcccatgcaaaggctgagctatgagaaaaatcagatatacaattacctacagtcctaaaatcttcttagccatcttttgatttctgttcttggtagaattgaatgctctttattctggttgaaaacagaaactgtctatctggtgacagcttgtgaccagaaaaatgtagattcttggcagagttcaccttttctctagattctttatgtcccttttcacctactttgaataagaggtatttggatcctttagtaaactacttagatcaggaaacacagcagtaaatcatcaatatattgagtctctctctctctctatataattataaaaagtatatatacacatataattataaaaagtatatataaacatatataattataaaaagtacacacacacacacacacacacacacacacacatatatatatatataattttttagacattgagagaactaggaaggggattcagagaatccctaaagtttaaccctccaggtatatttgtcttcccaggaaaaagcaaatattgcctgtttttcttttcttttctttttttttttttttgagttggagtcttgctgtgtcacccaggctagagtgcggtgatgcaatctcggctcactgcaacctccacctccgggcttcaagcgatactcccgcctcagcctcccaagtagctgggattacaggcacccaccaccatgcctggctaatttttgtatttttagtagagacggggtttcaccatcttggccaggctggtcttgaactcctgacctcgtgatccacctgcctcagcctcccaaagtgctgggattacagacatgagccaccacgcccggccaactgttttcctatatatgtacgctagagaagcctgcacataaattactgcagtgagatatttactggttgagagaatgaagaacaggacagtattctaatggttgcatgatatttcattagtgctatgatgaacctctaatgttggacatgtaagtgtcactattatcaataatacaacaacaaatatctttgggtgtaaggctttttctgtacagattgttaggagtgaaattacctagttgaagagaatgaatatttttagggttcttaatatatattgccaaatccaagagcaattgtattactgtatcaaaataaatcaaagtttttaatgtcatgccttattttgccagcattggattttctcattaaaaggaaaagggctaatttcatgggcgcaaatgtcatgtcactgttgttttgacttctttattggcgacactgaatattatgtaggttgttaatcagtttgattttctcttttatggattgtttatgtccttggcccatttatctataagatgagggagtaatatttaagttgttgttaatgaattattaatttattatcctaggcatagtccccaacagtgcatttttctgaaaaaatattttcccctgttgttcattatagcatttttcaacagaaatttcagaattttatgaagttaaacctaaggctatagatcttccattgattcaacacttttagttcttcctcattcaaagaattaaaattcacttaaatttctcatagatgtttgtagtttttaatatgtgttttctaaatgtatatggattttaggtaagaaatttcatgaattctaaagtatatgaaatgttttatccttcctctctgccactatgcagattcggagtgttcatctttttgacgtattatttcctcctaacatagataaccaatttaataaatggatgactttgataccttaatgttagtgttctccatattaagccagtaaacattgttctgacagtaccatactaatcagtttttgaaattgtgtcatttttgttgttgcacagagatatatacatatgtgtgtatgtttcagaaagagatatttcctgaaaaaattgttggatttgtatagtgatattaattatatttcagataattactatttttcattgaaaaggtatatatatatatacacacacacacacttaccagtatatatatatcttcattaaaaaattaggagaacgggtgagccaaaaaagtttccatattgttacgagttatttataaattgatataatatgtttatctttttctgtcatgcatacacacacaatcatagtgtatactttttgcatttatttgtttacatagtgcttaggtagaatgtaatattcaaatcactatctaaaagacatacctaatcagaattaaatttaaataagaagcaatatgaattagatttaaataagaaccacattaactgtgaattatgatttggaacaaatttacttaaagttagttaaccatctaatttacttttctgatagctttaaacagtgtgtatttacaatagaggctaatctgagtagtcaaacacactttgtggactatttgaaaaaccacagtggattagaacttgaaattggcatacgcttgtattccctgagtctcccctagaagatgctagtgagagacaaagtaatagaaagtaataaccattttaggttcctcgtggaaatggcttatgttggtgccatgtaactatggaaaatacgtgtttctcttttttaggaagtcgtacagtttctagacaagaaacatccaaaccactatcgagtctacaatctatgcagtgtgtaccttactctgtattttgctactgtagatagaaaacagattactgaatgtaagaagatgattttgttttttacattgcatttaatcataagtatttggtggtggtgaggaaggaatttaaaaatccccgtcttggactggccccatttggtagaaggagttagcccaggagcacaaagtaccctatgaaggaggcagctctggcaggaccaatgaggctagagtgaaggcaaaccattttagggaagatctgttctagtgatattaggtttaggaacatctgtctgtttttcctgccagattgtgttatgaggacatagacaatttaacaaatgagtcctctgacccattagcagtgggttgtgatgagagcagggccctaggtgggaaaaaagcaaactctttagaaaataggttgcaacccagcttaccactctgtcttgatttttttctctacctgtatactcaatagacagggggcaatcatcaaggatgttcatcaaggatattggtctaaaattctcttttttgcttgtgtctctgcccggctttggtatcaggatgatgctggcctcataaaatgaggtagggaggattccctctttttctattgattggaatagtttcagaaggaatggtaccagttcctccttgtacctctggcagaattcggatgtgaatccatctggtcctggactctttttagttggtaagctattgattattgccacaatttcagctcctgttattggtctattcagagattcaacttcttcctggtttagtcttgggagagtgtatgtgtcgaggaatttatccatgtcttctagattttctagtttatttgcgtagaggtgtttgtagtattctctgatggtagtttgtatttctgtgggatcggtggtgatgtcccctttatcattttttattgcatctatttgattcttctctctttttttctttattagtcttgcctagcggtctatcaattttgttgatcctttcaaaaaaccagctcctggattcattaattttttgaagggttttttgtgtctctatttccttcagttctgctctgattttagttatttcttgccttctgctagcttttgaatgtgtgctcttgcttttctagttcttttaattgtgatgttagggtgtcaattttggatctttcctgctttctcttgtgggcatttagtgctataaatttccgtctacacactgctttgaatgtgtcccagagattctggtatgttgtgtctttgttctcgttggtttcaaagaacatctttatttctgccttcatttcgttatgtacccagtagtcattcaggagcaggttgttcagtttccatgtagttgagcggttttgagtgagtttcttaatcctgagttctagtttgattgctctgtggtctgagagatagtttgttataatttctgttcttttacatttgctgaggagagctttacttccaactatgtggtcaattttggaataggtgtggtgtggtgctgaaaaaaatgtatattctgttgatttggggtggagagttctgtagatgtctattaggtctgcttggtgcagagctgagttcaattcctgggtatccttgttgactttctgtctcactgatctgtctaatgttgacagtggggtgttaaagtctcccattattaatgtgtgggagtctaagtctctttgtaggtcactcaggacttgctttatgaatctggatgcacctgtattgggttcatatatatttaggatagttagctcttcttgttgaattgatccctttaccattatgtaatggccttctttgtctcttttgatctttgttggtttgaagtctgttgtatcagagactaggattgcaacccctgccttgttttgttttccatgtgcttggtagatcttcctccatccttttattttgagcctatatgtgtctctgcatgtgagatgggtttcctgaatacaacacactgatgggtcttgactctttatccaatttgccagtctgtgtcattaattggagcatttagtccatttacatttaaagttaatattgttatgtgtgaatttgaacctgtcattatgatgttagctggttattttgctcgttagttgatgcagtttcttcctagtctcgatggtctttacattttggcatgattttgcagcggctggtaccggttgttcctttccatgcttagtgcttccttcaggagctcttgtagggcaggcctggtggtgacaaaatctctcagcatttgcttgtctgtaaaggattttatttctccttcacttatgaagcttagtttggctggatatgaaattctgggttgaaaattcttttctttaagaatgttgaatatcggctcccactctgttctggcttgtagagtttctgccgagagatccgccgttagtctgatgggcttccatttgtgggtaacccgacctttctctctggctgcccttaacattttttccttcatttcaactttggtgaatctgacaattatgtgtcttggagttgctcttctcgaggagtgtctttgtggcgttctctgtatttcctgaatctgaatgttggcctgccttgctagattggggaagttctcctggataatatcctgcagagtgttttccaacttggttccattctgcccgtcactttcaggtacaccaatcagacgtagatttggtcttttcacatagtcccatatttcttggaggctttattcgtttctttttattcttttttctctaaacttcccttctcgcttcatttcattcatttcatcttccatcgctgataccctttcttccagttgatcgcatcggctcctgaggcttctgcattcttcacgcagttcttgagccttggctttcagctccatcagcttctttaggcacttctctgtattggttattctagttatacgtttcgtctaaatttttttcaaagtttttaacttctttgcctttggtttgaatttcctcctgtagctcgtagtttgatcatctgaagacttcttctctcaattcgtcaaagtcattctccatccagctttgttctattgctggtgaggaactgcgatcctttggaggaggagaggcgctctgctttttagagtttccagtttttctgctatgttttttccccatctttgtggttttatctacttttggtctttgatgatggtgatgtacagatgggtttttggtgtggatgtcctttctgtttgttagttttccttgtaacagacaggaccctcagctgcaggtctgttggagtttgctagaggtccactccagaccctgggtatcagcagcggtgtctgccgaacagtggtttttcgtgaaccgcgaatactgctgtctgatagttcctctggaagttttgtctcagaggagtacccggccgtgtgaggtgtcagtctgcccctactggggggtgcctcccagttaggctgctcaggggtcaggggtcagggacccacttgaggaggcagtctgcccgttctcagatctccagctgcatgctgggagaaccactgctctcttcaaagctgtcagacagggacatttaagtctgcagaggttactgctgtctttttgtttgtctgtgccctgcccccagaggtggagcctacagaggcaggcgggcctccttgagctgtggtgggctccacccagttggagcttcccggctgctttgtttacctaagcaagcctgggcaatggcgggcgcccctcccccagcctcgctgccgccttgcaatttgatctcagactgctgtgctagcaatcagcgagactctgtgggcgtaggaccctccaagccatgtgcaggatataatctcctggtgcgccgttttttaagcccgtcggaaaagcgcagtattggggtgggagtgacccaattttccaggtgccgtgtgtcacccctttctttgactaggaaagggaactccctgaccccttgcgcttccccagtgagccaatgcctcgccctgcttcggctcgcgcctggtgcgctgcacccagtgacctgcgcccactgtctggcactccctagtgagatgaacccggtacctcagatggaaatgcagaaatcacccgtcttctgcgtcgctcacactgggagctgtagaccggagctgttcctattcggcctccttggctccgcgatctcttgcgtggtttctaactaccctgcaataatataatgatagtctgctagaaagttaaaaattacacctattaaacaaaagtaagttgagtttaggtgacatgagatggataatctgctcatatgcttatgtttttgagattcttaagtttattttagagcagcagaagcaacttggaaagctccttttgaagatggatagggaatttctaataagatattttatgttgctcataacttcatcatttactatgttattatatatagagatatgacatacatattatttattttaggtgaaagagcttatgatcctaagcacttccataatagggtcagtagaatcatgatcgatgatcataatgtccccactctacggtaagttttatgctaagttgactatgagaagggggctaaatctattgggcttgattttttgaaaatattttaactcaactaaaaatcctaaccttgaaatcagggagatggtagcattctccaaggaagtgttggagtggatggctcaagattctgaaaacatcgtagtgattcactgtaaaggaggcaaaggtaataacgttttcctttttattcctcccattctaaagacgtgtaaggatatgtaaagcacaagaacaagatacctgttgctattaataagtattagtaattgttagcatttaaaagtattagctgtaagactgaaagaagggaaggagaaaggaaagaggagaggaggaagagtaggagatagggagaggataaggaagggaagaaagtagggaaaaagaactaaggagggttgagcatattttctcttgtttttctatttggatatctttatttttggtttgccagtttatatctctcaaaatacaaagtctttaattttggagtgtcagagtagttttatttaaggctgctcttttttatttttaaattaacaaataaaaatcagtatattcatggtataccacatgatgttttgatatatgtaaacattgtaaaatggctaaatcaacctaattaacatatgcattactccacatactttttacttttttgtggtgagaacatttaaattgtactctctcagtaattttcaaatctatattattattaactgtggtcaccatgttgtgcaataaatttcctgaacttattcctgtctaactgaaattttgcatcctttaactgacatctccacaatccctcctttttgttccccccagcccctggtaaccaccattctactctctgcttctatgaatttgacatttttagagtccacaaagaagtgagacatccaatatttgtctttctatgcctggctcctttcacttagcataacgttctccaggcttatccttgttatctcaagggacaggatatcctctaacgccgaacagtgtgttcttatttatatataccaggtattctttatctgttcttccattgatgacatttagattgactccatagcttggctattatgaataatgctgcagtgaacatgggagtgcagatttcattttctttggacatatacccagaagtggaatctccaaatcatatggtagttctatttttttatttttagttttttgaggtgtccctatgctgttttccataataactactaatttacactcacaccaacagtgtacaagagggttctcttttctctacatcctcaccaactcttcttttgtctttttgttaatcaccatcctaacaggtatgaggatatctctttgtgattttaatttggttttcctgatgattaatgatgttgagcattttttcatatacctcttggccattcatatgtcttcttttgagatatatcttttcaggttctttgcccattttttagagaagtaacttgttctcttgttattgtgttgtttgagttcctttaaaaaaaaaattaacctgttcttgaatatatgctttgcaggtatttttctcccattctgtaggtggtctctttataattgtttcctttgctgtgcaaaagcttttcagtttgatacaatgtcatttgtctattttttcttttgttgcctgtgcttttcagtcatatccaaaaaatcttggcccagaccagtgtcaagaagcttttcccctgtgttttcttctagtagttttccagtttcaggtttcacagttaaatctttactttgagttgatttttgtacactgggtgagatagggtgcagtttcattcttctgcaagtggatgtccagtttccccagtattgtttattgaagagactgtcctttcctcatcgtggattcttggcacctttgttgaagatcagctgaaaaatgcacggatttattctgggctttctattctgttccattgatctatatgtctgtttttgttccagtaatatttaaggttgttcttaaacttggtgagaatcttttagattaagggagccaacacagagatgctatttcaaaaattatactggacttatgatagtgtaatgatacaaagaagtttatattggtggggttaaaatggggggaaaagccacttgtaaatccaatcaatttaagttcagttagattttctctcattcaggtttaggctttgaataatcatctaagtatatttcacaatttttgataaacataaagaattaccttcttagagggctgtaaaaccatttttatatcaaattccaggaaaacataacactgtaaactgacttatataattcaataaaatgaagttttagttttattgagaactagtttcaagcccattagttaatatacaggttcagtgtttagctctacaggtttgaatattctgtataaagtggcaatttacaataccatagttaaattaagaatatagaagttgaatcatttgaagttcccagttttttaaccatcttttggtttaaaaatggccatttcacattgcctaacctaacatgttatttttcaagcagtagcatcagttttctattaactgatactaattccttgcttgaaggatttcaaatttgacttttttctaaaaacttttgctgagagggggtttgcataattctgggttcacataatattttgttgatttttttaggttgtttagagaatattcagctggtatgcaccagagaagcctctttttaaaaatgttcattcatattaatcttgctgtcttctgattggttgctgcctgcaggttatcagtagtatcatgagagtagaaatattttattattgatttataggagttctttaaagaatctaaatgccaatttttcttagtattgcaagtatattctcccactgtgttgtcttttaaatttgattgtgatttattttgttgtataaaagcttgtaaatttgtgttttgttttgagacacagtctcgttctgtcacccaggctggagtacaatggctcaatctcagctcattgcagcctcaacctccctgtactcaagtgatcttcccgcctcagcccctctgagtaggtgggattacaggcacgcgccaccacgccggggtaatttttgtattttttgtagagacagggtctccctatgttgcccagactggtcttgaactcctggactcaaatattccactcgcctcagcttcccaaagtgctgggattataggcatgagccattgtgccagcaagaagtttgtaattttgaatgtggtaaaatgtgttaatcgatgtgtttgtatttcatgcttttctgtcacgtttaagaaattcacccctatactgaggtagtaaagatattctacatttcttcaaaaatcttcaagttgcatttttaatatttgggtcttaaatctaattgaaatttgggggaggtttttttttcatatggatagccaacggtcctaacagcatcaattgcatgctattttgttctccatttatttgtgattcctctcaatcatataccaagtttctagaaatattcaaaattgtttctaagttctctatatcacacttttgtaattattgtagccttatattgtagtttgataaaggcagaattgtcttgctcttcttggaacgttattctttcattaaattttaaaatcattttgtcaagttccattataaaacacgcttaggattttcattggaactacattgaatttatagattcactcgagagaactgacagctttgtgataataagttatacatgtgattgatcttgttcattctttaattaaatattttatattttcttcatcatgtctttgcacatcttttcacaaattcattcctacacaaattgtgactgcaagtggaatctcttttttttttttctgttacatttgggttgtttccagtttttactatgataaataatgctgctttttttttttttttttttagacggagtctcactctgtcacccaggctggagtgcagtggtatgatctcgcgcactgcaacctctgcctcccaggttcaagtgattttcatccctcagcctctggagtagctgggattacaggcgcctgccaccatgcctggctgttttgtatttttagtagagacagggtttcaccatgttggccaggctggtctcgaactgctgacctcaagtgatctgcctacctcggcctcccaaagagctgatattacagggtgagccactgcgcctggcccaataatgctgcttttaaaaatacacgtttcttgttgcatatgtggccatatttttgttgagtatgtacctcagactaaaatggttctgtcttaaggtaatgaatcttgaactttatacttgataatgtcacctgtttctaaaacagttgtaccaattttcactccactggtatcgcacactcgaagcattccatatcttccccagtacttgcaattctgagtattttgatttttagccattgggtgtttgtgtgatggcatattatggtggtgttcatttgcatttctataattactaataagattgaagaagttttcttaagattattaagtatttggatatccttttttgtaaagtaactgttaagttttcttacccatttttctcctggattatttgtctttttttctcttgatttgcagttttttatatattctgatttccattctgttattggtcatatatgtatttcaagaaaacttttctgctctgtgatttgccttttctctctcttaggagtatcttttggttaacagaagttcttagttgtattaccatcataggtattatgctttctctttataaagtttgtgtttttgtgtcctgattaagaaaattttccttgagtttaaagacattctactactatattttcttctagatggttcattcatttaaaaattgatttataggtgtggtgtgaggaagaggttaagtttcatctttttccatatatggctatccaattattccagcacactggttgagaagatttttatttctttacttccctgcagaacatgagtctgcttctgacctttctattctgttcattgatttttcatctgtgtgccaatagcacaaccatcttactgtagctttctaatagtccttatttccagtcaagtgaggacaatcatctttttcttcataattgtttgtgtattttaggccgtctacatttccatataaatttgggaatcaaacaaaaggcagcagaaacctctgcagacttaaatgtccctgtctgacagctttgaagagagtagtggttctcccagcacggagtttgagatctgagaacggacagactacctcctcaagtgggtccctgacccccgagtagcctaactgtgaggcaccgcccagtaggggcagactgacacctcacacggccgggtacccctctgagacaaagcttccagcggaatgatcaggcagcaacatttgctgctcagcaatatttgttgttctgcagcctccgctgctgatacccaggcaaacagggtccggagtggacctccagcaaactccaacagacctgcagctgagggtcctgactgttagaaggaaaactaacaaacagaaaggacatccacaccaaaaccccatctgtacgtcaccatcatcaaagaccaaaggtagataaaaccacaaagatggggaaaaaacagcagaaaagctgaaaattctaaaaatcagagcacctctccccctccaaaggaacacagctcctcgccagcaaaggaacaaagctggacggagaatgatttcgaagaattgagaggagaaggcttcagacaatcaaacttctccgagctaaaggaggaagttcaaacccaatgcagggaagctaaaaaccttgaaagaagattagacgaatggctgactagagtaaccagtgtagagaagttcattcatcatactgaatgggcaaaaactggaaacattccctttgaaaactggcacaagacagggatgccctctctcaccactcctattcaacatagtgttggaagttctggccagggtgatcaggcaggagaaagaaataaagggtattcaattaggaaaagaggaaatcaaattgtccctgtttgcagatgacttgattgtatatctagaaaaccccatcatctcagcccaaaatctccttaagctgataagcaactgcagcaaagtcttgggatacaaaatcaatgtgcaaaaatcacaagcattcttatacaccaataacagacaaacagagagccaaatcataagtgaactcccattcacgattgcttcaaagagaataaaatacctaggaatccaactgacaagggatgtgaaggacctcttcaaggagaactacaaaccactgctcaacgaaataaaagaggttacaaacaaatggaagaacattccatgctcatgggtaggaagaatcaatattgtgaaaatgggcatactgcccaaggtaatttatagattcaatgccatccccatcaagctaccaatgactttcttcacaaaattggaagaaactactttaaagttcatatggaaccaaaaaagggcccgcattgccaagtcaatcctaagccaaaagaagaaagctggaggcatcacgctacctgacttcaaactatactacgaggctacagtaaccaaaacagcatggtactggtaccaaaacagagatatagacatatagagatatggaacagaacagagccctcagaaataataccacacatctacaaccatctgattttgacaaacctgacaaaaacaagaaatggggaaaggattccctatttaaaaaatggtgctgggaaatggtgctgggaaaactggctagccgtatgtagaaagctgaaactggatcccttccttacaccttatacaaaaattaattcaagatggatcaaagacttaaatgttagacctaaaaccataaaaaccctagaagaaaacctaggcaataccattcaggacataggcatgggcaaggacttcatgtctaaaacaccaaaagcaatggtaacagaagccaaaattgacaaatgggatctaattaaactaaagagcttctgcacagcaaaagaaactaccatcagagtgaagaggcaacctacagaatgggagaaaatttttgcaatctactcatctgacaaagggctaatatccagaatctacaaagatctcaatcaaatttacaagaaaaaaacaaacaaccccatcaaaaagtgggtgaaggatatgaacagacacttctcaaaagaagacatttatacatccaacagacacatgaaaaaatgctcatcatcactggtcatcagagaaatacaaatcaaaaccacaataagataccatctcacaccagttagaatggcgatcattaaaaagtcaggaaacaacaggtgctggagaggatgtggagaaataggaacacttttacactgttggtgggactgtaaactagttcaaccattgtggaagacagtgtggcgattcctcaaggatctagaacgagaaataccatttgacccagccatcccattactgggtatatacccaaaggattataaatcatgctgttataaaggcacatgcacacgcatgtttattgcagcactattcacaatagcaaagacttggaaccaacccaaatgtccatcaatgacagactggattaagaaaatgtggcacatatacaccatggaatactatgcagctgtaaaaaaggatgagtttgtgtcctttgtaaggacatggatgaagctggaaaccatcattctcagcaaactatcgcaagaacaaaaaaccaaacaccgcatgttctcattcgtaggtgggagttgaacagtgagaacacttggacacaggaaggggaacatcacacaccagggcctgttatggggtggggggaggggggagggaaagcattaggagatatacctaatgtaaatgacgagttaatgggtgcagcacaccaacatggcacatgtatacatatgtaacaaacctgcacgttgtgcacatgtaccctagaacttaaagtataaaaaaaaaaaaaatttgggagtcagctggtcaaatacacacacctgatagaaatttgtttggaattgcgttgaatctatagattggggagaattgaatctttacaatattgacccatccaacccatgaagagagatgttctctcattcagttaggtttccttccatttctctttacaatgttttctcattttctgtgtagaaagcttgcatatttttgatgagatttattcctagatatttgatattttgtggttatttaaatgatatccctttaaaatgtttattttctaaatgttgttgatttaaatgcagttcattttattcattaatcttgtatttagcaacttgactaaactcactttttgtttgtttgtttgtttgtgtgttttgagatagggtttcattctgtcacccaggcgggagtgcagtgatgcgatcatggctcactgcagcttcaacctccctgggctcagggaatccctcccacatcagcctcccgagtagctaggactgcaggcaggtgccaccatgcccagctaatttttttatttttttgtagaaacggggttttgccatgttgcccagattggtctcaaactcctgggctcaagtgatctgccagcctcagcctctgcctcctaaaatgctaggattacaggcctgagccattgtgcccagcctaaactcacttattagttctactaaattatctatagattcttttggattttatagtacacagttatatcatgtgaaaataatacattgtattttttccttttcagtcattttcccccctagcactggctagaaccttcagtacagtgttgaattagaagtggcaacagcagccatcagtgtacacttctattctcaaaggaaaagctttcagtgtctctccaattgctttacgagcatgtgtgtgtgtgtgtgtgtgtgtgtgtgtgtgtgtgagctaccatttatcagatgaagaaattccttagccaggcgccatggctttcgcctgtaatcccagcactttgcggggcccagtggggcacatcatttcagaccagcctgggcaacatgatgaaaccccatctctactaaaaaataaaaaattaaccaggtgtggtggtgcatgcctgtaataccatctactctagaggctgaggcacgagaattgcttgaactcaggatgcagagattgcagtgagccaatatcacaccactgctctccagcctaggtgacagagcgagacattggctcaacaaaaaaaaaaagaaagaaaaagaaaagaaaaaacaatgtctttagtttgctgagagagttttttttttaatcatgaatggatgttgaatttttccagatttttctgaatctttgagatgataatttttcccctttatcttataaataaatgtggctaattacatgattgattaagtggtaaaccaacatatttctggaataaatgtgattgagttgtgctatactattttattaaataattattaaacttttttttattaaattcctgggttctatttgttaatatttgtttaggattttcaaattcatgtcaccagtgtgattggttgtaattttcctttctcatagttttttcaaatcttggcttcataaaatgagttagattttattttctctttttttattccctcgatgaatttatgcgtgctgtttttttttttctttttaagtgtacggtgaaattcaccagtgaagctacatttgtctagagttttctctggggagaagtttttaaattatcgctcagtttcgtatatagaattctctctaattttatttccttagcctgttttggtaggttattgttttcccagcatttgtccatttaatctaagtttgcgaatgtcttggcatcaaattattcacaatatcattttaccattttaatgtctacaggggcattccctttttattccttacattattttcttggtgccttctccctttgtttcttttgattagtctcaccagggaattatcaattttactagtcttttaaaagtaacaaatgtggctgagcgcggtggctcatgcctgtaatcccagcactttgggaggccaaggcgggcggatcacgaggtcaggacatctagaccatcctggctaacacggtgaaaccccgtctctactaaaaacacaaaaaattagccgggtgcggtggcgggcgcctgtagtcccagctactcgggaggctgaggcaggagaatggcatgaacccgggaggcagagcttgcagtgagctgagatcgcgtcactgcattccagcctgggttacagagcgagagtccatctcaaaaataaataaataaataaataaataaaataacaaatttttggccttactaatggactctattatttactttttatttcatgaattagtattatatttagtattttcttttgtattccatgggttaatttgttcttttcctgacttcttgagatgaataattcttagagtgtcgaccactctgttttctgtttagcatttaaggctatacattttcttctaagagttgctttagcttcgtcccacaagttttcatatgtaatattttcattttattgggttcaaattattttccaattttcactgtgcttggtgtttttttttttttttgacccgtgagttgtatagaagtatacttccttatttccaaacataggagacttttgcatttatctttaagttttttatttgtgaagccaggcgcagtggttcacgcctgtaatcccagcaatttggcaggccgaggaggtggtttacctgaggtcaggagttcgagaccagcctgaccaacatggagaaacctcgtctctactaaaagtacaaaaattagccaggtgtggtggcacatgcctgtaatcacagctacttgggaggctgaggcaggagaatcgcttgaacccgggaggcggaggttgtagtgagccaagaacacaccattgtactccagcctgggcaacaagagcgaaactccatctgaaaaaaaaaaaaaagttttttatttctggttgtattgtgctgtggacacagaacatactattttttttttcttccaaatttgtgtagacttggtttatggcctagaatttggttgatattgttaaatgttttctgtacacttgaaaaaaacacgtattatgcattgttgagaacaatgttctatgtacgtgcatttgttaatttatttaactcttctatattcttactgacttgtgttttggtttgattgaattttgataattttttccttctcactctctcccattgccttggaagttatatactccttttctatttttttagtaattactgtaaagatttcaacctgaatccttgatttagctattaatttttgtttatgttgagcctgcatctagagatcttcctaaactctctcaactctctcgttagattaatgagttattctatagatttactgactacacggacttactacactggctaggctctgcagtacattgttaaatggaagcagtgaacagagggcatttttgcttaattccaggctttaaagaaaatgctatcaatattacatcattaatatgatgttcctggtaggtgttttggtagattccctttgttgagttaaagaagtgtcctagtttttattaatttttaaagtcacagttgtaggttgaattttagttaatgctttctctgcattaattgacataattgcaaggtatgtctactttaatctgtgaatatgataaattacattaatatagatttctgatataggatgattcttttttgtttgtttgtttgagacggagtctcgccctgtcgcccaggctggagtgcagtggcgtgatctcggctcactgcaagctccgcctcccgggttcacgccattctcctgcctcagcctcccgagtagctgggactacaggcgcccgccaccacgcccggctaatttttttgtatttttagtagagacggggtttcaccgtgttagccaggatagtctagatgtcctgacctcgtgatccgcctgcctcggcctcccaaagttctgggattacaggcaagagccaccgcgcccggcctaggatgattcttgtatttttatttgtttttttaatgggcaaagaaattttttttttttgagcttagttttttggtataatttccactttgattttagatttggaagtacatgtgcaggtttattacctgggtatattgtgtgataccgaggtgtggggtatgattgatcccatcacccaggtactgagcataggacccaatagtttttcaacctgtgtccccttctgctgtgcaccctctagaattccagtgtccattattgccaccttgatatccatgagcatctattgtttagctttcacttataagtgagaacatatggtatttggttttctgttcctgcattaatttgcttaggataatgacttccagctgcatccatgatgctgcaaaggacatgattttatttttttatgaatgtgtagtattccatggtgtatatgtaccacatattcttaagccagtccaccactgatgggcacctaggttgattctgtgtctttcctgttgtcagtagtgctgagaagagcatgccggggcctgtgtctttttgttagaacaacttactttcttttggatgcatacgcagtaataggattgcaatgtcaaatggtagttctaagtttttgagaaatctccaaactgctttccaggtagctgaactaatttacattcccattagcagtgtatacgtgtatactctgcagccttgtcagcatctgttgttttttgactctttaataatagccattccgactggtatgagatataatcatgttgtggttttgatttgcatttctcggatgattagtgatgtggagcatttttcatgtttgttggccactggtatgtcttcttttaagaagtgtatgtttatatcttttgcccatttttaatggggttatttgctttttttgcttaattgttgagtttcttatagattctgaatattaaacctttgtgagatgcatagtttgcaaatattttcacccattctataggttgtctgtttactctgttgataggttctttgctgtgcagaagctctacagtttaattaggtcccacttgtcagttttttgtggcaattgcttttgaaaacttagtcataaattcttccccaaggtcagcgtccagaatgctgttttctaggttttctcctagtattcttatagtttgaggtctttctatctttagttaatttttgtatatggtgaaaggtataggtccagatcattcttttgcatattgctagctcaatatcctagcaccatttattgaataggaagtcatttccttattgcttatttttgttgactttgtcaaagatcagatggctttctgtgtttggctttatttctgagttctttattctcttcctttgatcaatttttttttcctgccagtaccatgctcttttggtttctatagccttatggcgtagtgtgaagttgggtaatgtgatgcttctggctttgttctttttgcttaggattgctttggctattccggctcttttttggttccatgtgaattagatttttctagttctgtgaaaaatgatgttagtagcttgattggaaaaatgttgattctgtatattgcttttggtagcatggccattttaatgatattgattcttccagtccattagcatggaatgtttttccatttgtttgtgtcatctatgatttctttcagcagtggtttgcagttctccttgtagagatcattcacctcctcgattagctgtattcctaagtattttattttttgtgtggctactgtaaagggggttatgtccttgatttggctgtcagcttggacattattggtgtacagaaatgctactgatttttgtacattgattctgtatcctaaaactttactgaagtaatgtatcagttccaagtgccttttggtggagtcttttggattttgaagatatagaatcatatcgttgatgaagagagatagtttgactttttattttcctatttggatgccatttttttctttcttttgcctgattgctatggcaaagacttttactactatgtgaaataggagtggtgagattaggcatccttgtcttgtcccagttgacaaggagaagcgtccagcttttgcctgttacaatgttggctgtgggttcataatagaaggctctgttttgaagtgtattcctttaatgcctagtttcttgagtgtttattgtcaagaaggatgttgaattttatcaaaagtttttttttgcatctattgagatgatcatatggtttctgtgtggtgaatcacatttattgatttgcatatgcagaaccttgcatccttggaatgaagcctacttgaccatggtgaattaactttttgatgtgctgttggattcagtttgctggtattttgttaaggatttgtgtgcctatcttcatcattgagattagcctttagttttctttttttttttttaattgtgtgtttgccaggctttggtttcagggtgatgctggcttcatagaatgaattagggaagaatccctcctggagtttttggaatagtttcagtagaactggtaccagttcttctttgtatatttgatataattcatctgtgaatacatctgatttaggacttttttggttggcgggttttaacttatggattcaattttggagcttgatactggtctggtgagggtttcaatttctttctgattcaatcttgggaagttctgtgttgccaggaatgtattcatttcctctacattatctagtgtgtgtgcatagaggtgttcataatagtctctgaggaccttttgtatttctgtgggattggttgtgatgtcgtctttgtgatttctgattgtgcttatccggatcttctttctttttctttgttaatctagctagcagtctatcaattttgtttatgttttcaaagaaatgacttggtttctttgaatctctgttttaattttggggtctcaattttgtttagttttgctctgattttagttattgtttttcttctgctaggtttggggttcttgtttttctgatttctctcggtgtaatgttacattattaatttgagattttactagctttttgaggtacacatttagcaccataaactttcctattaacactgcttttgctgcatcccagagattctggtatgttgtgtttctgttttcatttatttcaaagaattttttgatatctaccttaattttatcatttgcttaaaagtcattcaggagcaagttgtttcatttccatgaaattgtttggtttttagagatcttcttgatattgatttatatttttattcaactgtggtccaaaaaaaatggttggtatgatttcaacattttttgaatttattgaggcttgcttcatggtggaacatatggttgatcttggaatacattcgctgtgcaaatgagaagaatgtatattctgtggttgatgcatggagtgttctttaggtgcctattacatccagttggtcaagtgttgaatttatgtccgtaattcctctgttagtgttctatctgaatgatctgtctaatgctgtcagtggggtgttaaagtctcctgactattattatgtggctgagtcttttcataggtctagaagtacctgttttattaacctgggtgatccaatgttgggtgcatatatatttaggattgttaaggcttcttgttgaattgaaccccttatcattatgtaatgcccttctttgtccttttttactattgctggtttaaagcctgttttatctgttttaggaatagtgatccctgctctttttggtgttttgtttgtgtgagagatctttctccaaccctttacgttgaacctgttggtgttgttacatgtgagatggtgtcttgaagacagcagacagatgggttttgtttttttatccaacttgccactctgtgacttttacgtggtgtgtttagactatttacattcaaggttaatattgacgtgagcttttcaccctatcatgacattgttaggtggttgctttatactttctgttgtattgttgttttataggctctgtgagctgtgtacttaagtgtgcttttatggtagcaggtatcattcttttatttccatgtttagaactcccttagggatctcttgtaagactggtctagttttaatgaattctcatggcacttgcttctctggaaaaaaagatctttatttgtccttcgctcatgaagcttagtttggcaggatgctcttgattagaatttattttctttaagaattctgaaaatacaccttcccaatctctcctgatttttaaggtttctgctgagacgtctgctgttatcctgatagggctccttttgtatgtgatctggccttaggattttttctttaacgttgaccttggactgtttggtatatgccttggtaatgtccacttttttatagtatctcgcaggtgttctctggctttattgtatctagatgtctacctttctagcaagattcaggaaattttcttgaatgattgcatcaaatatgttttccaggttgttttctttttttccttgtctctagggaatgccagtaatttgtaggtttggtcacttcacataacctatttctcaaagacgttcctcactttttaaaaatagtttttctttatttttgtctgactgcattagttcaaaagaccagtcttcaggctctgaaattatgtcctctacttggtccagtttattgataaatctttccattgtattttgaaattccttaagtgagttttttaattccggaagttctgattgatttctttttaagatgtttatctcttccttcatttgctgaattgatttagaagtttccttttgttgatttcaaccttgaatctcattgagcttccctggaatccatgctttgaattctttattgtcatttctgagttttcattttggtagaaagcattgccagagagctagtgtgatcctttggtggtatcactacatgcaggtttttcatggtgccagaattcttgtactggttcttctcatctggagatgctagcacttctaatttttgtaattgtttttatgtgggtaggattttttctttatcttttctttcctatatcattattattattattattattattattattattattattattattctttccctttccctcctccttaggtgatgtgactttagagcaatgctaggtaggtcttttggccttgcttctatatgcacttctatcagcaggttttatattgggtatgtggtttgacctacaagccagtagatggcggcgatgggtaagagctggctgtggccagtggtgctggctatatacttgctgtttgtttattgggaagagctctctgttgccttaggcaatgagctgattcctggagtacacattaatctgagctccctcctaaaccctaggggaacgggagttaggtgggggtgtgggaggaagatgggtggagccagatggggaaggttccccagtgttgtcctgctctcagtccaggtttgggaaaatgcctgcagcttttccttgtgtcctttcctcacaaagtctccaagtctctcgttaaattagctccaggacttgggagaaacagtgcccctcctcggtccgggttgcttggatccccagtggaaaggtaagacagagggatgctgtctgcctctctcacatactgaggcttcactcgcttttatcagtcgaatgttgtcacaagagctgtttgcctgcgttgtcctcccaaggatctggggtgtccttcataattccagggagttgtcgttttctttcttgaattaaagttcacagagttgatctttatgtactatcttgctatttccaaatggctgaggcatgctaaaagcctgtaatctgccgtcttggaaaaaaatccttgcattcttaagagaaatggcacttggtattgatacgtggtatttctacactgctgaattcactttgaaaaaatatatatatttttatatctacatttatatgtcagactggtataaagtaatcgtctactgtatttatgcagttttggaaccagctattttagtgttactaaatgagttgggaatttttctttcttactgttacccaaaggaatttatataagacatgaattattgctttcgaatagatttagtaaaaacctcatcttgttctttcgtggagaggtagttgagaaatatttttaccgtaaatgtaatttattttccacctgtggggcagaggttgcagtgagctgagatcgtgccagtgcactgcagcctgggtgacacagcgagactgtcccaaaaaaaaagaaagaaaatcaacttaaaatgaactcctggaatatttctgagtgtatttttataccaagcatgttccttgaactaatttttcttttcttttctaggaagaaccggaactatggtttgtgcctgcctgattgccagtgaaatatttttaactgcagaggtatgaaagatgttactacaaactttgtcttaggatgactgagtttgctagttctgaaacatcactggtaggatgttaagatgattattttagtcatggtgcttagtgaaattgtaattggagaagcggttgttaaaaagtctgtttttgatacttccttgtttaacatgcactggttagtagctggcttaagaatctctttgggccaggactagagtgaggtcaatgaggcgcagaatttaagagaatgctaaaaattgcaataattaaaataaatgatttttcatgcaatatttaaaaaataaaaattaatgcaaaaaaaccatgaggtatacaatattaacattttaaataatgacaagacctgatggggcaggattaaggtgaggggagtaaagccatgttacacagatacaaaaaacattcagtaatcgcaatggttccctcacctcacctggccctgctgttcttccttcctcatgagaatagtatcaagcttaattagataaattctccaaagggccttggccatcctcacacctcttaggtagataaaaggcaacatttcacaactcaaagcctctcctgcatgtaaatacctctgcttagtcaacacatgtggagtctgtggcctctagaaatttctgataagacaaggtgggatgtttccacctacagcagtgttctcagtcatttttctttgccattttcttgctgagatgctaccatttccagcagctccgcttgagttgtttggcctacagtctagggaagaagtggtggttctgcacaatgcccagcactctaattccaccacctttggtttttctaatttgagacacacagattttgaaaatggatgttctaggatggtgtttttcaagctatggatcatgatgtatcagtgagttgtaaaataaagttactgggttgtgactaacatctcttaaaaataaaatggaatcggccaggtgcggtggctgatgcctgtaatcccagcacttcaggaggctgaggcggatggatcacctgaggtcaggagtttgagaccagcctgaccaacatggagaaaccctgtctctactaaaaatacaaaattagctgggcattgtggtgcatgcctgtaatcccagctacttgagaggctgaggcagaagaatcgcttgaacccaggaggtggaggttgtggtgagctgagaccgggccatagcactccagcctgggcagtaagagtgaaactccgtctcaaaaaaaaaaaacaaaaaaaaactaaagctaaaactaaataaaatggaatagagcagaatagaaaatctgaaaaggtttaagtattggtgtgtgtgtgtgtgtacttctccgaggtttattaatgtggattgcaacttaaaaaatgaaaagtttgaaagccactgatacagagccctagactgaaaaccagagacttgtatttcaggcctgtgctgcttctaactggctgcagcatctccatggcagattgtgtagttttcttttggtctcagtcttctcatttgtaagatggaaagaagggttggaccagatgatttctaaggtctttccagctctaaacttttatgtctttacgaaaccttgaatgagagaagtctttgatgtgactttgttaattttggtaatttgggtagcctttgccaaaagaccactgcggctaggcgcggtggctcatgcttgtaatctcagcactttgggaggctaaggcaggcggatctcttgagtcaggagttcgagaccagcctggccaacatggcaaagcccccatctctactaaaaatacaaaaaattagccaggtgtggtggtacacgcctgtagtctcagctactcaggatgctgaggcaagataatcgcttgaactcgcgaggcagaggttgcagtgaggtgagattctgccactgcactccagtgtgcgtgacagagcgagactccataaaaaaaaaaaaaatcactgactttaggaaagaaggtggttttagaaagactaaggtacctaatatagaaaaggaaagagtgcagatgaaccatggttccttttttgtaggaaagattgtactattttggagaacggcgaacagataaaaccaatggcactaaatatcagggagtagaaactccttctcaggtaagttttcgttttaagaaagggagcttttgtaggggagtgggttaagattgccatctgttatttggtttcattttagactcttctcctttggtgatcagtcagcagcattagggcaccctgcgacaggccttggtccctccctgatgctaagggtcatgcttcaggtgccacccacacgttggggggtctggcttctcctcagagcatcctgctttctattctatactggttattgtttacggagctcaggagttgattattttcccaaagcaggaaagtccaatacctaaggctccaggaccctgaagtttatctaaaatcaccagcctttgatttcaatgtaaaaaagatctaagtctttcacagatccttattagggcaattcaacccttgcagaacatcacaaagactgtttttgggtgactcccgtgtgtgtgtgtgtgtgtgtgtgtgtgtgtgtgtgtgtgtgtgtggtgggggaggtgtattttaaaagagaaagaaaaggggaaataaacttttcaaaaacccttttatataccagacagtactgcacttttacatatctcattgaaaacccataacacctatatgaaacatatgctgttactctgttttttcttttaaaaataatttcgttatggaaaactttaatcatatacaaaagtccagagaatcatacaatatatctccatgtagtcatcacttcgctgcaacaatcatttcagcctgcaactggccacgtttcatccatacttttcccactccactcacacccccaaccccactctccactcttgctttccccaaacctggattatttggaaggaaatttcagtcatcagatcattttatcccacaagtattttagtatgacatctaagtactcttaaaacaacaacaaaaaacccttaataacttttatcatatctgaaatattacaccttaaaaatccttaatatcaaatttctagtccatgtttgtttccaaaattgtcttaaaatctttgaaaatttagtttgtttcagtcagaattcaaacaacatccacacatttcatttggtcgctatgtctcctaagtctcttttagttcatagatttcttgccattttttattgcttgtaatttgtttactgcagaaaccagaatgtttatcgtatagcatttacaacattctagactttgctgaaccattctaagagttttacattcactatctcatttaatattctcagtaactctatgagtaggcactactatgattctcatcttataaattagaaaattgaggttcagagaaattaacttttgaaccaaggactgaaatctagatgtcagactctgaagcccatgctgtgcacagcttctcatttatattgccttttctatattgcccctcaaaccgaagtgagagtgggttgggaattctcaaatagatttggatgtggctgtaaatgagtttttctttaggtggtgggaactgaataagtactcttggccctgttataagaacactaactactgtccccgtttagtttgggcaaaagaactcagccttatccactgatacttttctcccacacccaagccaaaaacaaaaccagacaaagaacagtcatagaccctaagcgaaaaggaatgtgtggatttactgaagtgcagccctactcatgccatttccatgctcaaaatccagagtatgtccccactgccagtagcaataaactaaatgtttcaacctggcactcaagatccacagtttgacttttccaaccttttcttccactatgtgcatgcacacatcccacactctaacacatttagactgtgtgctgtttcccagcccatggacacttgattccctcgtgccatttctcatgccccttttcctagagtccctttcccttcccagcctgaagtagtctcttgctttttcagttcctaaagccctttgtgtttctcttagggatgatatcactttgcattgttctctagctatttgaagtggtgacttctgtttcccctttaaaggcaaggcccatggcttacccatctttccaccctttcctcataatatcttctttgtttgtagtgagtacctcctatgggttggttgtatgaatttctactaccagtccatgttgttttaagttgtagtagaaagaagcatgggagcaaaagcagcttgagggccctggcaggttacagcctttaggggaaggtggagaatctggtggcaggagccaaggagatgttagatagagctccttcagcaactcaccccacacgtctccccatccccatctcttctgtagtcatgcatagtttcccgaactttagtccagaactagcacaccaaaggctgcaactgaatctcttctgattgactgagaaggcaacacagggtctcagctgcacatttgagagatgtgttggcaagacctcaggacagagtgccctctgtgtctggtggtgattctcggataccatcacattctgatcctgcattgtgggccattctactgactacatctactcctaagttaagaactttcatgagccttcctcatgactggccctttctaaaggaaagtatggcagtttgttacttctatgaacatttctcaatgggtaagatagagtccatgaacttatgagtacttcttcttttttttttttttggagacagaatctgtctgtcacccagactggagtgcagtggtgcagtctcagctcactgcaacctcgacctcctgggttcaagcaattctcctgcctcagactcccaagtagctgggattacaggtgcccaccaccacgcatggctaatttttgtagctttagtagagacggggtttcaccctgttggccaggctggtctcgaacccctgacctcaagtgatctgcccacctcggcctcccaaagtgctgagattacaggtgtgagccaccagcgcagccaacttttgagttctgaaccagttgattcagtaccagagctcttcaactccttgaagatagattcaaggagagccactgtgaacagcttgccctaggaaaaggacaaggctaagggaattccggggcttccttgtgaaaacagaattggggaaatggaaagtgaagaaatcctagctgtcaggaacaagagaagaatgacaggaaacctgctactgagatatggaggtattcctcttgagttttcacatatggcattctctcatgcccaggaacctgctcttcactaaaccacacaccttcctctaactcagtcacaactaagcttctatctgcacactgctaatgctgtaactgttttgttgttggttctgattagttgccctctcaaccataagcagcctgtcaacaagacctggctccatccttgtcacttccccatagcacttaattcagtattttttccccaaggtagatagttgtgaggcagcatccctcaaaatatctagtaacataatggcatccagtaaatgtttccttaattatttactgcccttaacctttatgcaaaaaaaaaaaaaaaaaaaagggaaaactgaaaataggaatgctgacttcaggcttttcatctccacttaaagtaaggcttctgttgcttttcagaatagatatgttggatattttgcacaagtgaaacatagctacaactggaatctccctccaagaaaaacactgtttataaaaagattagttatttattcgattcatggtaagtgtttatgtaaaattgaagaattgggcaggagggccaaggttcccactctgggagggttttgctcattgttatatacacagatgatcctaacttatacctgtctttttacgtatcctcatgcataaactcctccttaggtatgcccctcctcctggaattgcccattgattgccagcccttagatgttcttcactttttcttttccatcaccaatttggaggacttcatccccttcccatctctcctgttctctttgctcttctggtcacaacccaaggtggacttttcagggcagagtgagcctctgatgagggaggaggaggtcccatgtgccttcaagactggttatttctcaaaccacctctagttgagagtttgtcttggtggaggtgtctccatatcatatcattttcttaccttctttcagaggcatatttttttctcatccccctgggctctctctttcccctctgtcctccatctgtaaccctctcactcccagccactcccataccttgtggctctcactcccagccacagtgctgggggtcaagaagagcctcctaggaggagcgcttaggtcttccctgcctgaatctacatgaaaatggaaagggttgcgagagagtggggctctatggaggtatctttcacccacctagctgttaccgagtattagcagttgtaaaaatccatataaacatcatgagagctatttgcctgcttccagaatgtaagcagagagataaagctgggatgcactgttgcccagggacgcaggcaaattggtcagtcgtacaccttcgggacttgagaaagaaagtgcagagagaaactggcctccatttccatgtccatttctccatcaccaaccttgcttcccctgcacagcttaacactcagtagaggtgggaaagcaggatgtgtctgtgtagaggggatggggtctcaccactcccactgccagagaggtagcagggaggtgatgcatctgaacccctaaaggaaacctcttataacagccagcgtgtggacctgaggtggtgccactgctgggtgttataggtgccatggtgccggggtgcttgtgtccacacagagagcctagtatttttagcctcctgagtttcgttctgcatttcactgatttctggtggacatcaatagaaagaagttctgcacctggaatgggaaagagggaactgaggcaagaaactgatttctaatgaccaatgaatatcatggtgttagtgaaaacaaaattaaatgaaaagaaaacaaacggcatatgagatgatcaatcaagaataattaatacacttgtttattagaatatttgttttaattctctacttttagttttgtgccattttaaattaaaaataatgtagagttgagatgaaagcaataaaaaattaattggagcctgagaaacaaagcctttgaggaaatgctaaggaagcgggtcatttgaattgaaaaaaaaaaagggcaaaagagcctttgtctgtaaatatatattgaataccttgggaatttttggatataacctatatttttatagagattgcatcaggaactagacttaaagtagggccaaagtaatttagaccacagtatttcttattaagaatcattatgattagaagtctgaaggaagcaacacattagcaagaaaggtgtcaagtcaccttccctaaatatagatatatctatatttattccctaaatatatatatatatattccctaaatatagatatatatatttattcactttggagacagagtcttgctctaagtctcactctggtccaggctggagtgcagtggtgcgatctcgactcacttcaacctccacctcccaggttcaagcgattctcctgcctcagcctcccaagtagctgggactacaggcatgcaccaccacaccgggctaatttttgtgtatttttagtagaaacggggtttcaccatgttgatcaagctggtcttgaactccagacctcaaaagatccacctgcctagcctcccaaagtgttaggattacagacgtgagccaccgtgcccagccattttttttccctttttaatccataatgttaattggcaagacattttgatcttcacactaaccaacctaactttttaatttcatttaggtgttggaacaggcgatggatatgatctaaaagtccaaatagtaatgaagaaaaagattgtcttttcctgcacttccttaaacagttgtcgggtaagagaaaacatgtgaatagaaaaaaatctgatgtttgttttaaggctgaatgtcaaaccagcaatgttgacttccctaaactatcacttaccataaagagattccacgatgctttctggttaccatcgtggtgtcactggatttgaatgcaaaccagagataaattaacctgtttgttcaaaacagttttttcagggtactttccagaatttatttctgttcagtgttgctttgcctttcacttttccacaaatgctgagcatgttcccaggaatgtattaaggattttaatttacatgtctggtcatttttagccatattctcctcttctcggtcattttatcttttattatatagcactgattctaaaatgttagtgtgcatgaaaaccactgagaagcttgtaaagatttacattcctaggttgtactctaaagtatgattcaggaaatctggaatgggggcaggaatctatagacttagcagtgtcccaagtgattcttctaagtcagaggttctgtgggatgaccctgtgagaaacaatgcacgagtgaatgaattggggaggaatctctttatccaaagcaaaagggacctggtagtcaatgttttgctacaatgaagaaatgcctaaaactatataccttttctgaaacaatgagaaagcttccttcatgggtctaataaccataaacttttagaattcctacccaggtctttgtctcaaattcttttattactaatcctattccctggctctctgcactgcacccactttttttggcctctcccaactgagggcattcacccaggcctgatccttggctttctgttcttagcaaatgctttattcttggttaaagaatcacccatttcccttacttaaactattatttgttcatttactgacgaggtatttctagtcgcccactgagttgtagatgcaagagctgcaacatgaacagtttccactcgaactgaaacgcagtagccagtctgaattatcaaggagctttctctgcttctgcaaatggtagcagcattctcccactcaggccttgggctttgattctctttgccttggctccctaaatccagttaggcatcaatccctgttgatgatgcctttgaaatgtttctgtgctcgccttcctttctgttctcactgccactaactgtccagaacctcatttgctcatgcctagatttctacaatcctctccttaccttttcttgattcttatataatgcaatgtatagaatcctgaaatatgcgtactgaaatattgctctcattgtgaaaagttgtaggtagagcagaagacacactgcatgcccatggtcgaagccagttaacatctttggcttaacatccttacctgtaaaataaatatcacacctcaagtgttatgggaattaaattagataatatatatatgaagttgctttgtaaactataaatcactaactaaatgttatatgtgataattatcaggcctctttgtcacataggaaatatcccacgatattcttcaaaagcctcactcttatttccttggctcttgaactcttaagatataatagccctaacatacctgagcttatttttatcagtagctcgaccagcagactccattccaaataaactgggtcatcccctttggctcttggaacacaactctaagttatttagttagttagttggttatttctttcttttcttccttccttcctttcctttttttttccttgagtcagggtcccattctgtcccaggctgtagcacagcggcgcgatcatggctcactgcagcctcaacttcctgagctcaagcagtcccccaatattttttttattttttgtagatattgggtcttgctatgttgcccaggctggtctcaaactcctgagctcaagcaacccttccacctcagcctcacaaagtgctgggattatagacatgagccacactgcctgaccttttttgttgtttttctcatttctactttgcgttattgctggtctttttccctctgtatggactagattctattttcagagctttcatgcccaattcagtttctacctcctcaatgaaattttctgcacctcctgttaactagccttcaatggtgcataagagcacacccagtcttcatcatacagattgagaattatattccattctacaattgtttctttttttcttttttcttttttttttttttgagacggagtctcgctctgtcgcccaggctgaagtgcagtggtgccatcttggctcactgcaacctccacctcccgggttcacgccagtctcctgcctcagcctccagagtagctgggactacaggcgcccgccacaatgcccggctaattttttatatttttttagtagagacgggctttcaccgtgttagccaggatggtctcgatctcctgaccttgtgatctgcccaccttgccctcccaaagtgctgggattacaggcatgagccaccaggcccggcctctgcgattgtttcttatgtgtatagctccctgaagggaccaactgagtctgcacctccttttgtgtttttcacagggcctagcatagatccttcttactgtgggtgccattatttatacgagagtgagtcaaagaaatagtatatcttcaaagtcattcattccaaaacttgaactatctttggtcactccatctgcagccggtaatggtcaagtccaaagatcccactgacaaacacaagagttctgataaaacacgatgatcgggggaccccaccctcccctctcttgggaggggcaggtgggcccaccccccaagtgttacagacccctgttgttattttttaaatttagtaaataaaagaccgtgagttaagcattgtttttagaatgtcaaggctagctttaaaattgagcttctcagcatgttctcaaaagaggccctaatgtatgaaaatcaaatgacacacattaaataacaatatttaactgattaaagtgtctaatagaaaattcaatagttttgaaaagggagacacttttgaaaagtgcctcatgataaccctcaaacatgttggcctttaaaaatcataaacaacagggtgggcatggtggctcacccctgtaatcccagcactttgggaggcccaggtaggcagatcacttgaggcctggagtttgggaccagcctgaccaatatagcaaaaccccatctctactaaaagtacaaaaactagttgggtgtggtggcatgcgcctatagtcccagctactcgggaggatgaggcacaagaatcacttgaacctgggaggcagaggttgcagtgagctgagatcacacgactgcactccagcctgggtgacagtgagactgtctcaaaaaaaaaaaaaaaaaaaaaaaatatatatatatatatatatatatgtatatatatatacacgcacacatacacacatacagacacacatacatataaacaacagtattgcaactagaaaagattattaataattatttatacatgtagtgattggtctgtgagaccaaaagtacttgataaatataggaagtcttgataagtgaaaaggaacttcattgttatcattagctaggtttatagttctaaattccatgttcattcacaggtatttcatgacactgaaacagacagggtaataattgatgtgttcaactgtccacctctgtatgatgatgtgaaagtgcaagcttcctcttcggtgagtaatcaagaaacggcctctgccactgttcttatctgaacttttgaatggttttatttaaggtttcctttactacagttcccaacaagggagatgatagatgtcatcccatagagggagggggagaaaataaatcagatctataacaatttttttaaaagaacatatgtaatttgaataatttttgttcatttgttttttctaaattgtacattttctaaatttttctaaatttttctaaatttacatgtattaattcacaaatccaaaaaatagaaaataaatacaaaaaaaataaaagccaagatgctaaaaaaccaaaggtatgttttactgcatagcagtgattacattttgttttgcatcatttttaatattacaaattgagacaggttctcactctgtcaccccagctggagtgcagtggtgtgaccatagctaactgcagcttcacctcctgggctcatgcagtcctcccacctcagcctcctgagtagctgggagcactgacttgaaagagagttaggtttgggtgactcagttgggtgaagcacagagaaggcagcacaatacaacacatgaaataaccaaagcagttttttattaattccagagagaagagggcagcacacctcgcagggctaactggaagggggagccatccaggagacctgtgctcaactgatgggtggggagcaatagcgagaacgagggagggacctgagagtggaagcctttattgggatgtaaggtgttacctgagcaggtttcctacggggaggtctaactggtggatttaatgcaagcagtcatgagttccatggagtcatgctgtgactgagaggtggtcattgatatatccacatggtccatgcagagtatgggggtctgtagggaggttatatctagctgtcccataatgaagtagtcaccaacagaaggttgtataaggcagatactgggatcagtcacattgagaaacctggaggaggtgaactggaaactgtcaagggtgactgaaccctgcttctgatatcagaaagtccaatttatatttgaaagggatgctgaggcacaaaaaaattgtaagaattcactacaaaaatacttggctatatataaggataggtccttagtagattctgtttagcactatctaaaccagattcaaatttcagcatttaaattaaatatctatcatggaaaataaactattccttgaaaattttgatagaaatagcaagagaaagcaatagcattttcttaagcctcctcctctgtgtcttgagtgtgttgttatagaatgcagagtgctacatattgaatggttataattatttgataaatatataaaggaataaaggaaggaactttgatttctttggaatgattagttcttggcatcaattttacttttaaaatattttttttttctttttaggattttcctaaatactatcacaactacccttttttcttctggtttaacacatctttaatacaaaataacaagtatgtatataatatcaacccatagaaacaacctaatcttcaatgtctatgtataagatgtaatggcaagtcttttgctggttgtcataagcttaatttatagaaaacaaaaaatcctcgagccaccattgttcattgtcttactccttttactttggctattttaaaaatacagttgttcttgagacccccggttgcagcatcctcaaggtccatgccataggactgtgttatgagctcaaaagtattataatcagatcttaagtgtggaagtaaattcctcccagagaagttcaatatgaatctgctcagtaccttcaacatgtcaggtcctcagtaggtgctgatttaccaatgacgaaccaccaccaaattttgtgctaaagtaagggaggacctagggaagcttcagctagctgaaaagctgactgacacacttatatctaagagaagttacaagacacagtaagtattaagaaatacagctaaaaaatcattaaaattgatagtctcccatttaaacatgggtttctaataactgaattgggaaaactttcttaaaaactattaattggaggctgggtgtggtggctcatgcctgtaatcctagcactttgggaggctgaggcgggcggatcacctaaggttggaagttcgagaccagcctggccaacatggtaaaaccctgtctctactaaaaatacaaaaattagccaggcgtggtggcacatgcctgtaatcccagctactcaggaggctgagccagtagaatcgcttgaacccaagaggcagattgcagtgagccgagatcgcaccactacactccagcctgggcgacagagtgagactctgtctaaagaaaaaagcaaaaaaacagaacaactattacttggatttggagattattgttcccagaaaaccttctgccatatttggaaacttatttctcagtctagaagttctccactttaagtagcatttgttctgtgctggtgaaaaactgagacttttttgtatcaaccatactcttcaatacaaaaagagaaaatatttttaaaatgcttcaggtcacagttgaggcagttgctatgattgcatgtggcatgaattggtagttatcggtacaaccagttctagtcttttcttcaaatctgagctggatctaataactccttaagtccagcaaggcaacagtaaattaaacctctggtctacacacttgcaatacatacacatttaatagattttgatagagtgaactttggattggatggaaattttttacaaatttgtttcttggatgcatacaaacaataagctttgattcctaacatgagcaaagtccctcaaatgtgagagctgggtggagcttcatttgttgctgctcctcagattgattcttggtaaaggatacagtttttttcctttgaaacaccatgttcattttggggaaggaataagttagatcacctttattttcacttttatataaatttctaaagatttctgtaatatttaaatttatatactattggtaaagctgtttttcttagttgtgaaattgttgtttagccaaaaatgccaacttctgtcttttagaacactaggcataaatgggttaaccaatttatgcctagtgttccattattggaatgctaagcatgtgggatttatttatatcctactgctcaaggtcatcgccaagggctgattgcaaaaattcaaaaaattgcaacctcaggcataaattaaaagagatatagtattttattattgggttttgatacatgtctaatcagactgatttctgtcacatatagaaatttagatactgtattaaacctagatgtcattaattccataaaaagcaacgttaaaagaatcagtagcatgtgttactgatgtgttgctgaagattaagatatttttaagtctcaccgaaaaggtagaaggagccaactgagacacaaaaaaggggctgaggttctattcatggtgagcaagtcttttttttgtttgtttcttcaagctctaacaagggtgcctactacatggcttttcagttaactccaaaataaaatgtaacaattttttttctattcttaggctttatctacaaagaaatgaattggataatcttcataaacaaaaaactggaaaatttatcaaccagaatatgcagtagagacatattttgatgagaaatgacttaagttatgttgtaactggtagctgattaagtatagttccctgcaccccttctgggaaagaattatgttctttctaaccctgccacatagttatatgttctaaatcttccttgctggtacatctatattgatatatgtatacacatgttctttataaatctattaaatatatacaga

SEQ ID NO: 606 - DNA, 134023 bp, Homo sapiens
agggagcgcggcgcggccgccgcgtgcgcgagccggggttgcagcccagccgggactttccagccggcggcagccgcggcggccgccggctcttccccgccccccgccatggggcagcccggggagcagaacgctgcggaccgcggcggaggacgcgcccggcgcccctgagccggccgagcggcgacggaccgcgaggtaaggggccgcggcgggcgggcgggcctccggcgcgcggccgggcgcctccatccccgtcgcctccatcccgcgccctgggcggcggggcccgggggcctcggggctgcccggcgcgggcccggcgcggcgcaggcccggcccgtcccagcggcgacggcggggcgcggcttcagcctggccccgcgccccagccgggctgcctcccgcctccggacgcctcaacttcggcaaactttgtcccggaggccgggctcggggcccgagggggccggggcgcccgcaccttttcaggaaacggggcgcgcaggcctcgctacggccgtgacccccgctggcgttgaggacccggcaccccgcggggccgcgggtttcacgcggggggacgggcggctcaggggctgcgtggccgagcgcgctgcccgggccggccgggggggcccgggcgttattggaaagttggtcctgagtcattccgcctcagaggcgcctccgaccgcttggcgggcggcgcgggggtccgggtatgggcagagggcgcgaatccccctcgcgcggccgccgagggccggcgactcccggggcaccgggcggctcctggccgcgggctctgcgtcttccccgcgggcgccaggcggctctcggcgggctggccggttccacgccgccagccagccccgtgtggggacttcggtctagtatttggacccgaggagataattctgtgtggaaaattctctcccttcggttggaaacagtaacaaactggaaacggatgaggtgttatggacgtgcttggaaatgcaagaaaccttcagattacgagctgttgacgggaccagttgtatttcacgtttttcgaattaagctcagaatcagttttcagaatgacatgtgatgcgtggtgcgtggtgtgtgtgcctgtgtgtgtgtatggatataattcattcatttttgtggcgtcagaaaggttatgtcgagcgttgtagcggcttcttaatttacattcacggcatacaactgaagaggagccattatttattttttttcctagcatttgctgcgactacacactgccggagcgtttggaaatgttgtttgctgttaccctgtatttgtctataaaattcttactgtagggaatggccaagtggaccatcagttcgtcctgagatcttctcatgtctctcacgtctttgaaaatggcctgtgaacagactgcatcatatgtaggatgtctggcaaaatagtgtacagcgttcttttctcaaatgagaggaaatgtgtaccttttcgccgcgttgtgacaatgtaaatgttaagaattagtctaaagatgaaaattctttggccaaaacaagataagccttatcgatatgaaaactggaaaacatcacatgggactggaaatcctgtgagtgggtgctcatgacggaaaccctgacagaccttggattccagcatcgctggtgaaaatcagaccttatcatggataagggttaagatgtaaggtgtctcacccagacgccatctgttccagctgtcaatgcagaagccaggaaaggagagagagctggccagggagaattccagctttttttttttttttttttttttttttttgagacattcatgtgaatttctctgcgaggggaaagaagaccaattattttccttggatgctgtcccttcttttggaattaataagatggcttcactcagtgagaggctgtaaagacatttcactggaaacaggcagtaacagtggccagttgtttctgttaataccatcaaaatatccctactcttgtttgtgccttgaagaaagtccttcatttaactgagacatctgagcctgcgttgcggattctgattctctaaatactcctgcaagaatccctttaatttttcactgtgcaactcaagaaggacctttctagggtattgtcaggatacgtatgctaatgatattgtcaggttaggtgagaatgattgatcactcccttaaaatccttttttatgatgttaaagctgtactttaagaaagataaaactgccactgtggcgttgcaagtctgagctagctcaagcaaacaaaggaaattgcgttaaatttgcccaactctattttctcatcttcatatagcaagactctccaaacagcaagtgatctaacctatcaagtattatgcaatagctgaatttccttgcaatggtcagtttaaagaactgttaacttagcagaggcgacgtctcgtggccaaggcccttagggtccactccatggaatcaggaccccttgctgctgctttgcgagtgttcatggaggaagaaaaatcacttggtgttctttttttgcatggaagagtcataataactgacttcagatacagagaaagtgggaagagtgagaaagaaggaggtgaggccagaggatttggaaggctaccagagagaagcagccgaggcctgattgtggaaatgatgcttagacttgctttcagcaggagtgatgaagccagaatgagggaggcccagacgcccgggagaggtacaggggataggtgccatgtggtttgcaccaccgcagcaggctttgggtcccaaagacgcgaatggaaatagaagaaaatgcagttttaaatagaaaagaaaaaaaaaaccgagaaaatgttatgtgtgcttgtgtaaaatttattattcataattaaaatacaaaatggctttctcatttgagaaagcctttattgactaagttctgcacaacactattccaggaaagggggtggggagacagaccaccctagggagaaggcagagttttttactattaagcataataccttttttttttttctttcggtgaagcttattgtcggcctgtacagatgacttggagtaggctggcaggtagtgggatgtcataaatgttgatgcctgttggtttctatcaactttaggaatcaggttggaatcgatgctgcattctgtattcctcgagataagtggattgttaattgggacttgggagtctttttctcatttaattaatattcagttaatgtgccctgagttctcataatgttctggttaccgtgctgggaagagtgagacacagcacccatctgctagggtgtgatttgcagggatataggccatcttggcccctgtgcacagtgaagggacatgccagaaaccagcagatacttgactgagacagaccaggacaggagcttgtggcaggaaggataaggaaaaatgcaaatctaccatcctgccctcagggtgctaacccttcgggggagaatactttctcccaccaggaagaaaccagaaagtaaaaatgtaggatgaaatgaattagtggattgtgtagaattctggaagcgtggtgggaatccaccataagggaaagagaaagtcttctgggaagcggcgttgagttgaggcccagtgtcaggaaagctctggtatagtggggccatctggtccctcttacagggccccctcccactttgttttggtaagatgggatctgacggcttgccatcctgtcactccttgccagtagatgcagtgctggccatgctgctggtcattgggtttccagttgggaagttgcatgtgctggcctttggctcttgccaggcagggccttttgtgactgggagctcatgtgggtcatgcatactgtactgtgaagggcatggtctgtggaggggaacagagcagcaggccctaacctgggtggcaccactttgctgtccctaccatttttcattgcaggttgaaagtctccaaagtggcaggggaaggggtgtaaatgttaaacagccccttcctagcctggcatgcgcacctgtggtcccagttactccagaggatgaagtgggaggatcattctagtctgggtaacacagtgagatccctggctctaaaataaatttatttatttattttattttatttgaaacaggggctcactctgttgcccacgctggagtgcagtggcccgatctcggcttgctgcaacctccgcctcctgggttcaaatgagtctcctacctcagcctcccgagtagctgggattacaggcgcctgccaccacgcttggctattttttttttttttttttgagacagagtctcactctgtcacccagactgaagtgcagtggcgcgatctcagctcactgcaacctccacctcctggattcaggtgattctcctgcctcagcctcctgagtagctggggaccacaggtgtgtgccaacatacctggctaatttttgtatttttagtagagatggggtttcaccatcttggccaggctggtctcaaactccagacgtcaagtgatccacctgcctcggcctcccaaagtgctgggattacaggtgtgagccactgtgcccagccttcccagctgatttttgtattttttagtagagacagggtttcgccatgttggccagactggtcttgaactcctgacctcaggtgatccacctcagcctcccaaagtgctgggactacaggtgtgtagtcccaccacactcggcctatttgttttttttgagatggagtcttgctctgttgcccaggctggagtgcagtggtgcaatcttggctcactgcagcctctgcctcctgggctcaagcaatgctcctgccttagcctcctaagtagctgggactacaggtgcttgcccccattcccagctaattttgtatttttagtagagagcgggtttcaccctgttggccaagctggtctcaaactcctgacctcaagtgatccacccatctcagcctcccaaagtgctgggattacaggcgtgagccaccgcaccctgtcttggctctaaaatttaaaaaaagtcctttccccaacctactcctctgtcatccatgtttaaatgacctaagtctccttaattctcaagaactgaaaaattgggggccctacatttcatttcacaatttacttttttactacgatttgttccatgctgatttcgagcattaaaaaaaaaaaaaaattaaatggaggctatttggtggtaacttctcatgaggccattctaccaagaaagatatggcgacctgctgcttggacattctgatttcctttccagctgaaacactgattctgtggcagaacccaaaagcgtatttattggaaacttgatttctttaagtggaaagaaaagctaaattgattaaccaagtggggtaatataatctgtaaggcaacagtagcatcaaagtggtgaaatgtgaatctccaggagtcatgagaattgtaatgaaggtttcctgagattaattttgtgttctggaaggttaatgcccgttaggaggcctgcgtacacaaggtaatgaggtgctcgttaggccttccctccttccaccaagggccaggcacatggtaagctctgggtcagtgtttgtgtccagattctgcaagccggggagacaggagggatgtgccagatgcccacagtggttccatgtgtttggaatgtgtgtcggcacttgggtgtgccttgtagctgcctcctttaacggtgtgttcctggaggtcaggcttccatcctcccgttctgataatgcttagctccaggatttgttgcattatgggggttctttgatggaaagttttatttgacaatgtaattttcttggatgcttttaatgacttaaaagctggaagaacaggaaaactagttctcttgagctctttcatgtccagtaattcccagaaattataactttatgctggaaattaaacctgctatttgaaaccttattacagggtgaattaagagtttaggtttcagaggcttttctgtgtgactttccccttagtgggagggggtttggtatgcccattaagttttatcttaaaatttaatgtgaattttacattgtactcagtaacgtggctgattgttttaatataaacttacttcgttccctaaatctttcaaaactgttgattctccaaaagatgtattgtgtttctggaatcccactgtgtatccctggagctgtccaccccacagctggagaagtgtggcatggtggagggtaccaactttgaggatctgaattccagtctgccctctgtatttagtggtagaatgaccttgggcaggctgcttggccccgctgaattgatgtccctatctataaaatggggctactagcaccagggacatcacttgcttattatgagtaagatggatgggaaagcattgtgcaaatgttaattttcatagtattaggggattgagatgtaacagagtaagaatgttaagatcttacaatgtaaatatcagatcttgttagttagggaccacagaagttttctagttgaggtctcttattttatgtgggaggcagctgaggctctcagtgtttaggtaagtaattctcccaaggcaaataatgacaaagcaagggctcttcacgcaggataggtttttccctgcatttttcctgttcccaacgtttgctcctgggaagatgcttggcctttttttttttttttttttttttttttgaggtggagttttgctcttgcccaggctggagtgcagtggcacgatctcgactcactgcaacctccgccccctgggttcaagctattctcctgccccagcctcctgagtagctgggattacaggcacccgccacctcgcctggctaatttttgtatttttagtagaaacagggtttcaccacgttggccaggctggtcttgaactcctgacttcaggtgatctgcccgcctcggcctcccaaagtgctgggattacaggcgtgaggtactgggcccctctgatgcttggcttctgattccagctagggtcaattgagaattattgaatcacccacactttctttgagaactttctaagtgctaggggctatgctcgttgctaaagctaaaaagtcagataggatgccgtctgatctctgttttcaaggagcttccatgtgatgaatgagccagaagaataatttcattatggcaccatgtagtaggtgccacaacagtggaacagaggctctggtgcattgtggaggcgctgtgcagtttcaacctgggttaggaggaggcgtttcccaaggaggtaactcttagggaagctagcagcaggagtggggaagcctgggctggcagggagtcgcctggcagagggcccgtgagtcggaaggggttctcctgtggctgtccttcaggggagagggtacaggaaaaggcacccggccacttctgggtgctgcctttgtgacagcctaacttctgaggcaggaattctccccattttgcagatgaggaaaaggaagagcaacaggcctgttggaccccagagttcatggtttcaccacagctgaattacagtgcagttttagattttcttcagattctaaacttcttagttttgctttcagagtagacttagttttgctgctgtagagtgctttttaaacaaattgtgtatttttcatgcagcctttcccttccatccaacatctgttttgcctatatggctgatactctaggccgcactccgttccatctctggcgtaagttcctttcttacagcagcctcctcggattcactctcctttgacacatttggatgggaggttctttacgcagtggctcagatgcttcttacagcttgctgagtaacagtccctaacctgatttgctaatgtgttttctttctcctttctctcttaatttacatttaaactggtagtctagtaataatgatagtatttagtcattgtgtcttacagggttttacaaacattagcttgttagtgatgaacaagtccccaaggcctggtcactctgcagagagcataatggttgcaggctagtacctattcatcttgaatttaattataactgcagattgcctgtggaaatatgagttaaaggcatggaagcccttaccactgttagcagggaaatgatgtttggctattttggagaatactttagctcttctgtgagaaccactgtcaaggttttgaacgtgcaaccaggaggggtcagtggtggctgagcagagatgtaggggcttgtttcatggccatttgtacctgctccaggaagggctgtgaataacggaatgcagccagacactgaggccactaggtcaggtccttgggatgacagagggtagatttctttgttcttagacctaagttggcccttgttgggtggaggtggtggcgtgagagccttccctgccttctccaggttgaaggatatttctgtgcatctgggataggtctctagggttgagacgacaagcttctcaagggttggctcacttcattctttctatttctgcagtctggtctatgatgtacacagtaaaaaggagatcagtttatgtatggaaggaattagacctgctttgaattctggtctgtccttcagctaactatgctgttaaattactcttcctttctaagcctcagttttctcatctatgcaaaggtaactgtagagttcacagtcacgtggaaaagcctctgaaacctaaattctccctctggagatggatggtggtgatggtcgcacaacattatgaatgtatttaataccactggactatacacttaaaatgattacaatgataaattttatgtgtaatttaccataataaaaaagtaattgtgagacttaaaagtgagcctgggctgggtgcggaggttcatgcttgtaatcccagcacattgggaagccgaggtgggtggatcacctgaggtcatgagttcgagaccagcctgaacagcatagtgaaaacccatctcacctaaaaatacaaaattagccgggcgtggtggcacatgcctgtaattccagctacttgggatgttgaagcaggataattgcttgaacccgggaggcagaggttgcagtgagccaagatcgtgccattgcactccaccctgggcaacaagagtaaaactgtctaaaaaaaaaacgagcctgtgccaggtgcagtggctcatacctatagtcccagcactttgagaggatgaggcggggggatcgcttgaatccaggagttctcaaccaacctgggcaacatagtgttataagaccttgtctctacaaaaaatttaaaaattagctgggtctggtggcgtgctcctgtagtcccatctaactactcaggaggctgatgcgggaggagtgcttgagcccaggaggtcgaggctacagtgaggtgttactgtgtcaccatacttccgcactttagcctgggtgactcagtgagatcctgtctcaaaacaagaacaagaaaaatcagagcatgtgagagaatataagaacctaatatttcagaagtgatcatttctcttcccctttcctttcctgagtggtttgataaagggaatgacttattagcaatgtggatgacaggctgtcttggaagtatggcctgtccctggaagaaataccggtgggagtagaaggacattattggactgcaaataaattatttataaaaagggtaaaatgtctagaaactgaaatcacagtatatttgcacaaaaggaacatctatagatatctccctttttaaaaagcaattttaacatatgaatttttatatatttaaattcgtattttagcacttttttttctgttatttagcaataataatattcttcaatttgggctgggcgtggtggctcacgcctgtaatcccaacactttgggtggctgaggtgggcgaatcacttgaggtcaggagttcgagaccagcctggccaacatggtaaaaccccatctctactaaaccaaaaaaaaaaaaaaaaaattagctgggtgtggtggcacatgcctgtagtcccagcaacctgggaggctgaggcaggagaatcgcttgaattcgggaggtggaggttgcagtgagccgagatggcgctactgcactgcagcctgggtgacagtgagactgtctcaaacaacaacaaaaacaacaacaacacttcgatttattcaggcctctgttcacattttacctcttcaaaggggtcttctgaacaccctaattaaacagcccatgctgttgctgtggtcacttgccttgctttttttttttttccatagcagaaaatggttttcctttcctttttcttttttttttttttgagatggagtctcccagtcacccaggctggagtgcagtggtgtgatcttggctcactgcaacctatgcgtcccaggttcaagccattctcatgcctcagcctcccgagtagctgggattacaggtatgcaccaccccacctggctaatttttgtatttttttagtagagacagggtttcaccattgttgaccaggctggtctcgaactcctgtgctcaagggatctgcccgcctcagcctcccaaagtgctgggattacaggtgtgagcccccacacccggcctgcagagaatgtatttctattaccttaacctgtgtactaggagtgtgcctggcatatggtaggttctcaagtatttgcataaatgaaccagtatattatagcccaatgttttattgaggcaaaattcacataacatacaattaagcattttaagtgtgcagctcagccgtatttagtgtattcacaatgttctgcaaccaccagctctctctagtttaaaaatcaggccaggcatggtagcccgcacctgtaatttcagcattttgggaggctggggtgggaggatcacttgagtccagtagtttgagaccagcctgggcaacagaggaagactccatctcaacaaaaataaagaattagcttggttgggtgtggtgtctcacgcctgtaatcccagcactttgggaggctgaggcgggcggatcatgaggtcaagagatcaagaccatcctggccaacatggtgaaaccccgtctctactaaaaatagaaaaattagctgggcgtggtggcgcatgcctctagtcccagctactcaggaggctgaggcaggagaatcacttgagcccaggaggcaaaagttgcagtgagctgagatcacgccactgcactccagtctgggagacagagcaagactccatctcaaaacaaaacaaaacaaaacaaaactgggcacagtggcttgagcctgtatgtagtcccacctactccagaggctgaggcaggaggatcgcttgagcccaggaattcgaggctgcagtgacctatgatcacaccactgcactccagcctgaaggacagatggagaacctatctcttaaaaaagaaaaacaacttttcatccccctttacccattaagtaatcactcccattccccaatcctcccatcccttgataacctctaatctgcttttggtctctgtggatttgcctattttagatatagcatctaggaatcatataacttgttttttgtatctggctgctttcacttagcatgatgtttttgaggtacatccaaattgtagcatgtgccagtatttgttcctttttattgctgaatcataatccattgtatgtacatacatgccacaatctgtctattcatttgttcatgggcatttggattattttcactgactattaagaataatgctgctataaacatttgtgtacaagtttctgtgtaggtatgtttttatttcacttgggtatatacctaggagtggaattgctggtcatacggtaatatcgtgtttaacttattcccaccagcagtgttccaatttcaggacatctttgctaaatttattttttttgttttgtttctttttcatgtcatatgggtaatgtgccgacgtcataacaaggtttcagagtggcacctctcacaccttcatttgaatacccaatcacacttatgaactacaaaaggatatatgtgtgtgtgtgtgtgtgtgtgtgtgtgtggtatgtgtatatgtatgtatatatttttgtttaaagctattctagttaaagtggtatctcgtggtttgggtttgtattttcttgatgagcaaagatattgaatgtcttttcatgtgactcttggccatttgtgtatttttggagggaagacaatgtttgttgagttctttatatattctgaatgttaaactttttttttttcttcttttttttgagaccgagtctccttctgttgcccaggctggagtgcagtggtgcagtggcatgatcttggctcactgcaatctccgcctcctgggttccagcaattctcatgcctcagtctcctgagtaactgggactacaggcacacgccaccatgcctggctaatttttgtatttttagtagagatggggttttgccatgttgcacaggctggtctagaacccctggcctcaagtgatccacccacctcagcctcccaaagtgttgggattataggtgtgagccactgcactcagcctcttctgagttttattgttttagtttttacctttaggtttttgatccatttcagttaattcttgtatatggaatgagataggagtcccaattcattctttgtatgttcttatttagttttcccagcaccatttattgaaaacactattctttccctattgaatcgtcttggcacccttgttaaaaataaattggccatagatgtttgcatttatttctggactctcagttctattctgttgctctgtaagtctgttacatcagtaccacactatattagtctgttctcatgctgctaataaagacatacctgagacagggtaatttataaagaaaaagaggtttaatggactcattgtttcacatggctggggaggcctcacaatcatggtgaaaggcaaagaaggaggaaaggtatgtctcacatggcagcaggcaagagagtctgtgcaggggaactgtgctttataaaaccatcagatcttgtgagacttactatcatgagaacagcacccccacgattcagttacctccccctgggttccttcccataacatgtggggattatatgagctacaattcaatatgagatttggatggggacacagccaaaccatatcacacactgttttgattactgaagctttgtagtaagttttgaagtagtaagtttgggaagtatgagtctcccaactttttcattttctatattgttttgactatttggggccagttgcaactttatatgaatttgaatatcacctttttcatttctgcaaaaaaggtcattggaattttaatagggaggggattgattctgtagattgctttggggggttgcaatcttaacagtattgtcctccaatccatgaacgtgagatgtcttttcttttcttttttttttttttttcgagagggagtctcgctctgttccccaggctggagtgtagtggcacagtctcggctcactgcaacctccgcctcccgggttcatgccattctcctgcctcagcctcccgagtagctgggactacaggcacctgccaccatgcctggctaattttttgtattttttgtagagacggggtttaactgtgttagccaggatggtttcaatctcctgatctcgtgatccacccacctcggcctcccaaagtgctgggattacaggtatgagccaccgcgcccagctgaacttgggatgtcttttcattcaattatgtctcctttaatttctttaagcaatattttgtagtgttagtgtacaaatcattcatctctttggataaatttatttctgggtgctttatttttgtgggttctattgtaaatgaaattattttcttacctttctttttgtattgctcattgctggtatatagaaacaactgatttttgtatgttggtcttatgccctacaaccttgttgaatttattacctctagtagttattttgtgggttctgtgggatttctttatacagaatcatgtcacctgcatatataatttacctcttctttctaatttgaatgccttttatttctttttcttgcctaattgctctggctaagacatttagtaaaattttgaataggagtgatgaaagtgagcatcctcatattgttcctgatcttaggggaagcttttcaccattgattatgaagttagctgtgttttctttctttcctttttttttttgtttttgacacagggtcttgctctgtcacccatgctggagtgcagtagtgcaatcatggctgacttcaacctctgcctcccaggctcaagcgatcctctcacctcagcctcctgagtaggtgggaccaaaggcacatgccacaatgccctgctgtttttttttattttttatttttggtagagatgggtttcgccatgttgcccaggctagtcccaaactcctgagcagtcagcccaccttggcctcccaaagtgctgggattacaggtgcgagccactgtgcctggactttttttttttttttttttttttttttatcagaccaggtctcactcttttgcccaggctggagtacagtgatgtgatcatagctcactgcagtcttgaactcccaggctcaagcagtgctccttctttagcctccccggtagctgggactactataggtgcaagctgccacaccctgctaattttttaatttttgtggagacagggtcttgctgtgttgcccaggttggtctcaaattcctcaccttgagcagttctcctgccttagcctcccaggtagctgggattacaggtgtgcaccaatatgcccagttaattgattttttttttttttttttttttagtgatggggtcttgctgtgttgcctaggctgatctcaaactcctggcctcaagcagacctcctgcctcagactcccaaaatgctgggattacaggtgtgaaccactgtgcctggccactgactttttttttttaatggaaggttgttgagttttgtcaaatgctttttgtgcatcttctgagatgatcatatttttttcattgttctagtaatgtagtgtattgtattgattttgttttgtatgttgaatcacccttgcattcctgggataaatctcactttgtcatggtatataatccttttaatgtgttgttagattgagtttgctactattttgttgaagatttttgtgtctatgttcattaggaatattagtctgtagttttcttttttttttcatttttgagacaaagtcttcctttgtcacccaggctggagtgcagtggtgcgatctcgggtcactgcaacctcagcctccccagtagctgggattacaggcatgcaccatcatgcctggctaatttttgtatttttagtagcgacagggttttgccatgttggccaggctggtctcgaacacgtggtctcatgtgatccacctgccttggcctcccaaaatgctgggatttacaggcatgagccactgcaccctgcctgtagttttctttccttgtgatatttttgacttcggtatctgggaaccaatctttttttgagacagggtcttactctgttgcccaggttggagtgtagtggtacgatcttggctcactgcagccttggcctcctgtgctcaagtggtcctcccacccagctgcctgagtagctggtactacaggcacttgccaccacacccagcaagttttgttcattttttttgtacagatgaggtctcactgtgttgcccaggctggtcttcgactccaggcctcaagtgatcctcttgcctcagcctcccaaagtgctgggattacaggtgtgagccactgctcccagcccccagttgtattttgactgtgcatcatgtttcttcagaattttgaaacctgccctctcctaattgagaaaattctaagagggtttccaagcagacaaccctaacatctctggctgggatgatgatgattgtaccatgtacttcccctcttctcaacacagacacattcatgttgtagtgccagctgtaagcataggagttgcacttaatggcttacagctggggaaaatcatggctgatagcacaccaccagtgcaggatcagggaagggaactctattcctgatgccaggacaggaaagagatgtgcttccttcatttcatgaaaaagccacagattgttccggataatggttgctgaataagaaaccaccctaaacatcagtgatttaaaacagtaatctactactacatctcatggttctgtgggctgatcaagcagggctcagctgggtgattcttctgctccatgtggccttgatggaggtaatttattggtattcatctgttggctggtccagtcatgagggtccaagagggccgtacacacatgcttggatggttggaaggccaggctcaggggatcctccctctccttgtgctctcaggtcctctgcagatggcctttctcctaaggtggttgtgcttcttacatgacaactcagaactcttagagtgagtgttctaggagaggaagtggaagctgccagtctctctctctctttcttcttttttttcttttgagatagagtctcactcttttgcccaggctgagtacagtggtaccatcatagctcactgcagcctcaaacgcctgggcagaagtgatcctcccagcccagcctcccaagcagctgggactacaggtgcatgccaccttgcatggctaatttcttagtttttaactttttgtagagacaaggtcttaactacgttgcccaggctggtcttgaactcctgggttcaaacgatcctcccaccttggcctcccaaagtgttgggattacaggcgtgagctactgtgcccagtctggagctgccagtatcttaagcctgggcttggatatcagtgtagcattattcctgccatgttctaaaaagacacagagtcctcctatatttgaggagaggggacatggaccctaactcttgatgaaaggagggtcgaagaatttgtgactgtccttgatctggtatacgcatggtggctagattccatagtgctctcagtaatatatgttagatacccatttgaaaactgttgtggattaaaatggaaatgccaactgttgtgtgttactcattttcagtgagtacattctgtgttctgaatcaataatttctaaaaaacttttggagtatacctattcataaaataattacctctataaaatgtatgtcttatcagcagccatccttgatcatgtgtttgtcaagtttttcaagtacagctttgggtccatacgttttttcttcctattactagttcattttaaaaatttgttgaaaccttcccttttattttaaataatattgtggggttttaatatttctctctgttcttaaaaaaagcttcattgagaaaatataagtaagcctatatatcctaaagttcctttcctttactctagatcattctagtaaatcccctagagacagttctggctgtttatatataaaagtgtggtataatttgacagtgtgtgcagaggtgtgtatggatgtgctctcacatagaaaccctgcctccccagcctgtctcagctgattgttgcaacactgagccgagcaaacatgatgaggtcacagagaagtgagggagtggttttaaataatgaaacaggaaatctctgtctttggctccagtggtgccccagtgttttgggattaatgagggaagagctatgtctgcctgtgttccatgagtgccccttgcttgtacctctatggagaaccccaacaaccctggctggaaagccacctaatcctgtgtttcccaagcataacctccctttgttcccaagtaagtctttcctagacacctgaacttctgtgcaacataggcatgaatgaggagagtgagctactgtggtgttatatatatacacacacatatatacatgatatgtatgcatgatatgtatatatgtgtgtgtgtgtgtgtgtgtgcatagttttcatccattgtttctgactcataagtcccatagcccttgttacagtcttttgttgtaatgttgggtgtcttgcctcctttcagctgcccaaggcaggactctaatctgactgtgagtcagaagacccttattccagagagggccctgcctcattccctagaggcaggaatgctgcacagagaggccaagataagtccgaacagacaggccttgctgggtttagatcatggttttttgtccagaaacatttctagatgattgtaagtcatgcctgtgtaatgaagccaccataaaaactcaaggacaggccgggcatggttgctcacgcctgtaatcccagcactttgggaggctgaggcgggcggatcacctgaggtcaggagtttgagaccagcctggtcaacatggtgaaaccccatctctactaaaaatacaaaaattagccgggtgtggtgtcgggtgcctgtaatcccagctacttgggaggctgaggcaggagaattgcttgaacccgggaggtggaggttgcagtgagccgagttgcaccattgcattcccacctgggtgacacagcaagactgtctcaaaaacaaacaaacaaacactcaaggacagcgttcaagagcttccaaatggcggaacacgtggaggtttctgaggatggcccgagggagggcatggaggctcccgcctggcctcatacctcgccctttgcgtcccttcatctgtgtcttctgcagtatcctctacgatataccggtaactgtaagtacatatttccctgagtcctgtgagccactctggcaaattaatcgaatccaaagagggcttgtgggaaccccaacttgaagctggtgggtcagaagttctagaggcctggacttgcgactagtgtctgaagtggggatggggggtggacagccttggcgactgaaccgccaacagctttgttcacgcaattcttctgcattggcgattgttgtcaggttgtgagagcaggggaaaaacacaggttgagagagtttttccccaaacagcccctggtcgatgccccggaatgactggctgctgcatggaattgcagaggcctgagtgcctctgcttctaccgtgattcctgaggccaagacctctggtctgcatggtctgaagtctcttacgaaggtaaaatgttatgtatatattttgaataagggtacctgttcctcattctgtccttttgaattccaaaagtgtgttggcctgtgagatagcataagggacagaatcattgctctcgtgagcctttgggcttgcttccttaggcactacgtactttctcattccccattgccttcaggattctttctgtcagaatgtagtggctgtggcctgggggtgaccagcataggggccaaagaagggtaatgagtcttgaggcctacagagggtagtaggcaaggcgggagggcaagggccagggggcagcatcattcacacagttgaaaacgtgcccttggcctgtctcctctctgtgttctgcatcttagaaaatagatattgtcttgtgttaagatgaatcaatatagttacccctttttatattgtcttaagcttcttaggaactgctttgtattttagtcactcaggcttggagtgaaacatgtaatgtgtagttcaacctgaaaaaattggtctgagaggcgtcttcatagagtccccaattctatatatgatgaggtctcatcaagctttgacattctgctcttttacgtgtaacactactaatgtaaatgtttctggattgtaaagaatggtgggaagcgtagagattatctgttggtaagccagaggcaggaggaagaggaggaggaggaggagatagtggcgtccctcctgcagaaaccccgcagtggaaggacaagattgcaggaggagttagagaccagtggtctagtccccatctgtctttgtgaccttaggcaaatcattgaatctctttgaaagccttgtctccttgcatggcatatggagattatagttgctgtgaaaataaaataatcagtttttaaaaatccataaaaatgaaaaatggtatttaaggttgaaggcacttgtatttctttttctttcttttttttttttttgagatgtagttttgctcttgtcacccaggctggaggtgcagtggcgtgatcttggctcaccgcaacctccgccacccaggttcaagcgattctcccgcctcagcttcccgagtagctgggattacaggtttgcaccaccacgcctggctaagtttgtatttttagtagagacagggtttcaccatgttggtcaggctggtctccaactcctgacctcaggtgatctacctgcctcggcctctcagagtgctgggattacaggtgtgagccaccacgcccagcctaggcactcgtatttcttagtcgggaaagagaggacaggatatgtccaccacacattcaccagttcagcatgtattaactactgtgtgcctgactaagcttaggtactcagtgtattttcatgtaaagaaaaacaacatttaaaacatttaagtgagcactgaccaaatctagcttagttcagaaaaccctttttttttttttgagactgggtcttgctctgttgcccaggttggagtgcagtggtgcgatcacagctcactgtagcctcgacctctcagtctcaagtgatcctcactttctaagtttccaacattttttgggccaggtacggtagctcacacctgcaatcccagcactttgggaggcaaaggtgagcagattgcttgagttcaggagtttgagaccagcctgggctttatggagacctcatctctataaaacaaatataaaaactagccaggtgtggtggcgtgtgccattagttccagctcctcaggaggctgaggtaggaggacagcttgaatctgggaggcagaggttgtggtgagctgagatcgcaccactgcactccagtctgggcgacagagcgagaccctgtctcaaaaacaaaattttttttgtagagatggggcctctatgttgcccaggctggtctcaaattcctaggttcaggtgatcctcctgattcggcctcccaaatggccgggattataggcatgaccactgtacccggcctcagcagacctttgtaaagcacttcatgggtgccagtcctgctgttacagtgctaggtaaatgcataaaaatgctccatgaggcattctgtgttctcaggaaattcagactgccagtttcagtctggaacgtgacactttatgaaggaggcaatagaacaaaaaaaggacaaattacaggattagtaattatcaaaagctaataccgaggtcagaataggactcttgttcagtttacatgaggaatttaaccaaatgagcttctgcagagaaccagcattagggtggtgaccaggctggggtacatacatgtcatatcagaagtgacctgagactgggtgtgagaagcagtggctgatttggactactgaaagcagaattaagagtctggtggcattggggggagattagtgctgtggaagtcctgctcagagtctttctcatgatgggtacatttgggaggagcttagcagacatcagaggacctgcagagagttgacacagcgggaggaaccagctgcactaccactcatgttcttttccatcttagcatctcgtgagcataattcagaatacacagtttgattaagtatgtgcagattccattcagttcatgaattcattcccacagtgtagcctagcccaagtgttagcacttctttacttgtttttgttgttgttgttgtttgtttttttgagacggagtttcactctgtcgcccaggctggagtgcaatggtgcgatctctgctcgctgcaacctccgtctcccagattcaggcagttcttctgccccagcctcctgtgtagctgggactacaggcacatgccaccatacctggctaatttttgtatttttagtagagatggggtttcaccatgttggtcaggctggtcttgaactcttgccctcaaaggacctgcgtgccttggcatctcaagtgctggaattacaggctgagccactgctcttggccaagcacttcttttctcatagtcttctgctaagtatttccttctgtcagctgccaggcagcaatagttttcacatttgtttgtggttgtcctctagaacttggcctttagtgtggtatgtgtaggattttgttgattccaagggagggtgaaaaatgctgtgatccccagaacctgggatggctggggtatgttgtctctgaggaatttaataacattttgtggtcattgctggaatcttcctagactcctttgatggaaagtagggactccaaggggaactcctgactgggcttgcgggctgccttctcagagccctactttattagtgatttatttctcttaatgggctattagaaatgaccacaaaaactgaggcccccacccatacaatttctatcagttaagaccctggaaattcagatttagagggaatttttaaagaactcctgggagtgctgatgccctgctggactgggagcctctggtccagtggaagcagcacattccctccaggagccccagtgctttaggaatgcagtttcccaggccctgcctcagacctgccgactcacagtcagctctcagagaggctgttaggtgatcattgcgttcatttaagtgtgagaagcaccgtgcaggctttgggtgagagagtcggggttcataccttgcctctcttctttcccagctgcatgaacttgaccaagttatttggcctttctgaaccaggaccgtagcacataaagtgagtgcgatggtgcaggccccagttcctcagccacagtgctgaaaccccagagcctctgaaaatggaatgttttttcatagatttggtgccacttggcctgaacttatgtgaggctatttataatctctattccacttaatatgaatatttcattattttaccacagatggttaattaacatgtttcctgttcttttccttttttttttttttttttttgagaagactcttgctctgttgcccaggctagaatcagtggtgtgatcaaagctctctgcagccttgaacttctgatctcaagagatcttcccacctcagcctctcaagtagcgaggactacaggcttgtgccgccacacccagctgattttttaatttaaattttgtaaagaaagggttctggccgggcgcggtggctcacacctgtaatcccagcactttgggaggccaaggcgggcggatcacgaggtcaggagatcgagaccacggtgaaaccccgtctctactaaaaatacaaaaaattagccgggcgcagtggcgggcgcctgtagtcccagctactcgggaggctgaggcaggagaatggcgtaaacccggaaggcggagcttgcagtgagcggagatcgcgccacggcactcccgcctgggcgacagaacgagactccgtgtcttctcactttgttacctaggctagtctcagactcctagactcaagtgatcctcccacctcggcctcccaaagtgctgggattacagtcaagagccaccacacccggtgaattaatgtgttttcttatggttactgcctcagacttccctggagtgttatataatatataatatataaaatatgcgtacaatatttcctttctaaaattcaaaaaattctgaactctgaaacacatctggcctcggttttggataaggattgtggtgctatagatacccagcttataggtgggtcagtatatgccatgttagtgtgttggtatgtgtagaaaactcttggcagttagcaggcacccaacaaatgcagctatttttgtttgtttgttttgagacagtgtctcactctgtcacccaggctgaggtgcagtagtacaatcacagctcactgcagcctcgatttcctgggttcaagtgatccgcccatgtcagcttcccaagtagctgggaccacgagtatgagccaccacacctgcttaatttaaaaaaaatttttaattaaaaaaattttttttggtctgctgcagtggctcacatctgtaatcccagcgctttgggaggccgaggcgggcagatcacaaggtcaggagatggagaccatcctggctaacacagtgaaaccccgtctactaaaaatacaaaaaattagccgggcgtggtggcgggcgcctgtagtcccagctactcaggaggctgaggcaggagaatggcgtgaacccgggaggcggagcttgcagtgagccgagatcatgccactgcactccagcctgggcgacagagcgagactccatctcaaaaaaaaaaaaaaattttttttttttgagacggagtctcactatgttgcccattctggtcttgaactcctagtggtcgtcccaccttggcctcccaaagtgctgggattgcaggcatgagccattgcacctggactcattttttttttttttttttgagatggagtctctctctgtcgcccaggctggagtgcagtggcgcaatcttggctcactgcaacctccgcctcccgggttcacgccattctcctgcctcagcctcccgagtagttgggactgcaggcgcccgccaccatgcctggctaattttttgtatttttagtagagatggggtttcactatgttagccaggatggtctcaatctcctgacctcgtgatctgcccgcctcggcctcccaaagtgctgggattacaggcgtgagccaccacgcccagccaactgtttaaagacatttcaagccaagagcagaagttgtgttagaaggtggctgtattagtccaatttcacgctgctatgaaaaaatacctgaggctgggcgcggtggctcacgcctgtaatcccagcactttgggaggtcgaggtgggaggatcatgaggtcaggagttcaagaccagcctggccaagatggtgaaactccatctctactaaaaatacaaaaaaattagccgggtgtgtggcgggcgcctgtaatcccagctactcaggaggctgaggcaggagaattgcttgaacttgggaggcggaagtttcagtgagccgagatcgtgccactgcactctagcctgggcaaccgagcaagactctgtctcaaaaaaaagaaatactcgagactgagtaatttattaatataaagaaaagaggtttaattgactcacagttcagcatggctggggaggcctcaggaaacttacaatcatggtggaaggggaagcaaacacatccttcacatggtggcagcaaggagaagtgcagagcaaagggggaaaagccccttgtaaaaccatcagatctcgtgagaactcactgtcacaagaacaggatggtggaaactgcccccatgattcaattacctccccccaggtccctcccatgacacatggagattatgggaactacaattcaaaatgagatttgggtagagacacagccctatcagtggcttacgctcctggcttggcctcctggcaggctttttatagagggagtgggatccttgctggttatgaaggacttgtgttccttagagttacagtcttggaatgtcagccctcagcttcttgtttttcttttcacccagatggtgcacataaggaggcagcgtgaggtggggtggtggctaagggcgtgagtgctggtggcaggctgcctggtctgagtgaccctgggtcttgggcagttaccttccgtgtgtctcagttcttttacctagaaataaggataatggtacttaccccctggagtgtgagatggaaagcatttagcataggtaagctcagtaaaatttagcagttttagttatctaggactataatggaggttaagttggccagaagtataattttttttttttttttaagagacagggtctcgctctgttgctttggctggactcaagctcctgggctcaactgatcctcctgcttcagcctcctgagtagctgggtgtgcaccctgcacccagccagaagtggaatatcttgttggggctgggcttagagctggagctggtggccggctctgctcgcttacagaattctgtacggtttctgatttctctcagcccatctgtccttcacttgcaagcatctgatgactgctgcatgtaccataaaaacatgcaaatatataattcttggctttgaggaggtgaccctatgaaattgacttaaaaaagttgggctggatatagtggctggcgcctgtaatcccagcactttgagaggctcaggccggagggtcgcttgagcccaggagtttgataccctgtctgagagagaattagctgggcatgttagtgtgcgcctgtggtcccagctactcaggaggcggggcgagagggatccttccaggctgagatgtgagggttctttgagcccaggaggtccatactgcagtgagccatgattgggccactgcattctagcctcagtgacagagtgagactgtttaaaaaaaaaaacaaaaaaaacttcagaggagtcatatgattgacttgtgtgtgtctacgcagactcccttttctctgtagagacttacaatcttcagttctctggagcgttcttcagattcccttgctccatgactgaccttggctaggaaaataattgggccgtttttggtgcacagcagatgaaaattatcagtatgtccctagctttccactgtgaggccgccgtagcaacagaggacagtggatgtgtgacttgtaccctttcagagggccaagaacgcaatatcctaaagcagccttttctttttttattttttgagtcagggtctcactctgttgcccaggctggaatgtaatggcatgatctcagctcacaggagcatcaacctcctgggctcaagtgatcctcccacctcagcctcccaagtagctggaactacaggtgcaagccaccacactggataatttttgtattttttgtagcgacagggttttgctatatcgcccaggctggtcttgaactcctggcctcaagtaatcatcctgccccagcatcccaaagtgctgggactacaggcatgagacatcacacctaaccctgttcttgatacctggtttttgtggtcctttttttctaaaattcatatgaattttgagttctgctgtatgatatgtaatatatatgttctaatattacaaacttctaaaaatctttctgtgcaccaaaattgatcctccaggacagaaaaaatgccagtggttcttgtctataccaccatattttgaggaacacaaggaaagattttgaccttccctggacgtagaagaatttgtattgtgattgacacatctttaatgccttaattacttgccttcagttttctttccttttggtgcttaagggagtatttgttctccatgcatatttggtaccctttggtttagataatttagataattagcaactagttttggtctcattatcagacattttactctggacaccccatcaccactcccatcatgggggagtttggaggccaggagattcactggatgcttcttttctagtgtgtgctcttcttagatgggaaggaaaaaggtaaaacctcaaaaactctgtggtaaactgatgtgggaatctgatactaaaaatgtcccaagtgatttaaagtgtgtaagaattactcacttttctgtggagagcgatgtgcataaagacagtgacaagtggaagaagatatccagatgagaccctcactgccctcggtgagtggattgcaggatgctgggagcccccttgcgtagagactcaccgctggactccaagccctctgtggcttctgctgtggctgagtcatcgctgcccaagactactgttgggttctcctccctgctggtgagcagtgaggcaccagggagcccctgcctgcagccagctcggtgattccatgcagttttacatagggaaagaatgctctacctggctacgttttcctgtgtcctgttgaaatgaagaggttagtcatgcattccctcagctagagcgtgaggcagtccttccgaagattgtccaatttagacccagactcttcaaaggaaatgtcagcatgttttgatgtcatggttcaaaacctcactgggatggtttgtgtgagtacatacctgttttacttttagtttcactagaggatgtcatttggactagttgtttttaagtgaacatttcaaacttaactaaatttgattcctgtttccttggttgtagttacatggaaagaccactgggtctgggacagtggttctcatccagagatggagttggtggggtgggggtggggtgcagtttcgtaccctagggggcattttgcagtgtctggaaaccttcagaagtggggtgggggatgccactggcattggtaagtagaacgagggatgctgtgaacaccctgcagtgctcagcatatccctacagcaaagagttttcgggttcaaaatgttagttgcgccaaggttgagaaaccgtggcttggaaattgttcattcaccatactcttcttgatttctagtgaatgtatgactgttaagattttatgttttcataaggtgaggtactttctacagaaattcagtctctttagtcattaaacagcagagggcacttggaggctagagtgcccagaagtccatcaagccagtctggataaacccttcccaacatgccataatttacatcaaaactttggttagcagaatgggaatttttgagtagataccattagaaaaataaaataattttccagctgtggttcccaagttccccaaacttatgtctttagtccaagctgccccttgagcttcagcttcggacctgcatatttatttaacagctattgagtccttggtatgtgccgggcaccctcctgtgtaccagggcatggcaggaaatgatatgggcagctccctgtagtcatgaggcctgtgttctaaggcagaccttgaagacagggaagtccatgtgctgattccagaagaatagagggggcctggcagggctggggggaggtcaagagtggagtgcttcatacagctggtctcagaggggctcattgtcccggacctgcaggacaaggaggcgttttgtccacaaaccttgagagtgagtgaatggggcatgactggggccactgggtgttattgcttgaatgacacctaacctgtctctagtgaagctcttgattcctccctacccccatccagatgctagaagactggggagcatttcttggtccctcttctctcacaatctgtcgttggtgctcacttctgcaccctgttttcccacgtccctggtccccagcccaggcaagccttctgctgatgccggtggccccaacttgtctatccacttcaccccagttttctccaggcctttctccatgctgctgtcagagagatctaaacataggtggcctcctgcccttccctgaaaaccctttacggcctctgactgcattcagtgcaccctgcattcctcctgataaggtcttgcgtctccctgctgccccagcttcagccccaggagcctgcctgcccaggaggccatcattgttccccctggacactgcctgtcctgcctgctgccttgtcctcctttctccaggggcctggggcctcagtctctccatgcctgcacctggagtcctgttgcctgtgtcctacagtttcctcctcagccatccccacagggctgtgtccctttctactagccatgtttattttcttgtggagatggggtcttgctatgctgcccaggccggtcttggtctcctggcctcaagcagtcctcttgctttggccatctttagatgataactcactcacctgtgctgcctttcacttggaggatgggtggatgattcacagggacctgccctccttcccgcagagttggggtttttgtgtaggggatttttctgtcagttattttttcctcacctttcagagtattaaaagaactaagccattagtggtgaggcatgagggcagcgaccacagctccaggggagctctcttatccctacagctggcaaatgttccaccctgtttttatggcacacagaaaggtaggcgcatagtgatgttgttagtaagcttttgaagtagagcatggtgagttagttggcctttttacgaaaaaggaaatggaaaactagcaccatggccttggcataattactccaacatgcaaatcagtactggaaggaagttgaggcagcatacctctatgctccactagtccttaagacacgtctgaaagaaatgaaattttattttgttagaggtgaaggaatgcatggatggaatgcatggtccaggtgtttataactgtgcatttatttggcggttgttttggatggacaggaagtgggaggggagggcacagagagtcactttggccacgtccctggtttgccacaggctgatactggagcattcctaagtttcgcaatggagatggatgtgaaagaagaacacactaggccaggtgcggtggctcacacctgtaatcccagcactttgggaggctgagacaggcgaatcacctgaggtcaggagtttgagactagcctggccaagatggtgaaaccccacctttactacaaatacaaaaattagccgggtgtggtggcacatgcctgtaatcttagctactcaggaggctgaggcaggagaattgcttgaacccaggaggcagaggttgaagtgagccgagattgtgccactgcactccagcctgggcaacagagcgagactccatctcaaaaaaaaaaaaaaagaaaagaagaaccatactagtcaggtgctagagggcttccaaggcagcctccaagggaaggaaatgtctgagaagttatttaagaggatttgttggaacagaaaaacttccaaattggtctagaaggtggaccctagctatagacgcattttacaggacataatgtaaatattaaaggcacattttcagtatttggggaaaatatgtcctctgagtcgaatgaccaatggctgtttctagaaaaattttagttgtagttttaatttgattgtcttgagcatggtgatagattgactttttttttttttaagacagtcttacgctgttgcccaggctgcagtgcagtggcacgatctcagctcactgcagcctccacctcttgggttcaagtgattctcctgcctcagcctcccgagcagctgggattacaggtgcgcgccatcacacccagctaatatttatttatttatttattttgagatggcgtctcgctctgtcacccaggctggagtgcagtggcgcgatccctgcttactgcagcttctgcctcccaggttcgagagattctcctgcctcagcctcccaagtagctgggactacaggtgcgtgccactacacgcggctaattttttgtatttttagtaaagactgggtttcactgtgttagccaggatggtcttaatctcctgacctcgtgatctgcctgccttggcctctcaaagtgctgggattacaggcatgagccactgtgcctggccgcacccggctaatttttgtatttttagtagagacggggtttcaccagttggccaggctggtctgaaactcctcacctcaggtgatctgcctgcttcagcctcccaaagtgctgagattacaggcgtgagccaccgcgcctggcctagagtgactttcttaaagctctgtgtctcctggaaatggaatgtatcccaaatgaggattatttttaagctttataataaaatctttcacagcatagactttttttttttttttttttttgagacggagtcttgctctgttgcccaggctggagttcaggggcgcaatctcggctcactgcaagcgccgcctcccaggttcatgctattctcctgtctgtctcctgagtagctgggaccacaggcgctcgccaccacacccggctaattttttgtatttttagtagagatggggtttcaccatgttagccaggatggtctcaatctcctgacctcgtgatctgcccgcctcggcctcctaaagtgctgggattacaggcatgagccaccgcgcttggcccacagcatagacttttaaagaccatgtaggcaagaacagatctttaaagggaaacctcagtttggcttttgaaagttcatctgattgaagttaaactgatgaaacatactccatccatgcattaccaaaaacgttggagcacggcatggcagtagtatctaaaacagattggcaaactatgggtctaagaatagtttttatgtgtttaaaggattgtaaaaataagcaaagaagaatatgtgacccatgaaacataaaatagttactgtctggctctttatgggaaaaaagtttgccaactcttggcttaaagggtcaagaatgctttaccaaaaaacaaacaaccccctcccccctacaactgtaatgtttgagcaggagttttacaagataaagaattttgatcttgaggggatttgggtgaggatggggcggtgcagtgggagagagagtatagatactgttcatcacacccagtgcagtcggctctggtgggaacatagggtgacctcagtgtgtggtgaggacagtgatcatggccccttttacaagttgaagcttagttctggagtggtggaccatcagaagcttttaagtaggagaatgtcaatgtcataaattagagttaattgtgagaaattgaaataagtattccatttttttctgagatgtgctctcctgaacttataaagtagttcttcagaagtgtttgcagtgttcacaagacactggctctgtggtatttgacatgcagatgggcccagaattcctgacttaaggctaaagatttatcttgagcttatcatgatgtgggcttatgattgttttgatcagcagctgacatctgtgaagcctcagtgatcctataaattgaggaacctgagagaatcaagagaaagacaacaattcttgctgatgtcagtaactgtatttcacctgttaaacttctgcatggaggaggtcagtgttgtctgctgtgtcagcatcagcctacctgggtgtggacgtattctttgggagatgaaacgtagaaaaggtaccccgagtccattacacattctggattcccagaaataagacatctctgagggcagaacctttacagtcacttacatcaagaaggaattcttcaggagaaagctcggtaaaggtatcttaactttgtatgtatacccagagaaaacacataaagataaaaataaaataattttcctcattatccccacaccattagcatcttggtgtatagtctttgcatcttttttcagtatgtatgcacttagatcatcttgtaggacgccagtcccatgcattatacactttgtatctcacagtggagtggaggacagcctgatccttaaggggatgccgaattgctgcatccccatgatttttgctgctttgattcttctcatgagccccgttgctgctgtctgtattagcgtccttctgagcaaacaatgggtacctttttttttttttttcttaagagagagtcttgctatgttgcctcaggcgggagtgcagtggctattcacaggtgctgtcgtactgccctggatgatagtacactgcagccatgaagtcctgggcttaagcagttttcgcctcagcctcctgagtagctgggacattaggcccgtgccgccatgcctggctcttgaccattcccacaagccacacctacaaggagctcaaggagctgtttgcgctgtaggcggttttttttttttttttttttttttggtttttgtttgtttttgtgcagaggtcagatctcttgtctcatagtgcaaaggcgatgaaggccttcattacagtctctcaatttgactctcagtttgatcggaagttgctaagatgggctgacattgtgaggaggatactgctacagcagtagtgtgtgtgtgtgtgtgtgtgtgtgtgtgtgtgtttgtacagactgtctcactctgccacccaggctggagtgcagtggtgcagtcataacttactgtaaccttgaactcgtgggctcaagtgatcctcctgcctcagcctcccgagtagctaggactgtaggcttgtgccaccatgcctggcccttttttttttttttttttttttttttttttgtacagacagggtcttgctgtgttgctaaggctggtctcaaactcctggcctcaagtggtcttcctgcttcagcctcccaaaacactggtattacaggagtgagccagagcacctggcctgaagctatatattattgttaactgcagtcatccgacagtgctatagaacactagactctgttcctgtctagctctctccccatttttcccatcctcctacccttcctaacctctagtatcctgtgtttacttttgacttctgtgagatcaactttttttagcttccacatgtattagtgagaacatgtggtgtttaactttctgtttttggcttatctcacttaatatagtgtcctccacttctatccatgttgctgtgaacgacaggatttcattcatttttatggctaaatagtagtccattttgtatagataccacattttcttcatctgttgttggacacctagattgattccctgtttggctattgtgaatagtgctacggtaaatatggggtatagatgtctctttgatgtcatgatttcctttcctttggataaattcccagtagtgggattgctggatcatatggtagttctatttgtagcttttgaggaaattccatactgctctccatagtggctgtactagtttacattcctaccaatagtgtgtaagagttgccttttctcaggccgggcgtggtggctcacgcctgtaatcccagcactttgggaggccgaggggggcggatcacgaggtcaggagatcgagaccatcttggctaacacggtgaaaccctgtctttactaaaaatacgaaaaattagccgggcacggtggcgggcgcctgtaatcccagctactcaggaggctgaggcaggagaatggcgtgaacccaggaggcggagcttgcagtgagccgagatagcgccactgcagtccggcctgggcgaaagagcgagactccgtctcaaaaaaaaaaaagttgccttttctctgcatcctggacagtatttgttattatttatttgtttatttatttagttttgaggtggagtctcgctctgtcgccaggttggagtgcaatggcacaatctcggctcaccacaatctccgcctcccaggttcaagcaattttcctgcctcagcctcccgagtagctgggattataggcatgtgccaccacgcctggctaattttgtatttttagtagagacggggtttctccatgttgatcaggctggtctcgaactcctgacctcagataatccgcccgcctcagcctcccaaagtgctgggattacaggtttgagccactgtgcctggcctgtatttttgataatagccattctaactggggtgagatgatacctcattgtggttttgttttgcatttccttgatgattagtgatactgagcattttttatgtatttggccatttgtatgtcttttgagaaatgtctgttcaggtaatccccctgccccggcttttttcttttcttttcttttcttttttttttgagacggagtctcactctgtcacccaggctggagtgcagtggtgtgatcttggctcactgcaacctccacctccaaggttcaagtgattctcctgcctcaacctcttgagtagctgggactacaggcgcacaccaccacgacctgctaatttttgtatttttaatagagatgggagtttgccatgttggccaggctggtcttgaactcctgacctcagttgatccacccgcctcggcctcccaaagtgccaggattacaggcgtgagccacccacctggccaatttgcccattttttaattggattttttttttttgctgttgagatgtgtgagttccttgtatatcaatcccctgttggatgaatagttcgcaaatactttctcccattctgtaggttggcttttcattctattgtttcctttgttttgctgaagctttttagcttgatataatcccattcatttatgtttgcttttgttgtccgtgcttttcagttactcatcaaatcttttcccagaccaatgtgatgaagcatttcccctatgttttgtagtagttttatcatttgggtcttatatttaggtctttgattcatttttagttcatttttgtataggatgagaggtggaggtctagtttctattttcactcttctgcatatggatatttaattttcacagcaccatttgttgaagagactgtcctttccccaatgaatgttcttggcgcctttgtcaaaaatcagttggctgtagatatgcaggttaattcctgggttttctattcttttccattggtctgtgtatctgtttttatagacacataccagttgttttatagaccagtaccgtgtcgttttgcttactacagctttgtagtatattttaaggtttggtagtgtgatacctccagctctgttcttcttgctcagcattgctttggctatttggggtcttttgcagtttcatacaaattttaggatattttttctatttctgtgaacaatgtcattggtattttgatggagattgctcttttaattatcttgatttctttttttcccccccaagacagggtctcacttcgttatctaggctggagtgcagtggcatgatacagctcagtgcagccttgacctcctggacttaggtgatcctcccacctcagcctcctgaatagctgggactgcaggcacatgccaccacatctggctaattttttgtacttttttttgtagagacggggttttgccatgttgcccaggctggtctcgagctcctgagctcaagcggtccacccacctcagcctcccaaagtgctgggattacaggcatacaccactgcacctggcctcttttcaatttcttgatggtgttctttgatgtacaaaagtttttaactttaaatgaagtccagtttatctactttttctttggcttattgtgcttttggtatccttttcttttcttttctttctttttctgagacagaatctcgcactgttggccaggctgtagtgcagtggcacaatcatggctcactgtagcctcgacctctagagctcaagggagcctactgccttagcctcctgagtagctagggctacaggcggtaccattatgcctggttaattttttaaattattttttgtagagacagagttttactatgttgcccgggctggtctcaaactgctgggctcaagcagttctcctgcttcagcctcctaaagtgttgggattacagatgtgagccactgttcctggcttggagtcatttctaagaaaccattgcctaatccaaggtcgtgaagatttacatctttcttctaagaattatatagttttagttcttttctgctgtgatcatgtgtgtatgtgttggttttttatttttatttttttgagactgggtcttgctgtattgccaggctggagtgcagtgcttatccatagccatgatcatagtgtactgcagccttgaacacttgggctcaagtgatctttctgccttagcttcccaggtagttaggactacagtgcataccactgtgcctggcttattgtgtgatctattttgagtcaatttttgtggtgtgagataggggtccagtttcattcttttacatgtgtatatttacattttgtagttcatttgttgaagggactacttgtattagtctgttctcatactgctataaagaaattccccagactgggtagtttttaaaggaaagaggtttaattgattcacagttctacatgtctggggaggcctcaggaaacttacaatcaaggcagacggggaagcaggcacgtcttacatggcagcaggcaagaaggagcgtgtgtgagtgcaggaaaaactaccatttataaaaccatcagatctggtgataattcactcactgtcatgagaacagcctggggacaccaccactataatccaatcacttccttcccttgacacatggggattacaattcgagatgagatttgggtggacacagagccaaaccgtattactattctttctccattgaatggtcttggtgcccttatcaaaaatgtattttccataaaaaaacaccaattgaccataaatataagggcttatttctggactctaaattctatttttttttttttaagaaacagggtctcactctgttgcccaggcaggagtgtagtgatgccatctcagttctcttcaacctccgcctcctgggctcaggtgatcctctcacctcagccccccaagtagctgggactacgagcacatgccaccaccctcgcctaatttttgtattttttgtagagatggggttttaccatgttggccaggctggtctcgaactcctgagctcaagcagtccaccctcctcagcctcccaaagtgctacgattacatgcattagctaccatacaccgattgtacaggccacaggctagccccacacaccagattttgaagattaagtgtggtttaaaaaaatgcaaaatatcctgttaataatttttgataatattacatgttgaaatgataaagtttaatgttgtgttaaataatacacagtaaattttactgacttctttttactctttaattgtagctgctaggagatttaaaattatttttgtgattctcgtatttctgttggaccagaggtattttttaatagcatgacattctgttacatggttgattatatgatgatcatatgattgtggcagtttcttgattcgattctctgttgttggacacttaggttgtttccagtcttctctgttttccacggtgctgtgatgactgacactgtggatgggtagtcatgcactcctgtgcccgctgccaggaaagagctcataaggaggacctgggaagcatttgctgcacttctgaatctagcgcatgcagactcgaccctgtgggtcgagctttggtgagaagtggttggatttggaacgtatcttgaagacgaagctgactgtctttgctgatggattggatgtatggcatgtgaggaagggggtcctttatgatctaaggaattggatggtgccatttcctgagccaggcattgccagaggcagatcagagaggaacgggtaccaagggctcagtgttggacctgttaggtttgagatgcctttttgatgctcaagtggagatgttgagttggttattggatatacaggtctgggggaattacagggaaaggggtgctggagatatatttgagaattatgaaaagctgtttgagcatcaagcaggatgggtgagacttgaccactggattttgcaacttgaaggtctttggggacttggacaagactggtgtcaggaggcatgacaagtggaagttttcaggggagaatgggatgtgtgtgttaacagcttcttgaaagagttttctctaaagtagaatgatgggggagtgggggtgctggggacacattagcacttaccgtgctctggaaggcagggtgttcaggagggaggttgacagaggagggcctgggatccagtgccagagtagagggtggaccttgcccatgggatctggagggagggcagagtagacaggcaggccttcctttcagcagtgggaggaggagaaaataccagcttgcccctttccaaaagctgagagtaagggtgacaagggggaaagaggtattataggtatgctatggagttaaaggtaaagtttgcatgaatttcgaatacaaaatgtaatacttcatatccattgagttgcttcaaagtgcttatcctcagggttctctctcctgtgcctttgggggtactttggtgaaaaagtttgagaagccacttcattattgtagtctattgttacgttgttaagtctcacccaagtgagtatttaaccttaaagagtttgagattcacttgcctattttgttatccataatagagcttttgcagctgctccaaatatccctccatttgtgcatcttaatagttgtttggcaatcaccttattctgcactgggaaggctggagaggggtggggagctgcggggtgtctggaggcagtatggcgagctcgagattcccaccctttcagagatgaggtggtggaggcaggcagggcctactaggcttctgaagcaacactcgccagggacattttagtgaccttttccccgtgttctcaaaacactttacaaatacaccatttgtctttaattctggcagggtggtttgggtgagctgggggtagtgctgttagccaaccttttacaatatttaacaatcagtagagattaaaagctgtttggcctctttcccattgatcacatagcctttttctttttgtacaattttagtatgattaaccctcccacccccattaaagttcttcagccttcttagtagaaagctctgtgaagtttgattcacccacggaagttacttcatggagtggaagcatttgagaaatcagatcttggctttcttcttgtggacagatcaggtggctgaggcctggagggagcttgatttgagatgagtagtttgtatgcctgactaagtcaagtagccacttacttcccttcacacttaatcaaatcctaactctctaactgaaactttgtaccatttgaccagtacctctcctttccccattcccccgctcccagcctccgtaaccactgttctactctacgcttcttcaccttctactttcttagattccacatataaataagaccatgtggtatccgtcacatatttcacttagcataatgccctccaggctcttctgtggccatggatgataatcatgtattgtatatttcaaaattgctaaagagtagatcttaaatgttttcatcacaagaaaaggaacttggtgaggtgatggatagattaactagtttgatttaatcatttcacaatgtatacatagatcaaaacatcccattgtatcttataaataaatacaattttttttgtcaattaaattttttaaaaattacaagaggctgaggtgaggttacagtgagctgtgatcatgccactgcactccagcctgggtgacggagcaagactctgtctctaaaaaaaaaaaaagtgaagttaaaaattaattaatttaaaaaaatcccaactcttccatcaccccagccctgcatccttctcccttcccccaagaccccctcccctgccactatgctctgattcctagagcggtgtgtccctgtcctgccactcttgctgtgcctgtggctgtccctgttccttgggtagcttccctgttactcctcaggggcttccctggccaccctctgctcgggcccttcctgagtgttacatcagcacctttcttgcccgcacccaccaccagccacagcttgtgtttgccgtgtgagccggagcacttgtttgtcacctcacggtcttcccctccatgagggcaggcacggcagtcttgctttcattcttgctttcatgcagtctacccagctgtgggcgagatgtgtgcacatcgctcagcatgtttgtagaatgaacacatgtataaactagacttgaatggagattattgttctctcctggccattaaaggtgcttcttcctgctgctcatttacatctcaggtgttaccatctctggccagtgcctgccctgttgttgtcatctaacagtcatgggaccacacctttgtgactctcagggccagaggtgtttgggaatgtggaatttttgagatttttagaacagaaatagtgaaagtaccgtatagtataggacatcctaggcagcaccatataatcaagcacattaagatttttgcagcaaaaagtatatgaatattcacactaagtgggacagtgagactatgaatagcttcacatcagatcagggcataccgccaagtgagttatgaacatgctttcagttttcagagagctttttggattttcaaattgcagagaagggattatggacctgtcttagtgagcatctgcttgtcacgcattatgcagcgtgctgaaatacaaaggaagaaaacatcacgcctgccctcccgtgtagggggtgggtggtcaccacatgcgggtggtgagcccatgctgggagggcactcccggcaggtcctgttgttctccctgtcatctccccctttcctttgcgagcgtcctctacaggtgcggtttcaggtgagccacatggggggctggcagaaggggcactgcattgtgacgcagggtcaaatgtgtccctctcagagtgtaggaggtaaccgttctggatcgcctggatcctgcccttgggtctggctgcccgggtccaaggaggaaagggccgactccaggtgatgctgcagaccaggagcgctgccctcacttcctaaccttctgcacttgggtgccggggccccctctctgcagtcacacactctgccctcttagctgggcctagagctttaaacattaactggattcaacatacgtttttctgactttttaaatataatgagtatagttttattttaatgtttttcagatgcattttgatgtaggtaggtacctttacattttaaaaatttatttgctttctgaaatgggaccagcatatatatatatatatatatatatatatatatatatatatatttttttttttttttttttttttttttttttgacaggttcttgctctgtcacccaggccagagcacagtggtgcaatcacagcgcactgcagtgcagcctcaatctcctgggctcaagcgatcccccacctcagcctcttgagtagctggggttataggcacccaccaccacacttggctaagttttaaaaaatttttttatagagacagggtctcactatgttgactaggctggtcttgaactcctgggttcaagcagatcctcctggctcagcctcccaaagtgctgagattacaggcatgaaccaccacaccctcctggtacctgcattttgaaaatgtttcattgccaagcctgcagggaagtctgccctttttttattagaaaatgaagagctaattctgaaatatgcctactaaatatgcatatctcaagcactttaaaaggatgtagggtgaaatagtctgttcctgaagcaaatatcactgtgtgttcattccattatttccgtagcttttctgtggcttttgataagttgtgtagaatgtattaagtctcatctgaaaatgtatattaaagattgttcttttaatttaaaatgatttgtccaaggtacttgacttaatgattcaagatttaatgagccgtgacacttttagtaacaccgtctcaatctttcagattttataaaagatattaaagttttcagaaagttgagaatggtcttttgtaatgtattttaagatagttaagaatagagtttatataattaagattaggatttgtattgcaaaaactcccttcaagacgcattttgggcctttatgagcgagtaatcatgacaggacagagtggcttcacccacagttttgtggttaatatttgcaagtcgtttatttaacaaggttgaaaagaggcttcctggtgtcttttataattatccttttctggggaccaacttataaagtaaaaaatacctggtggcattatctttgcttcagatgtattatgtttatggaattggaaatgtttgatttcttagtgtgtgtgtatcagtggattatgtagtttaaaatgtttgcatctgtattgcatgcataaacatgtccgtttccaagtgtggcctttaaatactcagggttttgtggccgggcacggtggctcacgcctgtaatcccagcactttgggagcccgaggcaggcagatcatgaggtcgggagttcgagaccagcctggccaatatggtgaaacccagtctctactaaaaatataaaaattagccgggtgtggtggcgtgtgcctgtaatcctagctattcgagaggctgagacaaaagaattgcttgaaccctggaggcggaggttgcagtgagccaagattgtgccactgcactccagcctggatgacagagtgagactccatctcaaataaaataaaatacaataaaataaaagactgagggttttttaaaaggtcataatagaaaaattttatgtgttttaattgtttaaatgttttcttcgggattaaaaaaacctgaatgtattctgggaaaatgttaaatggatgcaacactataagattttccacagaaatatgttattcaccgtgaagcacaatgggaaggctccattagcactttagatggtatcataactttggaaaaaccatttcaccatgcgagtatttacaaaaactgaagctgtccctgtcaggttttgacagagcttagctatataggtagtaagtgacgcagtgccaaaaccagtcttaaattacctatgttgtcaatatgcagattttctctatttagtatttaagctatgaatttaccaatctgagtaacttgaaatgcagtatcataaaaagaatcagatctaccaaactgaaaatgtgtgcgtatctaaagtagtttcttttcttgattttggttaagttaacaggagtatcttcacatctgtaatttctggtaacttaatgagaacacactgaacttttgggtcacaataaattttcccattatgtaaaatattttacacaccggttgactcattgtgaattgtgagtcgacatgattctcttcctgcggaaaacagaaacacatgctggccgggcgctgtggcttatgcctgtaatcccagcactttgggaggtgaaggcgggtggatcacctgaggtcaggagttcgagacccagcctgaccaacatggagaaaccctgtctctactaaaaatacaaaattagccgggcatggtggcacatgcctgtaattccagctactggggaggctgaggcaggagagttgcttgaacccgggaggcagaggttgcggtgagccgagatcacgccattgcactccagcctaggcaacaagagtgaaactccatctcaaaaaaaaaaaaaagaaacacatgttattgtaatgatgatttgagccaattacaggattgtgcttatgttaccacattgactaggtgctttctgtgagttgggttgttgaagagtttgaggtagacagatggcagtgggtgggaatgagcggggagcttttgttaggtttagggaatgtggtctttccaccatcatttagttgtttattttatgcataggcttattttcgttcttgtgagcattatgttgagttaatgtgttttctttgacctcaaaccttctgaaatgtttctgggtcttaaagattcaggtattatttatttcatagtagacagaatcaagtaaatgaatactttcttgggggagagtgttgataagttccatagcgacacctctccctcatgattaaaagtgctacatttgcacaaatatgtgacttatattttatattaaaattaagatcaacttttttcttgagaagttgttgaacttttagatttgggagagggggagttctcacaggaattatgaattgttttgactagtgagaagcttatttaacatttttggaaggagtaccccaaaagtaatgcatcttttggcatagtggaaacttgcagtaacgttttcttgttgttttttaattgattgggtgacctgcatctcattaagtggtgtctattggatgtttggcctttggcttgattgtgtccgcttttaaaaaataactttattgaaatcgtcacattccatacaattacctatttaaagtgtccatgtctgtggtttttagtatattcacagagttgtgcagccattgcctactttggacattctatggaaatgcggttgacaggatgtgttttctgtgtgcagtctctgtcactaagcaccatattttcattcatattgtgcatgtatgcatcggttgttccttgttaatgtcgaatattattccattgtgtggatgttccacattttatgtatttgttagtccattgatagacgtttgggttgtttctactttttggctgttgtgtgatagcgctgctgtgaacattcatgtacaggtttttgtgtggacatgtcatttctcttgggaatatacctaggttgtttgtatctgcttttgctgcttcttttacctacagttcagattcccatttatgtttgtacagacagtttgctacttgtgactggggcttgtttgacctttgttgctgacctagcgacttcttgtgtcatgtttaaagcccctgagaccctctgttgcctagagaaacaggcagaattgcagtctctttccttcctaagaccagatcacatctggtggtcatgaaatggtcttatcctgtatagatttttggtaaataagtatgtatctaagccaaataaattttgtgtgtattttatattatttttcttctctctgcttcctcttggggacatcctttgttctgtggccccagtggcacctagagtgaatatgaatgatttgtctatgttttcccttcaggcggaatgccgattacttggattttttcttgttaattttggtgactgagttgcctgtttttgaagtgaaaaatacctgcagatagtagggttgccctttagcattttaagtgtctaaatgagacctattgggatgtttccatagtttgcatcaaattcatgtaaatgcgcgttaatgatgttagctagtctgcctgagctaaattactaatttcattactactatttaataaaggggcaggatttgccatggtcattctagttaatggtaagagccctgtaggtctctcatcatatatctaagctgaattaaggttgaaaatattactgagtgccttgtggctctatttggtaacagtcatgccttacattttgagacagctaatccttttacacaccaggtgactcatgtgaattgtgagtagacacgattctcttcctgcagaaagagaatgcattcagtcagttgaaaatcaacatcatgtggtttgtaggataggtcttactcctttcttagacaaggaatctgggatccagaaggagtgagcggttggttaggaggagtcagtgccagagggaggcagcatgccctttctgctctgcccacgctgtgaggacaccgggccgtgccttcgccaggaggaggtcatgccaagtccaaagcgtcaggccgctcagagccaagcagctttgctggagcacccactggtgcacttggaaagtgatttctcctgttaaagcctcgctgccacctcaactgtaaactggagacagtaggaagccaccttcacaggcctgcggggacctggcacccgtgcaccaaaccttgctgcccttaatcagatggtcgaattgagaggcagttggaagggtcctgtggtgtgctccttctgggaccttctgccaccccttggaggcaggttgcgcccctgcccgtctcttcccaccagtggacactcccttcagccctgggccagctgtggggccctcctctgtaggcgctggctgttccaggaggcacaagagtgttggtgtgggaccttcccactgctcgagatcccccacggagagcccactcaggctacgcttgggcttctggccgtgtgggtcagcgtcacaggacggacagatcaatgggggaagagtcatcctgcagcgctgccaccactggaggctggtgagagtggcgctgccacagagaacaagccttgatccctgacttgaaagtcagagttcttctggaacttctgtggggagtgcccagagtggcacctaaatacgtctagaagcgcttgatgaaagttcctctgaggcttttaaactgcttgagtgagtctctctgaagcacggtgatggcaaaaggaaaccacctcacgctacctctttgtgccttctcttctctcctcatctcctgtaggccgtaggtgttccctgtcaggaatttacgcggaggcatgtctgctgtggccaaatgtgttcattcattcatatctcacagtaagagggaaggatgggggaggaagactgctgtatttccttaaaagtttttctgtaactcgaatccctcccacccccgtgaggtaacaacgtcttttccagttggtgtcagtgaactctgttttgggtatctacaaaagcagaaggggaggttaggatgtggctggaggaggctggttcctgggtgtaaatcctggctcttctgcttgaactgactgtgcctcagcatcctcgtctgtctggtggagccgcctcacagaggaacaagtgagttgtgcgtgtggagcaggtggctgacatgtggtgagtcctccaggaatgtggcagcagaaggaacacgttgagcaccgcagataccaccctgaccgccactgcagggcttctgtgcgggggcagctgcagagccgccgcttcaggacagcatgggagctgctggaggtcgggggagctcagggaaagggccttgctgccaggggtgggaagggagtcagtgaagacgtcctggaggagaagattccagagcctgagatgtgaagtaggttaggtagccagagacaaggcaaagaagggccattttcatcagagaacagcataacattggcagaggtctgacatgtcatttcctgttactagaattggggagtgaccagtagattctttaatttgtttattcattcgtgcagtccttcacctcacacctgttcagggtccggctgggctctggacatagggtggaagaaaaccatctgagcagaggccgcgtggactgtcacctctgtcaggggtgccagggctgccaaaggacagctgttacttatgggtggcggcgtggtgaggtcgcacaacacagagctgccctgctgtgtccatgccctggtgcctccccgtggtcaccatgtgccttgggcaaatggaggcctcaggtcccagacataggctctgtcagtggtggtggcggtggctgtacctgctccgggctgctgtgagggagggacgggctccggccacaggcgtgcaaggtccccttgcagaggacctcccgcacctgctgaggaatgtgtacagccatctggagggtgttctccccctggccctccctgtagtccagctgagtccacgtccttcagccccttttcaatgttcctttctcacagaaccttgtcctggaggtgcactcgggcccgggttcttcctcctgtgcggtgccaagccctcctccaccacgcatgatggtgtgttttccatgactcttcctcctagagcaccggtgcccgccctgacggcggttccccacagtcagattgagtatcccttatctgaaatgcttgggactagaagtgtttcagattctgatcttttcggattttggcatatttgaatatgcataattggatatcttggggatgagacttaagtgtaaacacaaaattcttttcatatacaccttatacacatagcctgaaggtaattttatgcaatattcttaaatattttgtgcatgaaacagagttttgactgtgacccgtcacgtgaggtcagttggggaattttcctcttgtggtggtatgttggtactcagaaagtttcggattttggagcagtttggatttttggattagggatgctccatttgaatattctttttatatacagcacatggtcagtgctcactaaacttagtattgcatgaatgaatgaaaaccaaaggtcatttactaagcgtgctactatttcagaagcctctttttcctgatttggttctatggtcagtggtttaatatttcaagtgctctgaccacgtaatggttgttaccacactgtgaaggtggctgggtgttcagtgattgctgcccacagaggacctggaagtgcttgctgtacttggttttctggaatggaaatcatggctcattcccaggagcccctcagcaggggctttgagtctggtgctaagcagcagatgtgcagattcccgcagggcgtacctgagcccggagagggggcgtcgtagcgcacagcgcactcgtttccgcattcccaccccgcacggccagttgtcacagccatcctccagtaaaaaacacaaaccagtcaacctctaggagacaggtaggaaatctagaagaagcctcaggtgttcacagcattttttaaagattctttaaaaatcttcgtgattggaaagactgcttcctgtgccagagagtctctctccagcgcttttgcttctgaggttggtagctttcagaaagactgcaatgcagcggttaccaaagtccttgttaatatggaaacaactcgtggtgaagccttttgctccccttcacaactgctgactgttgcctgcagtcggaaggaggagataatgaaggtaatactcctccggacctggcagtttagtgattagaacgtacgcgattctgtgaatgctgtggctggcacagcatgtcctgcagcagctctgtcaacttactgatgcagtgggcttcctgggaacgtgaagctgaagatgtctttgcagtttgtgcacgataattttgttttcatctctgtgttcagatggtggattataagaaggtaagggactttacagatcatgcatatatgtattttaaatgtttatgaatatccctaatcaaggtaaagaattatgattgaatagacctcttttgaacctaagaaataaaactttatttcttgttaatgacccttttgacgtttgaagacttatcttatttagtcttgacaaatgccctatataagtgaattattgaagatgttctttgaagagatctgctttttctttgatttgctaaacgtagttggtttcagaggtgtagatacgcatagaatatattcatttctttaacttaagcaatgacagttacattaatctggatggaacttttcgtcttaaaaaatctcagccactggctgtagatgatgaattctaatctccttagttcttattttgcctttagaagagcattttcagatgtgtggagctctgtgtttatccgtggggtgagctgggtgctacctccagctgctgctcttcgtttatcttagagggaggccaagagtcagagcggagatttattttgcaatgaattagtggccccaaacggtattaaatgcattatgggtggtaatttatatgtccaatgccaagaaatataatgttggggttaccatggcaactgcttgcattctgaaaagcttgtgaatgggttctgaaccttctggcattggaagtgagcttttccagctgagggcctgcattcgtgattagtgtaaataaattcagctttccatatgaagcacatcctttctctttgtttaccagagtagtccattgagctcagttctttctctggtgatgtctgccttggtctcttggttcctggcaacagaatatggttgagacatagttttcaacttcaggctgaggaactagcctgtgtgtgtgtgatgacctgccacctcagtccatgcactgtgtagaaggggctggctcatctgtacctcctgagggctggcaatgcatgatgtctccaaaagcacagttgcagccgcatgtgctggtgggctcctggcacagctttctatccatctgaagggcttgtttccggtaacacttgctagggctcttcctgggaggcagccctgcctgtttccagggtatcatggggattggttttggggagggaggcccaagttagaaagacccatgtttaaaatgtcaagcttgtgaaaatgataaacgagggcctattgtcttcattgccgaagatctgtttgctgtttgttagaaatatatgtagcataggccggggatggtggctcacacctgtaatcccagcactttgggagacgaaggcaggaggatcgcttgagcccaggaatctaagaccagcctgggcaaaatagcaagacctcatgtctacagaaagataaaataaaataaataaataaataaaactagtttcccttgtgcatttaaaacaatgttgacatcttgatggccagagactgaaatgtctgtgtgtgatttcaggggcctgaggtcggaaggttggagcctggtggttgctgccgaggcggcagctcctagagggcctggccagacactgggagaatgttttcatgctctgtagaattcattctctttgttaataagcattgagattatagaatttaaatgttgagcttgaggatagactggccttgaggcacacagcgggcatgctgctgtggctcacctgtaggcctcagttaagaatctttgtctaatccaatccctttattttacagatgaggaaaatgaggcccaaagaagtgatgccacttggttaaggtcccagagcaggtcagaatcagacctaggatcagaaacctggctcctggctcctggctccctactcttctaaggatcgctgtcctgacagaagaggtttgctctcagttaattgatgttgttgttgttttgctttccttttgtcagaaagaggcctgtaataacaacaggcatctaatttagactctgtaatttagaattttaaaaattcttgtcttcccttcttctggttatttatagaatttctactcagtgtgctggagtcacccataggaggggcaaagggcatgacctctgcccttaacgctgtgtgctgtgatgagagatgggtgcatagccgagcctgcaaactggaatgttgggataaattctggcttgacatctccatttctgccaggctgtggtattctgtgttcttacagagaagctgcagtgcccagcagttacccaggggtgaatctgaatcaccacctgttaaatcaaggtcatgatactgtatttactaaggcaggacaacatagtaatttaggctcaacttacaagttgcaacttattacaagtaataagaggttcggcttacaaggtttgaaatacaaattgatttttttagccagattccattgaaccctggtttttaattttccaatcttgaaagaagactgagattttactgtataactcacttagggtgacattgtgttttcctaagtattctcagtgatttctcccattctccctattcttctcacatgggactttgacagagagctgcacctgggctgggtgtgtggcctccctcacccagcagtatggcccaatggtgctatgtgactgctgagttaggtccttaaaagggtgcagtttttgcctggatgttctttttggggtacttgtttgccatccctatggtgaggaaacccatgtcgcccacacaggaggaccacacagtgagcagggcattgacataacaaggtgacttctgttttctgagtaacttccaccacagtggtgaaactgtgtccccaagctcagcaggcggaggtaaaacatttttcaaagaaaagggtaagataggctcttggtttaccacatggtgaagagaggcctctggctcttccaaactgttgcagatagagcgtggagtgctgggacttcggtcaggccaggtcctgccgcctcactgtccagctctcctgagtgctcctggtctgccttgctctctgcccagtgctgcctgctgcccgctgcccttatgtggagtgaccttctgtctcccagccccagccatgggtcccgttgcccagaatacaagagcctttcttggcttagaactttaattcaaaaccctcagttcttagagggtttgttttccctttttttttggcctgggattttgagaatatctaatagtgctgggcagttttatcattcatcatcatgggtagtttggtttattacaacttgcagcttcatatcttgtaaaacaaattcatttcttgctttcagatttgcttatctaaaagttttgttcataatagtaacttagcacaaggcttctaatatatgagttgatgaaaagcacctcctgtatcacctttaataaggataattttgaagtgtaatttaatgcctggaagccagttggtactgaggtttaattttgtacttgggaaagaagtgtgagaagaaaagtatccttttttccttaaatttatttttcttagttgacatataaaattgtatatatatttatcatgtacaacatgatattttgaagtatatatattatggaatggttaagtctagcaaattagcaagtgtaaagataaactcacagttatctttttttgtggtgagaacactttacattttttctttcttttaaacataaaatctttcagaaaagacgtctactttctcagcatttttcaagaagaaaagtatctttttaacaaatacattttctaagccctggtctgcaacccactccattcagttaatatttatcaagcactggccgggcgtggtggctcacacctgtaatcccagcactttgggaggccgaggcaggtggatcacctgaggtcaggagttcgagaccagcctggtcaacatggtaaaaccccgtctctactaaaaatacaaatatgagccgggcatggtggcaggcacctgtaatcccagctacttgggaggctgaggcagaattgcttgaacccgggaggtggaggttgcagtgagccaagattatgtcattgcattccagcctgggcaataagagtgaaactctgtcctcccaccaaaaaatatatatatttatcaagcactacctacacacacacccactctctcttatacacacacaaacacactaatagacatagcagtaatatatattaagcatgaatacagcaagaagtttggtaccctagaattagaacgggtttttttttcgtatataatctacaaaatgagatgttgaattgatgtttaatactaagctacttcttaagcatttgatttttcttactgcatttacctatgtttataattttaaaatctgagaattatagaaaatacgtaatttctacttatctttcagattatagcttaaatgtcctctcctggggtgggggaggtccccatatccacataaatgggtgtgacctccatgtgcactgtgcacttccctttggtacttttcgtctcacacacatgcacaccctgcacagacacacacactcttattgctggtgttctgtcttcttgcctgtggactgtcagctctgtgaaggggaggcttctgtctttcttgtccctctcccttctgtggcactcagtacatgttgggtgaatgaatgaatactggacacagacgctttccttgaaggtggttggatgatctaccctttccttataggactttttcagatgttttcaaattcaaccaagaaatcttttttttctattactaagttactgtttttccaaattattgaatatttctattttctcctgcctttaaggagtaggaaacaactaagaacagatgatgtctcatgttgcgaatggatccttccttcctttgcttttccctcaagttctttctcatgcaagcgaacacccatattgtgaggggtagcaaatttaaatgagtcctttgcattcgagtatagagatgactgaggagaatgaggtagtttggaaacactagaaaaatctgcctcagtgcttttgatattttaatttataggcaattcttttaagtttcatttttctcaagacaaatgccagactgtggaaagggtgctgtcatttaaaaatattcgggcatgtggccgggtgcggtggctcacgcttgtaatcccagctctttgggaggtcgaggcgggtggatcacgaggtcaggaattcgagaccagcctggccaacactgtgaaaccccatctctactaaaaatacaaaaattagctgggtgtggtggcacctgtaatcccagctactcaggaggctgaggcaggagaatggcttgaacccgggaggcggaggttgcagtgagccaagattgcgccactgcactccagcctgggcaacaaagctagactttgtctcggggggaaaaaaaagaatatttgggcgtgcatactgcccaaagcgatttacagactctctgctattcctagcagattaccgaggaccttcttcacagaactagaaaaacactgctttaaaattcatatggaaccaaaaaagagcccaaatagacaaggcagtcctaagcaaaagaacaaagctggaggcattctgttacgcaacttcagactatactacatggctacagcaacctaacagcatggtacgggtacaaaagcagacacgaatggaacaaaagagagagcccagaaataaggctgcacacctacaaccatctcatcttcgacaaagctgacaaaagcagtggggaaaggactccctattcaatcagcggtgctgggacgactggctagccacatgcagaagattgaaattggaccccttccggctgggcgcggtggctcacgcttgtaatcccagcactttgggaggccgaggtgggtggatcatgaggtcaggagatcgagaccacagtgaaaccccgtctctactaaaaatacaaaaaaattagccgggcgtggtggcgggcgcctgtagtcccagctactcggagaggctgaggcaggagaatggcgtgaacccgggaggcggagcttgcagtgagccgagactgcgccactgcactccagcctgggtgacagagcgagactccgtctcaaaaaaaaaaaaaaaaaaaagaaattggaccccttccctacaccatgcacaaaaatcaacaaaagatggattaaagactgaaatgtaaaacccaaaactataaaaaccctgcaagacaacctaggcaataccattctggacacaggaactgacaaaggtttcatgaagaaaacacaaaaagcaattgcaacaaaagcaaaaattgacaaatgggatctaattaaacttaagagcttctatacagcaaaagaaattatcgacagagtaaacatacatcttacagcatgggagaaaatatttgtaaattatgcatctgacaaaggtctaatatccagcatctataaggaacttaagaaacttaagaactacaagaaaaaaaacaaccccattaaaaagtgggcaaagggcatgcacagttagttttccaaagaagatgcacatgcagccaacaggcatatgaaaaacagcccaaatcactgaccattagagaaatgcaaatcaaaaccacagtgagatagcatctcacaccagtcagaataactattattaaaaagtcaaaaataagatgcttattttgagggtatggagaaaagggaatcctaatacactgttggtggagtgtaaactagttcaaccattgtggaaagcaatatggtgattcctcagctaaaaatagaactaccatttgacccagcaatcccattactggttatatatactcaaaggaatataaattgttctaccataaagatatgtacacatgtgtgttcactgcagcactattcacaatagcaaagacatggaatccactgaaatgcctgtcagtggcagattggataaagaaaatttggtacatttatatcatggggtacgatgtaactgtaagaaagaatgagatcctcctgtcttttgcaagaacgtggttgggagctggaggccattatcctcagcaaacgaatgcaggaacataaaaccaagtaccgaatgttctcacttataagtgggagctaagtgatgagaacacatggacacaaagaagggaacaaccgacagtagggcctacttgagggtggaaggtgggaagagggagaggatcagaaaaaataaccattgggttctaggcttcgtacctgggttacaaagtaatctgtacatcaaaccctggtgacaggagtttacctgtataacaaacctgcacatgtacttctgaacctaaaataaaagtaaaaaaaaataatttgggcacgatgactcatgcctggaatactagcatgttggcgggaggatcgcttgaggccaggagtttgaggttacactgagctgtgattgtgccactgcactccatcgtgggtgacagaacaagaccctgtctctaaaatatttatctacatgatatatacatttggtgggtgctttggtcccaactgtctgtgaccatctggggcagagccagtgccgtgtgcaaggtgtactgcctgcacacagcacaggaggctggggctggccagggcctgtgcacctgctcctctgtgcctggcttgtggatgcccctcactcgctgagtcttttctgaagtcatttagcagcactgccactgctctaacctacatttaaagatttattttcataattttctggcagaaaattttattaatgtagccattttatttgtataatgattgttgagaatagaatattttatgttcaagatattgattaatttttggagaaactaagaaatttgatgttgcataacaaatctctatttaaattcacggtgtaaactgcagtgaatcattagtgtattaggtaaaagccaacattgcagaatatagtttatttgaaaggccgcttagatgaaaattctagggtgatctggaaatgttttacacttttgtatatgtgatcattggatgctacttaggagagtttgtactagtgtgtctagcagttgtagcaaggtgaggtgggtggccacatttgattatgaagtaaatttattctagagagtttatatagcatgaagaatattacaatcaaagaagtgttacactacatatcttaaacttttaacatgactcttatctagctataaaaatatgtctgacattttgtgttttaggaatgaagtaagtatgcagtggtaatgaatgtttgatcatgatttcaggtgagtaagacgtcagggaaacctatcacagttccataagcaaaaatgaaaaaaactcactgaggtatattgctacaaaatggcttctttcccccaagaatagctgtaactgtgacagagtagcgcagcacagtccttccattctccccttgctctttcctcctcctcatccagatgcatttggatgatactgttcaaaagtaagataaataattgtactcaattttcatattagagtagctagaaattaagcaagtaatttgtgtgtgtgtgtgtgtgtgtgtgttttttttgggggggggtgaaggtcttgctctgttgcccaggctggactgcagtggtataatgacagctcgctatagcctcaacctcctggacttaagccatcctcccgcctcagcctcccgagtagctgggaccacaggtgcatgccaccacacctggctaatgttcacattttttatagacatggggtctcactatgttgcccaggctggtcttgaactcctggcctcaagtgatccttccaccttgaccttccaaagtcaaagtgctgggattacaggtgtgagccaccgtgcctggcctccaaacaataatttaaatgatgtgataaattttattttagcctagccgagatcttaaaatctattttgaagtcaggcactagccttatttggttcagctaaaggtgctccctggtgcatcaggttgtgaatgtcatatatgagtcctaagggagtaaacaaactctggctgtgtcagtgctgaaattcaaaacagtaaaaaaaaaaaagatacttggttttaaaatggggtggatgcatctattgggctttattgatattttggaaattttgagatatgtattttgcctcttgctaaggaattagataatcgtgcagggtttgaattgacagttgtcaaagtcagcaaaaatactatggtcaaattgctgggtctttgagacctaggttttagtcctgttagctctgactttgggcaagttgtttgatgtaattgttttagttcctcaacaatccagaccctggccagcagagttggagcattgaatgatctttctaagataatttgagcgtacaaatggcaaatctgatttaacagcataactgttgattcttacggcacaagtcagtgagcctgtctttgttgaggtagtcgcggtgtgataacagacatagtagttaagaacactgactcgaggtagaccgctgtgccgcttagtaacgtatcgtgttgtgaagctgctgaatcttcgtactctagtttcctcatctctataacaggcaaatttgtaattgtgacaaataataactacaagaagtaaattaataactaagaccaaatgcatactgtgtggccagcaccattgtaagtgctgaggatacaaacctgaacaagacacattgctgtcttcagaaagctcacagtcagatgggagagagagaaggaagcaaggcaagtacaggcttgtaagtgttgtgatgggtgtccttacaggaccaggatttcaggaggtaaggtcagtttccctgggaagggagagttagagaaaagatgctcgcagtttaattcaacaaacaagtggtacctgctgggtgtgcctgccgtcctgctaggcattgagactacaggataaatttagcatgatccctgctctaaaggagcttaaagtttagtggaaaaccatgagtctagtgataaatagtagttgtcaagatacttgaatggagtcttgcagatgaagtgtttgacaggcagtggaagaacaaaaacacagaaggagacagtcgttgcggctggagcagagtttgcaagtccactcctggtgagggaggggatgctgagccagcagggcagggtctactcacacccagaggctggctcggaagcagcagatgtaaagggaagtgtgtattggagggggtatgttgtgaatttgatgacgtctgattgttacattgaattccatgagttctagacaatttcttcatgataattacccccttaaatttcataatcttcattcccccactaaatttaataccataacatttttaatttaaaaaacaccttttttgtcggtacttttgaaaacattttcctgcacctgtgccttctatgaaatgaacgctgtagagaatctgtggaaatcggctcatggtagaagctttccctgtcatatggatgagtccttttgcttgcccagtgccctcctggcatattgatgaggtaggattgggagttcggaacgcctacaaaatgagcaggctaatttcgaacggatgctaatcctgcaaaaccaagagagatgcttattggttgatttgccttttttttttttttttttttttttttttgaaacagtctcactctgtcacccaggctgtagtgcagtggcgcgatcttcgctcactgcaacctctgcctcctgggctcaagcgattctcctgcctcagccttctgagtagctgggactacaggtgcacgctaccacttctggctgattttttgtatttttagtagagacggggtttcaccttgtgggcctgactggtctcaaactcctcacctcaagtgatccgcccatcttggcctcccaaagtgctgggattacaggcgtgagccactgtgcccagccattatttgcttttagttgaatttgtgtgtttggagactgagcacttactttcaacagtgaagaaattgacttggcagcagttgctgcaggtggctgttttcggtctacctcatactgtcagtgtgtcgcccagatactatataattactcagttattttgcagtcacaacatctttgtgtgtttgtatttatttagtaattagaagaaagtttttatgttctcatagtatcttcctgtctacacagtgcatttgtttactaatttatatccatttgatacacatctaatgattgcctctgatgggtatatgtgggaacatgtacattccctactgttagctgcaaatagtgagaagtagttagagcataatgtttcacatcgaagtaatctctttttcaaagacatctctgagaatgaaaacattaagtttggcagttccgacaaactcttatagtgataaggtattagtctaattctacttagtaagaaagttattcccggagacttccatttccactatgatggaattagaggtgatttacgccccccaacccaggactagggtaaggcaagtgaggcacttgcctcagtgcagaatttaaagggacacccaaaatctcagtaatcgagattattaatattttaatgcagtgctttaaaaaaatcaaatttgatgcaaaaaaaatccatgatgaaaaacaaaattattttttactttttaagacagggtcttgctctattgcccaggctggagtgcagtggagcaatcatagctcactacagctatggtaatacagatgggtgggctcaagtgatcctccagcctcagcctcctaagtagctgagactacaggcacatgccaccacgtctggataattttttatttttttttgtagagtggtgtctcactgtgttgcccatactgatctcaaactctgagctcaagcagtcctcccgtcttagcctcccaaagtgctgagattattggagtgagccaccacgcctggcccaaaacccaaatttgaaagacaggatcagtattaatgatttttctttttgtctcaagctccagcatggcttggcaagacaccattatcgatattatatataaaactttggtattttgtacctcgtggattttttcattaattttgattttatctctattactgagtttttttgacactcaattaagatttgtgcctaaggcaagtacctcacttggcttgccctagtcccaaattgacttctatcttaaacaacttgaaaaccagacaaaatatatgaagtaatagttttcatacatttgacagaaggctggttaggaccatgttccttgaaataaggggaacaaacaaaacaagccctgcagtattccagcttataccccacagcatgagactgcacttttttctataaagggctgtatagtaaccattgtaggttttgggggccggatgctgttaatgtcacaactactctgctatgctctgtgcctgctttcatcctaagtatgtaagtgaatggacgtggacgcattacaataaaacctttctgacacaaacagccttagtttgtctcgagaggcagtttccatgtttcagggcaggaagagagaagtcaaacagaacccactggcttcactaaagtgatgatacaggagaaattggggaggacaagacagctagaatttgtggaggaaaacataggagaggagggagcaggttagagagagagctctagagatctgcagaagggcccccttgaggcgttggctgcatcctggtctgcacgtggccaagaggaagcacctcaaggctgggaggagaaccaccaaaaaggagaaggccaagcacttcttggacatcagttgcacagggctgggaatagtttgtgttcccaccacccagggtggtctcaggtagatcctttgaagggttgccttttcatctttgttagcgtgggttcagagcagctttttcatctatggtgtcaggacgattcctcagaagggctgccttagcagtggggctgagttatccatagaccaatgggctgctcccgacttgccctaactgattacagatagcttgattacattatcagaaccaaagccccgactatatttaaaaaggatgtaataaaactagcacccaaaaatgtaaaaagaaattgtgtctagcatctaataaataattaccaggtatgcagagaagcaaggaaatgtgatattaaccaggaagaaaatcaagagaaacagaacccagaaagacaagggatgatgcaattagcacacaaacattaaaataacttataaatatgttgcacactcaacataaaacgtagagaaaaacataagcatactgagtgaaatgaaagactcaaaaaagattgaaataaaacttccagagatgaaaatagaatatatacaatatataaaatgccgggcgcagtggctcacacctataatcccaattctttgggaggctgaggtgggcagatcatttgaggtctggagttgaagagtagcctggccaacatggcgaaacctcgtctctactgaaaatacaaaaattagccgggcgtggtgcaggcgcctgtaatcccagctactcgggagactgaggcaggaggatcacttgaacccgggaggtggaggttgcagtgagccgagatcacaccactgcactccagcctggcgacagagcaagactctgtctcaaaaataaataaatagataaaaataatatatattttatttatataataaaatatataataaaataaatttatatatagtaaaataatatatacacatgtatatgtatatataatgcagtagagggatcacaacaggttattacgacagaagaaaagagttcatgagcctgaagacgtagcagtagaagctttccaaagcacagcacagagaatccagactgcgcgagatcacagagcatcagcagcctgtgggacaaagtcagctgacttaagatatgtataacctagttccagaaggagaagaggagggaatggaaaaaatatttggagaaataatggctggaaattttccaaatttgatgaaaaatgcaaactatgaagctcaaaaactccaaacagagcaaatataaagaaatccaaggtacctcataatcagattgccagaaaaccagtgatcaagatcaaaagctttcaaagcagccagaagaaaagacacattacagaggaatacagttgctaataacagcgattcctggtcacatcttgtgtgaaccagaagacaacagagcaacatattcaaagtactgaaagaaaaaaacctgttagagttctgtatctggcaaaaatgtctttcaaaaatgaaggataaatttttatttatttcagaagtaaagaaatttttaggccaggcatggtagctcacacctgtaatcccagcactttgggaggccgaggtgggcgaatcacctgaggtcgggagtttgagactagcctggccaacatggtgaaacctcgtctctactaaaaaaaattagctgggtgtggtggcaggtgcctgtaatcccagctactcaggaggccgagacaggagaattgcttgaacccgggaggcagaggttgcagtgagccgagatcgtgccactgcactctagcctgggcgacagagggagactccatctcaaaaaaaaaaacccaaaaacaaaaataaatttttaggccaatagacatcagaatttattgccagcagaatggcactaaaggagtattaaaggaaattcagatagaaagaaaataatatttgatgggaaaaatttttatttatatatattttggagacaggatctcactctagtgtccaggctggagtgcagtgggtgtgatctcggctcactgcaatctctgtctcccgggctcaagcagtcctcctgcctcagcctccctagtagctgggactataagcgtgtgccaccatacccagctaatttttgtattttttgtagaaacggagtctcactgtgttctccaggctggtctcgaactcctgatttcaagcaatccacccatctcagcctcccaaagtgctgggattacaggcgtgagacactgcactcaggcttaaatagtcagtttccatctggggccaggcatggtgtctcacacctgtaatcgcagcactttgggcaggaggagagggcagattgcttgagcttgggagtttgaggctacagtgagctatgatcacaccactgtactccagcctgggtgacagagtgagaccctgtgtttctaaaaggaaaaaaaaaagtggtaaaattgacaaagctccagtgaaactgataaggaagaaaaaacagatataaataatgaaatgaaatgaaaaaggtgaaaacactatggattcagtagactgttaagatatcataaaaggatattagaattagcatcacgctatatacatttgaaaatttagataaaatagacaaatttctttcaaaatgtaacttaactaaaagtaactgaagaaatagaaaaccttaaccagtcctatgactattaaaaatgtttagatttaaacaaatgtatgattgagggaatgctgggaatgtgtgtaaacacatacatatgttgtcatgtgttaccttaattgacctatacagttcttgagtacaagattaaaacctgtttctgagtatgtgattgtatcaatgagggctctttctgatgtaaattttgagaaattcaaccttagttgttttaagtaagtaaaaagaaggtttattgatcatctgattgaaaaacctaaggcagggctagctatagatggttcacttgggccagtttcttccccagcatcctccttcatgtgttcaggttctttgggaaagagggagaatctctataagtcccatagtgggaagaggagacccattaatcctgacctgggttgtgtgttcagagatgagccaactctgggcaggaaaataagatgctctgaatgaccaggtgcaaatcacaggctttacctgggcccaggtgttggagtcagcgcccctggaagctgtggactgagctgggaatttatacctgacaaggatcagggtgcaggaaccatggggaaggtgaacaaatatttggctacaaaattaaatctccattgcagtaattgccagatgtaaaatttcatgaattctttattcaaaattatgatgaaattctataataaagaattcttagttggccaggtgtggtggctcatgcctgtaatcccagcactttgggaggctgaggcgggagggttgcttgaggccaggagtttgagaccagcctgggcaacatagtgagactcccacctctaaaaaaaaaaaaaaatgttgtttttgttttgttttttttgagacggagtctcgcactgttgcccagactggagtgcagtggtgcaattttggctcactgcaagccctgcctcctgggttcacaccattctcctgcctcagcctcctgagtagctgggactacaggtggctgccagcacgccggctaattttttgtatttttagtagagacagggtttcactgtgttaactaggatggacttaatctcctgacctcgtgatccacccacctcggcctcccaaagtgctggaattacaggcgtgagccaccatgcccggccctaaaaattttttgtttttttttttgagatggagtctcactttgttgcccaggctggagtacagtggtgcaatcttggctcactgcaagctctgcctcccgggttcaagtggttctcctgcctcagcctcccggttagttgggattacaggcgcacgccactagctctggctaatttttttatttttagtagagatggggtttcaccatgttggtcaggctggtctcgaactcctgacctcaggtgatctgcccacctcagtcttccaaagtgctgagattacaggcatgagcaccgtgcccagcctaaaaataaaaaaaaaattttttttttttttcaagacggagtctccctctgtcacccaggctggagtgcagtggcgccatctcggctcactgcaagctctgcctcgcaggttcatgccattctcctgcctcagcctcccgagtagctgggactacaggcacctgccaccatgcgtggctaatttttttgtatttttagtagagacagggtttcaccgtgttagccaggatggtcttgatctcctgacctcgtgatctgcccgcctcggcctcccaaagtgctgggattacaggtgtgagccactgcgcccagccaaaaaaagttttgaatttgctgggtgtggtggcacatgcttgtaatcccagctactggggaggctgaggtgggaggatctcttgagcccaggagtttcaaggctgtagtaagtcatgatcatgccactgcactctagcctgggtgacagaggtcgaccgtgtctcaaaaaaaaaaaaaaaaaaaaaaaaaaaaatactattataccgctgttcagttagcaggaattaaaaagtttggcaattgttgttgaaaaagttaagcaacagaaactctctcatacccttctgatgggagtgcacattacagctgctttgggaaatagtttggctttagagtataagctagcaatcatacttctaggtatgtacaccagagaaacacatgcctaaagtgattgagatagctgtaccagaaaaatcttaagtcgtgtttatatttgctccaaagcagagaccaccctcggggatgagaatggataactaaattatggtatatttactgagtagaatattacacagcaatgaaaataaactacagacacagcaacaacaaaaaaggcaaagaaaaaagcaagacaagaatatatgtagtatgattttgttattttcatctgcttctggtttttatataagttatgtttggtagggctgcacacctaggtgataaatctctaaagaaaagtttggaaatgataaaccataaaagttaaagcacagtagctcatgcctgtaatcccagcactttgggaggctgagatgggaggatcacttgagcccaggagttccagaccagtctaggcaacacagggagatccagcttcttaaaaaaaaaaaaaaaaaaaaaaaaaaaattttccggacacggtggcatcctcctgtggtcccagctacttgggaggctaagatgggagaattgcctgagtttgggaggtcgaggctgccgtgagttgtggttgcaccactgcactccagcctgggtgacagagcaagatgctgcgtcaacaaatcaaacaaaatcattttgttaaagctagtacttacttacgtatgtggtggaagggttttggggtcagatagaggcacccagcctttctggagttctggcaatgctccatcccttggtggtagttggactggtatttatgtaataacttcatgaaacggtatacatatgttttctatgcttttctataagtaagtaatacctcatagtaaaagcagttttaaaataatcagattttatagtgcatgttccattaaaaaaatgtggaaaatccccaaagcacatgcatatacagtagttaatcatgttttatcttaaatttattcatattatagaaatttaccttttgaaatttcatttttatttatttgagatggagtctcgctctgtcgcccagactggagtgcagtggtgtgcatgatctcagctcactgcagcctccgcctcctgggttcaaactattctcctgccttagcctcccaagtagctgggattacaggtgtgtgccaccacgcccagctaattcttgtatttttggtagagatggcgttttaccatattggcccggctggtctcgaactcctgacctcaggcaatccaccctcctcgacctcccaaagtgctgggattacaacatgagccactgcgcctggccttgaaatttcatttttaaaagctctaaaaattttccaggtgagaattgaccaactattattattttctgggtaagggactccactacagtaattaaagaaggataaggttggcgttgctttgctcctttttttattgaagtccttccttcctgatcaagcttccatatatctccttaaaacatatgacacacaggtatgccactaaaaaacttaatttgtgtagatttctttcttcagctgttactttttcatcttgcataaaaatcaagtaattaaattttaaaacatcctgaacatattcatttttggctttagcaatttcattcttcagcagatgtatttgactttctatatacatggcactttggtttggtttgtgtctgaccttatttttatttttcattttttttcaaaccagtattaaactgaaaataatagacgtcatacctcatggcccaggaatgagtgaataagttggaaaaccaagagtagtggcctgcatctctttgtccaaggcctactttccaaaatctctcggccctacccttccctagaaggttccccactgcaaggaaggcacaggcagcctgggggtgtgacctgcctcatggagtattgcattttttgatacaagaactatttgctccttaacatctttctctaggagtttgaaagaaaagaaattactctgtgtttcagtctctaacttgtgattgagtggctgaggtgggaggatctcttgagcccaagagttcgataccagcctgggcaacacagtgaaactctgtctaaaaaaataaaataattaactgggggtggtggtgtgtgcctgtagtcccagctacatgggaggctgaggcaggcggatcacttgagcccaggagttccaggctgcagtgagctaggatcatgccactgctgcccaggctggccatagaccaagaccctgtccctttaaaacataataataatctttcatatgttagaatgttaaaaataagtataagaagtttgaaatgtttgcatccaaagtgagatttaatacatagctatttttgataaattgaaaagtgtcaagaaaactgctgtttaaatttcatttataatcatgatctcataatagtaccattcaattttctccaatagtctctggtatttttagtttgtttgaagcagcgtccaaataattgcagttaactgataggtctgttaagtctcttaatcaatagaatacttttccccatcccttttttccttgcattttatttgttggaaaatccaggctgattgttcagtagtcagaagttccctcattctggcctttgctgtttccactggacatgttcttctgcctgtgggtggatatagaggctcgatcgctttctggctcagcctttcagcacaggtacttcagaggtgcgtgatgccctcaccaggaggcacacatctgcactgatgtgagatccagtgttgttgttgttgttttttccttttgtcttttttatttaaaaatcatggggtcttgctatgttgcccaggctggttttgaactcctggcctcaagcagtcctcccacctccgcctcccaaagtatgctgcaagcttaagccatggcgcctggcagatctagtgttttttgaaatctcatgttttattctaacaattgatcgaaacattataatctgcttctcaatatggccatgttttatgcttttcacgtcttcaaatacagttgacactccaggaagatgaaccttatcacatttgcaacttctgccccttatacagccccggggctccagccccatgtggcaggcgtgacctaggggaagcctccatctggagaagtgctgcctgcacttggttgcatatcgagtggactgagcccttggctcctctcgctgcttcctgtccagatggcaggactctggtcgtgggccaaaagaggcacagtgtctttgcatataataaggattgaatgaatactttttaaaaatcctaactcttatgaaccaagggatactgacaatgctgggccccaaataactattgttttctcaaaggctttaagaccatgtgttatactgtgatttaatcaggttctttcctaggagtctgcctgagtcacttggtctgtgtgtctctccctccctgtcctaagggggcttttcatgtgtgactgtgttctgcctgcctgtctggtaagaatccagcctcctgttacttgcccaggatgctgactgtgggccctctcccgcagtggaacatttggcatcaggtaccaggaacagagtcagtatgctgaaatgtttgcatgaatgtggattttcagaaagctttcttatcagcagggcacacctgtctgttcgtgatctttgcccttctccctttattggcatcacttggacgatacctttaattgccctgctgggcttgatgttgagctgcttttctccatgtgtgtcgtgttttgtgctttcttgcggcaggagccttttgctttgtttatctgatgcttcccttttttggttttccccgggctttccagctcttggagcacccttttgtcagcagatgtacttttgtttccagtttttaaattctaattacagtgtaactcaactaaaatcatggaactggggaacataaaacaaatcattagggtaatggaggcatagaagaaagtgaaaggaatccagtccacctctttgctgtactaggtatggatatgcctcagctgtgagtgagggccttcctgagtagctgactacaaactaaacttttatgaaagaattttcttaaataattagagatgcctttcatttagctaaaaacaagacctcaaaatacagtaaattcatgtctaagactgtagcaaacagtaagtaaagtaatagagtaaaaattctgcttaaagaagactgcagaataagaattgcaggccgagcgtgctggctcacacctgtaatcccagcactttgggaggccgagatgggtgaatcacttgaggtcaggagttcaataccagcctggccaacatggtgaaaccctgtctctactaaaaatacaaatagttgggcatggtggcacacacctgtaatcccagctactcaggaggctgaggcaggagaatcgtttgaacctgggaggcgtaggattgaaccaagattgcgccactgcactccagcctgggcgatagagtgagactccgtctaaaaaaaaaaaaaaaaaaaaaaaagttacagcgctcagagtgccagatgctgcgctcctggtagtttctggtcttggcccttccttagctcaaagtgcactggcataggtgccattttttagtcacacaattcccttcattgtaattttcttagcactgtctttgcttagtggatctgttgttgccattcagcagtacatttctctctgtgtggaagcaaacatcttctcaaacctgatgctcagtgaggataggcagtgggctattaaataggcagtggcctcagattcccagcatgtgtatgattgccgtgctaaccagaggcgcatgtgtccagcatctgggcattggaacctgcaagctgctcccccaaatcaggatgccaaacattaattggcaagttactaaaagttgcctcaaataccatctttaatgcatttaactgaatttgcataatttttctttatcagcacaataattattataaatattgtagaattgccattaacttataattgtcatatctaaattttaggataaaaatagaacttaactatttttatacccatatataagcaagtgaagtaaaggtatttatgtttaaatcaagaaatctaatcaaaggtttttacaatccttccaaatatgcaatctcacttatttcttgccacttctggtgataggtctgtgtgtggaagacacgggattcctgcctgtccacagctcagtgtgaacggaccagatatggtcacagattagaatttaccatcacagggccgggcgcagtggctcaggcctgtaatcccagcactttgggaggccgaggtgggcggatcacgaggtcaggagattgagaccatcctggccaagatggtgaaagcccgtctctactaaaaatacagaaaattagccaggcctggtggcgggcacctgtagtcccagctactcaggaggctgaggcaggagaatggtgtgaaccctggaggcggagcttgcagtgagccgagatggcgccactgcactccagcctgggcgacagagcaagactctgcctcaaaaaaaaagaaattatcatcacaggcctcgtgggtggttcgtgtaagaggctgaggcaggaggattgcttgagcccaggagttcgagaccagtctgggccacattggcgagacctacctgggcaacatggcgagaccctgtctctacaaaaaatagaaaagttagcggggtgtggtggtgcatgcctgtagtcccagctggttgggaggctgaggcaggaggatcgcttcagcctgggagttcaaggctgccgtgagccatgtttgcaccactgcactccagcctgggtgacggcaagaaaagaaagaaaataaaagaaataacctcaaaagaaaaaaaagaaaagaaattacctcaaaagaaaataaattacccttacagacattttatttttattttattttttttacagacaaggtctctctcttgctcaggctagactcaacctcctgggctcaagtgatcctcctgcctcagccttctgagcaggcactacaggcacacgctgccatgcccgacaaccaccacagataatttagaaaaaattagccttttagttttaggagctttcttttacagtgatatttagtttggggcctttgaacttggtctttgcttttggagctgtacttgtaggtgttgttgttccagcctgggaacgagacatgaccgactccagtgcggcctgcttgctgtcctcaccatcagtcagtgtggtccgtgtgtgaggctgcagttgtcctcttggccacttatttctccttaattctctgcatgtaatttaaaacattatcccctgaaacttagtttttcattgacttctaatatctttacttctccttttaattttcctattgagatacttaggatgacatgaaattctttggatctacatatggacaaacagaattgtgtcacataaggttcagtgtgctagctgtttaaaaaaaattaaaaacagtttgttttttttagagacagaatcttgccctgtcacccaggctggagtgcagtggcgtgatcgtagttcactgtaaccttgagctcctgggcttaagcagttctcccgcctcagcctcttgagtagctaggactcacaggcatgtgtcaccatgccaggctaatttttattttatttttatattttatttttattattatttttttgagacagagtctcactctgtcgcccaggctggagtgcagcggcacaatctcggcttactgcaacctccacctcctgggttcaaacgattctcatattctcctgcctcagcctcctgagtagctgggactgcaggctcacaccaccacgtccggctaatttttgtatttttagtagagacagggttttgccatgttggccaggctggtcttgaactcctgacctcagacgatcctcctgccttgcctcctaaagtgctgggattacaggtgtgagccattgcacctggcctttatttttttttagaggctgactgagttttgctgtgttgccaaggctgatctcaaactcctggtacttcaagcagtcctcttgccttgacctcccaaagtgctgggattacaggtgtgagctaccacgtcctgcctgctagccatttttttatgttcgtggtggtggtaaggagtggctaccaggctgtgcgggattcaggaatctggatgttccccccaccaccgttttttaccccacgaaaaaaattgtaaacactttctaattgagataaaatttacaaaacaaaattcaccacttaaaccacttaaagtgtacaactcagtggctttgtgtatattcagaatgttacggccgggcgtggtggctcatgcctgtaatcccagcactttaggaggccgaggcgggcagatcacctgaggtcaagagttcgagaccagcctcgccaacatggtgaaacccccatctctactaaaaatacaaaaaaattagctgggcatggtggcacactcctgtaacctcaggcaattgggaggctgaggcagcagaattgcttgggcccgggaggcggaggttgcagtgagccgagattgcggcactgtactctagcctgggcgacagaggcaagactccgtctaaaaaaaaaaaaaaaagaatgttatgcaaccatcactactatctaatttcagaatatttcatcaccccaaaaagaaaccccataccactaagcaggcactctccattcttcgcttgccccagcctctggcaaccactaatctactttctgtatctatgaatttgcctattctggacatttcatgtaataggaatcatacaatatgtggccttttgtttctgacttctataacttacataatgttttcagggtccatccatgttgtagcatatatagtacctcatttttttttatgcctaagtaagagttcattgtatgaatagaccacattttgtttatccatttaccagttgaccatttgagctgtttctactttttttttcgctattgtgaatagtgctgctgtgaacgtttgtgaacaagtttttgcgtgaacagactggttctcttggtatatacatagagatggaattgttgggtcatacggtaattctgtgtttaacttttggaggaactgccagattgtttccacaagggctgcaccattttacattcctgtcaacaatatgtgaagattcccatttctccatatccttgctaacacttgtgattttctgtttttaaaattttagccatccaagtgactaagtggttatagtaggttttggttttggttttgagacagagtcttacttttgtgttgcccaggctgcagtgcagtagtgcaaacatggctcactgcagcctcacctcctgggctcaagtgattcccacctcagccccccagatagctgggactacaggtgtgcaccaccacacccagctattttttgtatttttttgtagagatggggttttttactgtgttgcccaggcatgtcttgaactactggcttcaagtgatctgcccacctcagcctttcaaagtgctgggattataggtgtcagctgccgcacctggctgtttttttttttttttttttaacaatgttttaaaataaattgtggtgagatacacataacattagccatttaaaagtgaatgattcagtggcattttgtacattcacagtgttctgcaccatgatctctatctggttccaacacatttttttcgttcccaaaaggaaaccccatacccataagcagtgagtccccattatgcctcctttcaaccactggtaactaccagtctgctttctgtcttgtggatttccctattctgtatgtttcatgtagatgaaatcgtagtgtgtgccctttgcttctgacttactcacttagcatgttttcagggttcatccatgttgtagcatgaatcagaacttgattcctttttaaggctgaatggtattcactgtctggatagattacattttgtttattcatgtattgatggacattttggtggtttctacctttttggttgttgtgaagagtactgctgtgaacatgtgtatacatgtgtttctttgagtaccttttttcagttattttgagcatgtacctaagagtggaattgctgggtcatatggtaaaatgttttaactttttgaggaactgccagcctcttttccttagtggctgaaccattttgcgtttccacagcagtatatgagggtttcagtttttccacatcctaacacttgttattttccttttttaaaaaaattataggccaggcgcagtggctcacacctgtaatcccagcactttgggaggccgaggcaggcagatcacctgagctcaggagtttgagaccaccctgggcaacatggtgaaaccccatctctactaaaatacaaaaaattagccaggcgtggtggcaccagcctgtagtcccagctactagggagcctgaggcacgagaatcacttgagcctgagggatggaggttgcagtgagccaagatcatgccaccgcactccagcttgggctacagaatgagactttatctaaaaaaaaaaaaaaaggccaggtacgttggctcatgcctgtaattccaacattttgggaggccagggtgggaggatcacttgagcccaggagtttgagaacaacctgggcaatataatgacaccccgtctctacagacaataaaataactagctgggcatggttgtgtatgcctgtattcccaggtattcgggaggctgagttgggaggattgcctgagcccaggagttcaaggctgcagcaagtcacgttcacaccactgcactccatccagcctgggcaacagagtaaaaccctgtctcacaaaaaaaaaaaaaaaaaaaaaaaattacagccatcccagtgggtgtgaagtgggaactcactgtggttttgatttgtattttcttttttaagtgaaagcaagtttattaagaaagcaaaggaataaagaatggctattccataggcagagcccattgccactcagctgcttatacttattgttacttcttgattgtatgctaaacaaggggtggattattcatgagttttatgggaaaggggtgggcagtatctggaactgagggtttctcccctttgtagaccatacagggcaacttcctgacgttgccatggtatctggaaactgtcatggtgctggtggaagtgtcttttagcatgctgatgcattataattagagtataatgaatagtaaggacaaccagaggtcactttcatcgccatcttggttttggtcagcttctttactgcagcctgtttcatcattaaggtctttattacctgtatcttgtgccgacctcctgtctcatcctgtgacttagaatgcctaacctcctgggaatgtagcccagtgggtctcagccttattttactcaccccctattcaagatggagtttctctggttcagacacccctgacatgtttcccccctcccttttacagcagaacccttaatcctaacagtcgtagagggacaaagatccatcttctgtaacttcttcaggctgaatggggcgatgatattcctgcctaactatgagggtctcttgtattcagggtagagaagagctcagtcagaaagcatcaatatggtgagggccattcatagctctgagttccaacaaaaggtggtatctggaagattaataagtgttcagtttaagaaaacattcagtaaacttatcctgcattcctacacaaagagtacaacagcaatatattccacaacagtaaagtagaataactaaaattatcctgagtaaactaaacaagaaggctttccatgaactgggcagttgttgaaaccaaactgatacatcgggttgctagccgactccagtatgtgcccagaattagaatattgatccagatttttacattacccatctctcttgtttcttgtgagcagcagccagagatcactgattggttcacaggagtaagcagggttagcctaagttgcagaaaaaaaacttaaaaacaactgatgagactagaatctagtaacaggtgtaccaagttcctgaaacataatttattttctctctccggtctcccatttttactgaagacaaatcatggtacaactgatttgctttattatacttggcctgattatttgtataaagtgcagcaagaacagttatttttcacataggtttttaaaattggctttgatgaaacttcattccataaaaggaagcttagataagactttttgttaaagccaagcccagccatgggtttgtaccctcaaataacctgtgagttgggaaattcctctcctcttgaggtcccaagatggcgtggggttcctgggcctgtcggaaagtgacattctttactaaccacaggtcaggaaccctgcacaggaactgtgtagacaaggtatgaggccagttttcccaaggaacttttattggctccataagtcaagtttgagtccttaaaggaaagcacaccattcccatcaaagtcctggtaaaacaactagtttctctaattgtgtcctgttgcaaaagaaaacagattcttattgcacttgtgcaaataactatattgccataagttaatactcacaaatagtttccaaattccagagaaagcaggtagagaaaaacaaatatgctccaaattttgttcacaggagtatactttactcaattgtcaaaagctgtaagtagctcaaaagttttcttggctctgaaaaacaaaaatgatcagcaacgttttaagcaaaaagtcagaaaagattacttgagtcttttgttcagtccatgcagttaactcctgttctacttgatattcataatcatttcagctctccatgagagtcctgaaagaacctctgttcttcttttttttttttttcttgagacagtctcactctgtcgcccaggctggcatgcaatggcgtgatcttggctcactgcaacctctgcctcctaggtttaagcgattctcctgcctcagcctcctgagtagctgggcttacaggtacgcaccaccacgcccagctaatttttgtatttcttagtagagacggggtttcaccacattggtcatgctggtctcgaactcccaacctcaggtgatccacccacctcggcctcccaaagtgctgggattacaggcgttagccactgcacccggcctaagaacctctattctaatgtcacaatctccaaagttattagaaacctgcatccaagagcacctgttgaagtcctataatagctgactataaaccaccttttgaagaggatcaacacagcagttgtctgtggttgacagaaagtcttaaggcagccactattaaaggcacaattgactaggaattttgattacttttgtggcatacgattttacataataattgtaattattagtaacatatgctaagtcatatcacaattctaggagtttcccattactttggaacacataccaataacatatttatataaatacaggtcaaagaaagccaaacaccatttcatatttgacagtgcttcctgtatgatttttataccaaataagccaaatttcaccattgcattagtgtactattaatgttaaacccaattcttaataaaacattatagacaaatctacccaattttaatgtcagaccagaaggtaagattcttataaaccttttataaccctttacaaatttttgttaaagagcagatcagtgctctaagaaaaccttgttacgcttttattccagtgttcaatttacggaactgtatcatacccctttaacttcagccagtatgttcacacacagaatttcttttaaaagattaatttttcacaaaatttccacaacttttgcaaaccttcagctttatcctaacttaaaacaatcccttaaccctttaatttaggccaaaaaaaaaaaaaatccacattcacatgtctccttctcttttaccaaaaacacatttcactttccctacacaccttgcatgtaaaactgtttttccagtagtctcaagtagatgttacactgttaactcttagcagtgtttatttttagtgaaaaacttggtaagcaattttaattatgtactaggtatggagcctaggacaccaggcagaagtgcagataaggtctgacacttactagcatagctaggaggcatggctaactccacatgtccctaggccttacctagaatctaatggctgtaggtaagtttaacaattttcaaaagtcaaagaggcagtttataaagttaaagcgtttagcaaacctaaaatttgacctgcctgatttagaccgaatgtctttattttaccaataatctttaaaattttctttacttcccacagcttaagtcacacgaattaaaaggcattacgctttttatttttctgacaaaatatttgatttaaacacttatttttaagccaattaatcaaagccttttatatcacacacacaacacatataaatacacagacagaagaaaatgtagtagttgtaaggtttttcctttgccagtttcttaattggattagtggctttatggtggagccctggaggaacagggcaaggaaagcatgcagtttctatggcctaataagcaggcacaattggaaggcaagacagagccccaaaacttgagggtcccatttttatattgatcctggatcccccaaagagaaacgctacagaacacaacagtgcaatgattttaccacatatttcattgccaggcaacccagagccaatcagccctttctgagatcagcccatcccccatgggagtcttatctctcagtggggaagggtgaggacatctccataccttccaggtggccaagagcatgctcttaatccagacacacaaagatccaagtatcccccacagtgccatttagccatccccaaaagtattaaatgtatttcctacctagttatattacacaccaaagttctctcataatgtgaagtaatttctgatacccccaaagtaaaaaacagataatgcagtgcaaaacagaacagagccatagattttgagagggatctatccacttttaataattctcggggttccatgaggaaaatagaggtttttcccaaaacagggtatgtggtgcctcctctgtttttcctaagaagtcccaggctgttagagcttgaatatcgacttttaattaagctgacttttaaccatagcactctttaaaaagtcgttttaaatatcttattacccaactttagccacgccaaactgccaatattcctggctttttaacttttccaaatgtaacctcccaggtgctgagagaaaggaaaatttaagacagtttatgaaagggaggagaatcaacaaatggcacaggtcacccaaatgccaaccagaaagtgctcattttctaggctaaaaattgaacctgaactcaggccaccattgtgaaaagacaaagccttaactgctaagctacagcattgggcagtttccactgcttttcccagaaggagcccagagcagtaaattttgagcttgcaaaggcttttaactgctcaagataatttgtagagctaactactaccccaaaatccctgttgcctggaaggcagagacaaagagaaagtactgccatatgattacaaggtcaagctctcagggacatttctcaacatgtggtctttgggcaagatggtggccctgaataacagaaaagataggaaagggaaaggaaagaaagggagaaaagcattgcctgcagcaggctggggaatgcaagaagctcagggaggccagagaaagacccgcccattgcagctgacactgaatcagaagttcaggtggctgctttttgggagcgtagggatctttcccagcattcccatcagctctagtttccccttttggggaggaaaaagctccccatgtcccataatcttggacatgtctagttctgtcacccacagccatcagcaaagagtgcaaggcagattaatccaaagagaatagcagttaacatcccatagtgccaaactggttcttagtcgagagggactctactgagaggggcctccaaccccctaaattttaggaaggactctaaccttcctaagttgggcatcaaacccaagttcagtcaagcgtgcttgccttttattaacaggcacctttatccctctcttaggagagactctaactctcctaagttgggcctctaacccaatcccatcctttacccaggtaactgcatcccacttacccaaggtcggccaatcagtgctgcagtctatttcctttgggttgggagtctcctcagtatcatccctttggggcttgccaggaagatgttaccggaaaggggtcccaatccagaccccaagagagggttattgaatctcatgcaagaaagaattcagggtgagtctataaagtgaaagcaagtttattatagaagtaaataaaaaagtggctactcaataggcagagcagccgatttgtattttcttaatgatattgatattggacatctttttatgcgcttgttgaatatttcagtatcttccttggagaaacgtttatacagatcctttgctcattttaaaattgggttgtctttttgtggttgagttataagagtgctttatatatatcctggatgctaaacccttattagatatgtgatttgcaagtatttcctcccattctgttaattgtcttttcactttattgataatctcatttggtgctcaaaagtttttcattttgatgaatgaagttcagtttatctagttttttattttgttgcttatacttttgttgttgtatctaagaatccattgccaaattcagggtcattaaagatttacctcctgtgttttcttctaagagctttctaatatattttttggggatctcattcatttttgaaagatagttttactggatatagaattcttggttgaaaaatagccagacatgatggcactggcctgtagtcccagctcccagagagactgaggcaggaggattgcttgatcccaggagttggagactgccgtgagctatgattgcaccacactgcactccagcctgggtgacagagtaagatcccttctccaaaaaaaaaaaaaaaaaaaattattggttgacagatttttttctttcagccctttaatttgtcacctttcggcctccatggctttagatgagaaatcagttgttaatcttactgagaaatccttgtacttgaagagtcacttctctcttgctgctttctacagtttggctacagtgtgtctgggtgtggctctttgaatttatcctacttggagtttgtcgagcttcctggttatgcagattaatgtttctcattaaatacaggacttttctaccattatttcttcaaacttttttttgtctttttttctctctgtctttctaagaccctataatatgtatgttggtacaattgatggtgtcccacaagtctctgaggctgtttattttcttcattattttttcttctgttccttacactttataatctcaattatcctatctttaagttctctgattcttactgctgtttatttctgctgttgagcccctgcagtgaatttttcatttcagtttttgtgcttttcaactccagaatttttgtttggttctttttttaaactatttttttctttatcaatattttctattcagtgagacattgttctgatggatcttgtagatttttgaacatggttttctttagttctttgaacatatttaaaatagcatatttaaagtcttcatccatacgtctaatgcctgggcttcctcttaaacaatttctgttagttgccttttttctgcatgtgaaccatactttcttgtttctttgcatgccttgtgatattttgttgaaaactggaacttttgaatttttaccgtggcaactctggaaatgagattcttccttctcccccagggtttattgactgcttgttacagtcattgtttgtatagttacttttctgagctaattttatatagtatatattctttatcatgtgtggcctctgagttctctgttccattaatatagtggtcagcttgtgattagacagagatttaagcgcctagaacaaaaaatgtctcccagtcttttgagatgaggtctgtgtgtatgttggagcacaccttcaacactcagccaggcatttgacggtgatccctgagcattcgctgcctgcttgcacagatcctgaaggtcagccagaggtgaaagcctagggccttttcaggtctttcctgaacatgtacacagccctgggcatttgtggagccttctggatttccaagaatgtgtcagagcttttcaaacctttattttccaaaacatcttactcctcagcttttcttcccaagcttttggttaaatctattgtttgcctcaactgttattcagtgcttcaggcagcagcaaatatgtttgtctgtaaatgtttccaataaccttttcccatctttccctagtagatgcctcagcactgggaggtaaagtcaagccctttgagccagtcttccagggactcagtagacaggtcgaaacaaacaactgcagttctttgccgatgaggcccattctgctccctctgggaccagtgcatgcaccggagtggcagcctcttgtcttctaggccactgcggcagccaggatgggaccagagaaagttaaaatgccatggaactcgcggttcttgctgagattcacctggtttttcttgattaagcattcttctgattgctgcaagtttttaattagttttccaaagttttaaaatagtagattctaacggtttttgcctttttcttttttttttttttttttggagacggattcttgcgctctcacccgggctggagtgcagtggcgccatcacggctcactgcaagctccgcctcccaggttcacgccattctcctgcctcagcctctctagtagctgggactacaggcacccgccaccacgcccggctaattttttgtatttttagtagagatggggtttcaccgtgttagccgggatggtctcgatctcctgacctcgtgatctgcccacctcggcctcccaaagtgctgggattacaggtgtgagccaccgcgcccggcctagtttttgccagtttttaaaatgtgtatattgaaggatggactttgagttccttactcagccatttttgtggacatgatttactagtcataatttaaattgaatattttaggacatattaaattatgatcagtttcgaggttgccaaatttacgtacaccttacttggttacacaagagatttaagatggcttacaaggataaatagcataagagatgcaataaattatcattgtcagtatttgttgggttgagggcatgttagtaaaaactgccctccctgctgttaagaacttgatcctacagacagaaatgtttccttggcagccttgagattcttgccctctctctgttacgtcagtggtggggaacctggggcagattcgcctccgtggcttctcctgcatgactgcgttgggctgagggagatatgccaggttagtgcccagcagtagggatggttgttactgtctgcctctgagttgattgtgagaaatgtgtctccagtgttggttttcctaaatctaaaactctcctttgctcaggacaggacaggtaagtgtttatatcctatttgaggacttaagacatcatgtctattgtcctatttgcttcaggaggtgatcaggggattcttacacttcagatcagaagtgactgctcttggtggctgttgatcactgggagagtcaagagtcatcagtaaacctgagacttgtccatcccctggttctggtgcctgttgaggtgtctgtctcctgctttcccaggagccagttcagtcctgtggccacctcattgatatagaaggtcacggggctgccggctgggctctgctcagggttcgtgtcatttctttcttcagcttttgtttagaaagcatattttccttgagcaatgtctgtcaatttgacatagtggctcatttactagtcttacttgagaacacctccttttgacattgcttctgtgatagaattagagctgctttctgtttttatatattggattgtccctttttcatcagcatcactcataagttaatctgaattttttttttttttttttttgagatggagtctcattctgtcaccgaggctggagtgcagtggcacgatctcgggtcactgaaacctctgcctcccaggttcaagcaattctcctgcctcagcctcccaagtagctgggactacaggcatgtgccaccatgcccaactaatttttgtattttagtagagacggggtttcaccatgttggccagggctggtcttgaactcctgacctcaagtgatttagccgcctcagcctcccaaagtgctgggattacaggcgtgagccactgtgactggcctaataaaattaagatttctcttcattaaaagacactataaataaagtcaagccatagtgctggctttggcagcacatatactaaaattggaatgatacagagaagattagcatggcccctgcacaaggatgacatgcaaattcatgaagcagttccgtatttttaaaacacatgcacacatatgtttattgcagcactatttacaatagcaaagacttggaaccaacccaaatgcccatcagtgatagactggataaagaaaatgtggcacatatacaccgtggaatactatgcagccataaaaaagaatgagttcatgacctttgcagggacatggatgaagctggaaaccatcattctcagcaaactaacagaggaatagaaaaccaaacaccacatgttctcactcgtaagtgggagttgaacagtgagaacacatggacacagggaggggaacatcacacactggggcctgtcggagggtggggatagcattaggagaaatacctaatgtagatgacgggttgatgggtgcagcaaaccacaacggcacgtgtatacccatataacaagtctgcatgtactgcacatgtatcctagaacttaaagtataataatttaaaaaaaagtcaagctataaatagggaaaagacatctgtaatacataaaactaacaaaggattagctgttaacatattaaatagatggggaatctccccaaatcaatattacgagacaggaacccaattaaaaaaatgacaccaccaggcgcagtggttcatgcctgtaatcccagcactttgggaggctgatgtggaaggatcatttgaggccaggagtttgagagcagactggggaacatagcgagacccccagctcctgaaaaaataaaaaaattagctgggcatggtggcatgtgcctataatcctagctactctggaggctgaggtgggaggattgcttgagcccagggggtcgaggctgcagtgagccatgatggcaccactatactccagcctgggcaacagaacgagactccatctcttgaaaacacacacacacacacacacacacacacacacacacacacacaaaacaatgacaagaaggcacaatttggcatttcacggaagagaaaacaagtggcctctcagcatatgaaaagatgccaaacctttctaatcaggataaggggcataaagaccatagtccttggttggtagaaattaagatgactgataactgtaagtgttggtgagagtgtggtttcatagaaattcttgtgctgctagtggaagtatttgttgttacctctgctttggagagcagtttggcactcatttacaaaactggcctttcgtacaacctacacaccagcgactcctctctgctctttagatgtagagtccagagcaaggactggtaaactctttctgttacgggcaagagagtaaatatcctaggctttgtggactacatacacacttagtctttgtttttataacacttaaaaaatctaaaaagcattcttagttcaaagaccttacaaaaataggctgctggctggatttgatttgcaggctgtagtttgccaattcctggttctctgatctaggggacgcatcctggagaaacttagttacatgcagtcttagtggcaggagggccaggggaaaagcacagagcggtatgggggagttgagagagactgggagggtggcctcctggagaaggtcgggggctggactgcatgtgtctgggtaggctcagccatggcctggctgggtgggcctaggggaacgtagagcttctgaggcacaataggccagtgtggagagcagagtggcaggcagggctgggggctgcaggtcgaggctggtcaacccttttacctggcgggcaaggctagtaccaggtgcccttgctacttagcttggaaagattagtgagcatcataatggaccggcaagtttgtaagcaaatgacatctataatacatatactttaacattaatgttttgaaaactttgttttcacaaataagtaatttcccacattttgccacagttatgttctatgaagctaacccaagtgtggctagaacgccagttcatccatctctcaaattgtctgctgccggcgttcattcctgtttgcttctagctgtaaagtcaggctaggagtctgtcagctcatgtgcctgtcagcttcatgcaggcagcaagaacggggctcggaagcaagggctccgcccgcccacccagcaactacctccccaggatgcccaggagctcaggggtggaaggaatttggctcttatttttctaagtagcaaaaatagatgaattgggtacaggaacgcagtgtatttttgagggagctggtgagttgtgaaagaaacttcctctgttcacctgaggcttaccgtatcgtgagaaaggatggaggaggcatggaggtgggaaactctacacaagaaaaatcctatagtgcagcagctactgatgtgaggcggctggtctaggcagcggtgttccctgaggctcctgagtctggttctcactgggtccctcacctcccttcacagccactcccttccttaccaaggtacatgggagtacagggctggccaggggctgttgacagtgggggagtggtgcaggctgagccttagagacaggaagggcatctgtgctggagctgccctgcagaagcctcgtaaaggtcgtaaggcactgggcaaaaacttttccaagaaagttcatggtgcacacgctgacctaaacactggccgacattcccaaggtttttttcattatggaagtgcatggccattgcatggtatccagaaaacaaagaccagagaagccagactttataccaccatctggaaacatttaatttgtgctttaggtaagtgttagcaaatatttaggatgattgatcaaatcattagtgtgtttatgagtgcatggtgtaatttttactaaagctcacatttcttcaggaactcgattcaactcctttacattcctggttattttcatttacttgatcttgaggtctcatctggcagagctgtgcaagctgggacctttgtggcttattttgaggagctgtttactttacctgttgatgggaacttgcaggtgggaggcagccagtcttaaagagtaccttgttagcaagtgtggaagagagtccgcgcagacagacttgccctatgtggtgtcccctctgccagcccagcccttgggcacattggcacctacctgaacccgagccccctcatgcacacagggagccgcacctccctcacacgctcctcaccagtgtgacatggtgtgacgtgctctgtgggtccacaacgggcccactccacagctctgtgcacagcatgctgggtcagggtggtgctagattaataagatgagggtgaatgtcaaaactgagcactttgagtactgtgggcacactgtcacagggtttacccaggaaggaacaacccctgggctccagaagcaggttgaccaggccagtctgagttgtagcattgagactcatctagcggaagtcaatgaggaaggaaaactggctgagaacagctgttgtttcagttaaaatctcagaatgatgcattgaattcaaagttacaacacagcaaaatagtatatgtatttttttaaacctcaaaaatactgtattattaactttaaaacatttttggctggtgtggtggctcacacctgtaatcccagcactttgggaggctgaggcaggcagatcacgaggtcaggagattgagatcatcccggctaatgtggtaaaaccccgtctctactaaaaatacaaaaaattagccaggtgtggtggtggccgcctgtagtctcagctactcgggaggctgaggcaggagaatggcatgaacctgggaggcggagcttgcagtgagccaagatggcgccactgcactccagcctgggcaacagagcgagactccgtctaaaaaaaaaaaaaaaaaatttttggagacagggcctcgctctgttgctcagcctagagtgcagtggtgccatcatagcttggtgcaaccttcaactcctgggctcagcaatctttccacctcatcccaatttattaagtatactttttaggaagttttttgaataataatatcaatagttactatgtgtttgggtaaaatagaaaggatggaagcatatttgatcatgttttgttcccaacacatattaaagttgggaaggattcttgtgttgcctaaaactgaaagacagcaggtctcaggcacttttgctttcccaaagctgtgtttgtttccttgcatgagaggatatgatggcactctactgttttttcccgacagaactcctctttcctaaaatggagtcgagtaaaaagatggactctcctggcgcgctgcagactaacccgccgctaaagctgcacactgaccgcagtgctgggacgccagtttttgtccctgaacaaggaggttacaaggaaaagtttgtgaagaccgtggaggacaagtacaagtgtgagaagtgccacctggtgctgtgcagcccgaagcagaccgagtgtgggcaccgcttctgcgagagctgcatggcggccctgctgaggtaggcgccctcgcccggcccgtcgcccggccccttctcagccctcggcctcaccctctccttcattcgtttctctaaaaataaacctctagaggtttaaagccctaaagaagtccataaaagcctccgggcccagcttgtgaatcctttagggaggtgcagtgggatcccacgtgtgggtttactgaggcctctgcgtgtctctgacctgccccgcccgtgtcttcccactccgtctgtagagccttggtgcccctcatatgtgttgctgtattttattgaggaacctcacagttccatggaggagatacaccaggaaatgacaagccagtcatttaagggcacgtgtgctggtgtgcaaggatgccgcagagaggagggaggatggggtcagcttaaaggactggacaggtccctacccgagcagaaacctaggccgcatgcttactcagcaggcgtgtgtggaacatgcaccgagcccatggcagccctttgctgctgagtgccagtgctggtaccgctggtggatcatgaaggcaggctggagctttactgcagaatagcatcggccagaagagcaccttgattcaccctgcaggcctcatgttttctggcattgtgctgggtgctggggtcgctgcgggatgccctggtcttggccactgccgtcagggcatgtcggcctgggaaggttgccagctcctcctcccacagcactcaagcctgggctgcacccgagccccagcctgggcacagcagccagccccctgccctgtcacctgccttcaccctcccccttctccatgcttccctctgtggtcttacccactcatcccaaatagtcagctaacctttgcccacttgggggcaaaatgacacttgagcttagtgacagcacaggagacacagaacaccgtgtctcctaacacaagagcctggactacacctctgggcccaggagaagcttcccggtggaggaggggctggagcccccatatatggtgggccacaggggagggaggctggtccccctgtgcaggtgccattggccttccaatagacagtgaagccaaatggcctgtggagaagggctggctgcttttacaacgcaggagcaaggctctccaagtaaacaggtactcacactgaagagctgctctgcagacagctagctttggtttctgaaataaaatttcacttttacattaagtggaaggggctttccaagtgggactgaactaaactgttctacttggtaacttccttttgaaaaatcagcattttaaaaaatgtagcccttttctcccatggcttcctatgtaaagtgaatcaccagggcgtcctgaagctctgctggttgctgtgagccactgtgcagacctgaccataaagtgaatgctcccagaatctcctgagtcctctcaagaaagggacttccactctaatgcagtcacttgtgtttccctgcagctcttcaagtccaaaatgtacagcgtgtcaagagagcatcgttaaagataaggtattctggggttttttttaatcattttgtcacatgttttcagctgggtaatacttttcacatagtttgcattcggcactctggcacaacacattctctcagttttggcagctgatgcggcaggctcccaggcaggacactgtgccatgtgatcacctgggcagacagtggattcagatccacttggccacttccctactgtgtgaactctgtgagctacttcaccccctcacctgtaataatcatatcacctgctaagaccgcagggagctggtgtgaggagtaaggggttgatgtgagcaaagtgctgagatgcctgtctgtggcagggctgtctgtggttgggtcacttccgtcattgcaggtctttatcccagacagcttctactcaactcttacactaggttttaccttcagactcgctaggctgaggggttcatttgagtttgtgctccctgccccccaggccccctgtgatatctttaagtcattagacatgagtgagattagccccttctcgccccctgtggctgtcctcagctagagcccgtgggcgtctctgcacattcagaggatggggctgcccagcctgccaccagcttctctcctggggcctggtccttctcatggagactgacagtcatccatgtgctgctgtaccctgccaggtatacttggagtttgaaacaattcttttcttttctttctctctcctttctttcttctttttcttttttttttgcgacagagttcactcttgttgcacaggctggagcacaatggcacgatcttggctcgctgcagcctccacctcccaggttcaagcaattctcatgccgcagcctcccgagtagctgggattacaggcacgagccaccacgcccagctaatttttgtatttttagtagagacggggtttcaccgtgttggttaggccagtctcgaactcctgacctcaggtgatccacctgcctcggcctcccaaagtgctgggattacaggcatgagccaccgcacccagcaattcattcttaaagtgcttaaaatatcaataaaaatgtgtgtttccctactttgagtaatatacctaaccattttttaaatgcaggtcactaagttgtacaataaaattcttactctggggttttcctgtctaaagcaccttgcagattgggtttgttggtcagagcagcccaggtgagtgcagtgatttgaggattgctggtagtcagtgtccctgggctgccaggcacacaggcatccagtatagccgctctggaagggggagagatggaattggccacctggccctgtaccttttctttctctgcatttacctgctgctgctgcaggcttggttagttccttgagtgaaaacagcccctcccctccactctgtgccttggcctagcatggtactcggccgccttgttaacatgtgcctaacgtgtgagtgagagagaagctcgcgacgatggctgagatgtttttttagtatctctgttttgttatgcagaatcattatccctattttttaatgacataagtagctgaagaaaaatggctagttttatcaaagaatcatgaacgagatgcactcaagttgtggaccctcatggagagaatggagctgtctgggccccgggtgacccggatcctcacccgtcagcaggtcatccaggggtgggcgggcctctggtcttcatctgtaaacagagacattttgagtaaatagtctcagatcctttccattccaaagttctgttgactttagtatctcaagtcatgaccttcttttttttttagtcatgtttatgaaagataagctttggctccaaattagtttatttttaactcttaacagctgttgattttatttctctcagcagtccaaaaaggcacattaagctcctgttattccactttcatagagcaacaggcaggagtttcttagaaataacctttggactaagatgttgtagatcgtgttgttagaaagagtgagagggagctgggcatggtgccttatgcctgggatcccaggactttgggaggctgaggcaggtggatcacttgggctcaggagttcgagaccagagtgggcagcatatggagaccccatctctacaaaaatgaaaattaaaaagttacctgggcttggaggcatgcgcctgtagttcaagccactcaggaggctgaggtgagaggatcgcttgagcccaggagtttaagggtgtagtgaagccatgattgcaccagtgcgctccagcctgggtgacagagtgaaacccaccctgtctctttttgagacagagtctcactctcttgcccaggctggagtacaatggcgtgatctcagctcactgcaacctcctcctcccgggttcaagcgattcccctgcctcagcctcccgagtagctgggactacaggcatgtgccaccacacccggttaatttttttgtatttctagtagagatggggtttcaccgtgttggccaggctggtctcaaactcctgacctcaggtgatccacccacctcggcctcccaaagtgctgggattacagaggtgagtcactgttcccagtcaaccctgtctcttaaaaaaagagtgagaatgagaatacttgtgttttctaagggaaaaataaaattaaaagttgaaaggttttttcttcttcttttttttttttttaaagaaatgggggtctcccactgtcgcccagtctggagtgcagcagtgcgatcatggctcactgcatcctctacctgccaggctaaagcagtcctcttgcctcagcctcctgagtagctgagactgcaggcgcatatgctgccttgcccagctaattttttaaaaaaatttttgtagagatagggtctcattgtgttgcctaggctggtctcaaactcctggactcaagcaatcctcctgcctcggtttcccaaagtgctgggattttaggcttcagctaccacgcccagcctcgttttcattttcaaagggaaatcttttcattattagactaacttcagactgcaatatatgtttaaagagagtgtttttcaaccacaggctaatgctgctttttttggtgaaaaatgagttttaacagcatgacctttagaaggaaccaacagttttacaaatcattccccaaatatggtctcttatgtggtctctccatttctccagcaagcgatctatacaatgtattcagttgtgtccagttctgctcttgtcctctggtgacagctgcaccataatggccacctgctccgtgctggctcccggaaggccccagagtctgaatgtgaacctggtcctcctctgccctcatcctgaaattatgtcaaagttaatagaagatgtttagatgctccagagtgatcgttaattatcaagtctaattcattttcttttggcttaactaataaaagataacagttaatgttatttaaattgtgtctcttagtgggggcagcttcttcattctacttctagaaatcaagatggtccttaatgctttctgaagttcacttaagagttcctctcttgttttttttttttaagtggttttgccttgtccaaagtagcagcatgtggagattaagaaatattaatcctccaaaataatgatctttcattttcaggtgtttaaggataattgctgcaagagagaaattctggctcttcagatctattgtcggaatgaaagcagaggttgtgcagagcagttaatgctgggacatctgctggtgagtagcaaagggacactggaaccttttacatgaaggaattcgagtcccttacatccagctgatgaagtggtcagtaggatgtggcactttaagaccatgttgacattagtttttcaaaacacagccaaataggaaagcagtcagaaccacttgagtataagttgttatttttatgacatcattggcagaattgtcaactggtttttaaacactcccccccctacttagaatagagaaaatctgaattggattttaattttggaaggcccattaaaaccttttttcaccatgaaattctacataacttcttatttttttagttagtaccatattttagcttagaaaattatttgaactggaataaaacaaagttcttagcagatattcatttatcctggaagcagagttgacttaattcttcaacaacaatatggtttgagtaatcatgaaatagaatatgaaattcagtgtctcttggcatacttgttactctttgctgtggaaaactggtctaacagcagatgagaaacatttctttagggtttcattgcatagagattagaatctggtatttcagatttagggtttttttcccaattaagaacattgaatggtctgtcttacaggtgcatttaaaaaatgattgccattttgaagaacttccatgtgtgcgtcctgactgcaaagaaaaggtcttgaggaaagacctgcgagaccacgtggagaaggcgtgtaaataccgggaagccacatgcagccactgcaagagtcaggttccgatgatcgcgctgcaggtgcgggtcctcccattccacaggccttccactcaattcctatatgatacattccacaggccttccgctcaattcgtagataatccgttccacaggccttccctcaactcatagataatccgttccacaggccttccactcagttcatagatattccgttccacaggccttccgctcaattcatagataatccgttccacaggccttccctcaactcatagataatccgttccacaggccttccgctcagctcacagataatccgttccacaagccttccgctcaattcgtagataatccattccacaggccttccgctcagttcatagataatccgttccacaggacttctgctcagttcgtagataatccgttccacaggccttccctcaactcatagataatctgttccacagtccttccgctcaattcatagataatccgttccacaggccttccctcaactcatagataatccattccacaggccttccactcaattcatagataatccgttccacaggccttaggctcaattcatagataatccgttccacagaccttgtgctcgattcatagataatctgttccacaggccttccctcaactcatagataatccgttccacaggccttccgctcatctcgtagataatccgttccacaggccttccgctcagctcatagataatccgttccacaggccctcccccaactcatagataatccattccacaggccttccgctcagctcatagataatccattccacaggccttccgctcagctcatagataatctgttccacaggccttctgctcagtttgtagataatccattccacaggccttccgctcaattcatagataatccgttccacaggccttccgctcagctcatagataatccattccacaggacttctgcttagctcatagataatccattccacaggccttccgctcaactcatagataatccgttccacaggccttccgctcagctcatagataatccattccacaggacttctgctcagctcatagataatccattccacaggccttccgctcagctcataatctgttccacaggccttccgctcagctcatagataatccgttccacaggccttccgctcagctcatagataatctgttccacaggccttctgctcagctcataggtaatcccttccacaggccctccctcaactcatagataatccattccacaggccttccgctcagctcatagataatccattccacaggccttccgctcagctcataggtaatcccttccgcaggccctccctcaactcatagataatccgttccacaggccttccgctgagttcataaataatccattccacaggccttctgctcaattaatatatacttcttccactgtacagcttcttaaagactattctaataggactaaagagaaaagataggaataaatagcactttttatctgactttatttcagaattaagctttgttttgcctattttgatttatgtagttaacattttccattgccttgattgactatcatttagtatgtcaaaaaatgaatagttattcaaaaaaggtaaaatttttatcttgtcctagggaattgcctcaaaatgttgatagattgcctggtcttattacagctctgtgacataaccatcacttacaacaggctaatttgtcctacagcattgaaatgcagctgtttatcttggagagagacagcttctcatacttcggttactttggcacagttttgcattgtgtgtttctgtgggggtgagtgtgtgaatgtgggtgagtgtgtgggggtaagtgtgtgtgggggtgagtgtgaatgtgggtgagtgtgtgggggtgtgtgaatgtgggtgtgtgtgtatgggtgagtgggtgaattaaagaggaaagcagagatgttgggggtggaggacacacttagaaaacaatgcatttgttgaacaaacacctattgggtacctactgtgcgccgggcagtattccaggagctggggactcagtggtgaggctcctctagtgggaaaaaatactaacaaatgtgtaacatcgggtagtgatcagttccatgaataaaaatcaggtggcatcaagggaagagaggtgatcagcactggcttgtctgaggcagccaagggacagtgggggagcatgtggaccctaagctggaactggcagggctgtggggttcaggagctgtgtggaacacaggtcagatgtgagggcagtggggcagccagagggtgaggggaaaggcactgggcagcccagaactgggagggtgagaggggccccggggcaaggcctggtgttgctggggtgggggaaggttgtactggggtgtgcctgagggtggagcggtaggattggccagcaggtggggtatgaggtaaaggtgactcccagtgcttgtggagaacctaggtgtcctgccgagggggtgcccagtgagtggagggtgatgggcttgggggagaatggggagtggagccatgcaggctgcagatgggggtgagtttggtggctcgcaggatcatggggctggagcgagtggagaggaggacagagctcgtgggggcctgggcacaccctcagaggctgcctagaggctggggtgggcttggccatgaagtgactgaagggaggcaccagggcagctcagccagggcgtgggccatcatccagttcctggtagatattgtggaatggtttgttttgtttgagagagagtctcactctgtcatccaggcctggaatgcggtgacacaatctcagctcactgcagcctctttctcccaggttcaagtgatcctcccacctcaggaaccataggtgcatgctaccatgcctggctaatttttgtattttttgtagagacagggtcttgccatgttgcccagtctggtctcaaaactcctgggcttaagccatctgcccacctcagcctcccaaagtggtgggattataggcgtgagccatcgcacccagccgtggagctctaatgaccaaaatttagggagagtttcttttgcttttttctctatgaaatgagttgtagtcctcttaggttggtgcaaaagtaattgcgttttttgccattaaaagtaatggcaaaaacggcaattacttttgcaccaactaaatactttataatctctgaatttgccttgctttctgtaattttcctgtgtccatgtctttcttccattgtgaaatctttttcttgtgtggtacttcagatgtttccagttattaagaactcttgaggctgggtgtggtagctcacacctgtgtgcccagcactttgggaggctgaaacaggaggatcacttgagctttggaattggagaccagcatgggcaacatagcaagactctgcctctacgaaaaataaaaatttagccgggtgtgctgaagcatacctgtagttctagctactagggaggccaaggtaggaagattacttgagccagggagtttgagactggtagtgagccataattgcaccactgcactcagcctgggtgacagagtgagaccctgtctcaaaaaaaagaacttttaagaactgtgccctcccctttggaaaatagcagtagtgtttttttggagtcaagtaattcctccaggctgtgcataatggctcatgcctataatcccagaactctggaaggccaaagcaggaggattgcttgaggccaggagttcaaaaccagcctgggcaacaaagtgagaccccatctctagaacgaaaataataatttctccagttgttaaatttcagtgaatgagacacatgcctaattaacaagacttcaggctttacatatgttaatatgttgccatctcatgccagtcagaatggcgattattaaaaagtcaaaaaacaacagatgctggcaaggttgcagagaaaaaggaatgcttttacactgttggtgggagtgtaaattagttcaaccattgtggaagacagtgtgacgattcctcaaagatctagaggcagaaataacatttgaccaagcagtcctattactgggtatatacccaaaggaatataaatcattctattataaggatacatgcacatgtatgttcattgaagcagtattgacaatagcaaagacatggaatcaacctaaatgcccatcagtgatagactggataaagaaaatgtggtacatctataccatggaatactgtgtatccataaaaaggaaggagattggctgggcgccgtggcttacgcctataatcgcagcactttgggaggccgaggtgggcagatcacctgaggttggaagttcgagaccagcctgacgaaaatggagaaaccccatctctattaaaaaaacaaaatgagccgggtgtggtggcaggtgcctgtaatcgcaggtgcctgtaatcccagctacctgggaggctgaggcaggagaatcgcttgaactcaggaggcgtaggttgcagtgacccaagatcatgcactccagcctggtcaacaagagcgaaactccgtctcaaaaaaaaagatctgccggtcacggtgactcacacctctaatcccagcacttttgggaggccaaagcgggtggatcacctgaggtcaggagttcaagaccagcctggccaacatggtaaaaccccatctctacttaaaatacaaaaattagctgggcatggtaacacatgcctgtaatcccagctactcgggagactgagacaggagaatcacttggacccgggaagtggaggttgcagtgagccaagattgtgccactgcacttcagcctgggcgacagagcaagactccgtctcaacaacaaaaacaaaaaaaaaaaaaaagaaaaaaaggaaggagatcatctactttgcagggacgtggatggagctggaagtcattgtccttagcaaactaacacaggaacagaaaaacaccacatgttctcacttataagagagagctgaacaatgagaacacatagacacatttaggggatcaacacacgcaggggcctgtggggttaggagagggagagcatcaggaagaatagctaatggatgcggggcttaataatacctaggtggtgggttgatctgtgcagcaaaccaccatggcacacatttacctgtgtaacaaacccacgcatcttgcacatgtaccctggaacttaaaataaataaatatatagctatcaaagttatattttgcttcttgccaaaatcagttacctttatttgcagaatagaatccaacaactgatttttgtttaagaaggaatcgtagcgtatgtctgttaaacaccatataagtaactgactctgaacaccagatgaggctgtaacaggtcaggtttaagcacaagcatatagattcacgaaatggcgtcagaccctgccctggttgcttaggatgcacaggagaataaattgcactctctccttcagtttgcagtctgatgagagagacagccagatgtacagtttaattcatgttagtatgggaagtactgggactgtaatattaataacatgccaacaaggaaggaccagttacaatagcttagccggagtgtcaaggaaggctttagtgaggaggttgcctttcatttgatctgggccttgaatttgtcaactaaagacaagggagaaagagaatagatggaaagcacagaatgataatgagtttggggcctgatttgtgcaaacattccttataaattgcacttcatgcttgagatgaaacaagttgaaaaccgtttgagcagtgttgacagtagagtgcattttaaggtgtgtgtcagcttctctcagggcctgcagacatttcagcaagcacgcgtgtttggggtcctgccagtgcatctgcccctgcctctcagcctgaccaggggagagcagttgctggttggctgcctttgctccaggcctggttctgtgacttgcccttgccctaggccacctctcttttcagtgatgtgatttaattcccatgtattttgttttttttttttttcaatttgaacacccttattctcatcccctgaggccttcgttgagtttatttctaggaagaacagtcctgatgtagggagacctaaagcccaggtcattctaattctcctacactccctgtgttctgtggtgtgtcacaacatcaagtgttgataaaatgtgctgaggatgcatggaaaccctggaccattgcagttcatataaggatttcttttctacgtttaaactgtggtgtagacagtatgccagctattttcaggttttattattactttttaaatttataggttagcataatttaaagtgtcaggaaacaaaccttttagatttaatctagaaattctggaccatcattctttaaacagctctgttaacttgtgaaggtcaggatgataaagatctcaccctatgggaaagcatacgtggtacaagtctgtaggtatgaccgctttggaaatcaactgtcagtatcctactaggttggacattcaggcactcagttaaccagcagttcttctcctggatgtgtaggagaaacacacacgccaggaaatgtggccaggtgtgaccagagccgcagaaatctggaaacagccggagcacccatcagcaggtggaaattatattacagtgttgttatacgacaaggagatgtgtcatacagtagtgaaagttagaggcctgcagttatttgcaataggcagatgagtctaagaagtgtaatactgagcgaagtccagaagactcctatggtagaattctgtattaacaaaattcaaaaacaatcagaatgaaacagtgtttcatttggcacacatatgtatagtgaaacctttttagaggcagaattacaaaactcagggttgtggttttaatgggtactccttgtgggagaatgagggtgagatgggagaggtaggtgcagaagatggatgttatcagtcatgctcttggacctgggtgttggcttcatgggtgttcactatgtagttatgctttttttttctttctttcttttttttcgaggcagtgtctcactctgccgcccaggctggagtgcaatggcacgatcttggctcactgtaaccttcgcctcccaggttcaagcaattttcctgcctcagcctcacgagtagctgggattacgggtgcccgccaccgcacctggctgatttttatattttcagtagcgacggggtttcaccatgttggccaggctggtttcaaactcctgcccccaggtaatccgcctgtctcggcctcccaaagtgctgggcttccgcacccggcctgtgcttttcaactcacacatgtgtgcacatatatgtttgtgtgatcagaattacatttaatttcatagataggactgatttcattaatagacaaatgaaaaaaaatcagcagcagattcagggttttttaaaaaatgaatgtgttattttcctttggcttctgtaacaaagtaacccaaagttggtggcttgcaaaaaacaaatttatcctgtcatagttctgggtctggaaatgcaaaaccaaggccctgctgtctcttgacaactgtagggaaggcttccctgcccctctcagtttctggagccaccagcagtccttggccttccttggctcatggctgcaccactccaacctctgccctccatgttcacgtggccgtcttcctagtgcatgtcctcacctcttctaagggtggcagtctttagatttagggtctgcccgacgccagggtgtcttcgtcttaactgacgccatcttcagaaatcttatttccaaataaggtcacattctgaggttccagatagacatgaattttggaggacattattgaactcactgtagtagtcaaaagctgtgaaaatgccttttcacaggaaaagaaatagaaatgattaatagagaaatagaaatgattaatatcaaaaatatgcttaagactgggtgcagtggctcacacctgtaatcccagcactttgggaggccgaggcaggtggatcatttgaggtcaggagttcgagaccagcctggccaacatggtgaaacccctcctctactaaaaatacaaaaaattagctgggcacggtgatgtgttgcctgtagtcccagctcctccggaggctgaggcaggagaattgcttgaacccaggaggcggaggttgctgtgagccaagattgcaccactgcacttcaacttgggcgacagagtgagactccgtctcaaaaaaaaaaaaagaaaaagcacatatatatgtgcttaaccacacattactaaagaattgcaggtcccactcaccccatttttttacctatcagattgccaaagattgtgcgatagaattggtgaggatgtggaaacgtgcatcccctgatactgggagtggagactggtgtgggcttgttgaaagtcgaacacagaaagttactgagtggccttctcttccctggccacagtgctgccctccactcccttctttctcagcctccctgccctgagccccatccctattctgccgcaaaaccactgtgggtgcctgcagagttgggccttagaaacatgccgaggaaagcaagctcctgggggagaggagcaaccacgttccgaggacgagcttccctcgggtgggccgctgccctcctcagccctcagacccgccagtcagactctggctctcagcaaatccctccccagttccttcagcagaacagcaacataactggaggccaaaagaggacctgaaaagatggatgggggaggattgaggcatcctgtggccactgggaaaccgctgccacagtcttctgctcagcagggactgttcagcgtggctccatctctggctcttcctcatcagtctctccccaggggccctgcagttgatgtccttgtggggagtccttgcccttgctctgctcatggacaggcacccagcaggtgcccatgggatagggcttaatagtcgccatcatccagccttagcaaaggtgaagtttgtgctattagggaaggcctaacccaaaacctatcccaattttctatggactaaagataatgtagattaaggttctaggttagtaatgtaaatactcagtaggttatgctgctctgacatacttgggaagcatcatttccagactccaaactaagaggccaagggaaaccctccgtctctcaaccagcagaggcagacaccagctgggtccccagctccactgtccacctgtgctgtgagtgctgtgtgagtggccatgcctgcctgagcattgcacgataggggctgtgtgaaccaggagcagctctggcacagaggaggcgtgctaaggggaaacccttgtggcgaggcccccaccagcagactgttctgaggcaagccgccctcactggtcagatctgaccagatctttggagatacctgtggcatcctgagacactcacactccgtgacaataatgactcagccatacgtaatgtgagtgccataacttagaggacagcgatggtgagcagagccattcctgggggccccatggggatctcagcgggactgaaggaagacaggttgtgtgtttaaagttgatagtactttctctctctgtagaaacacgaagacaccgactgtccctgcgtggtggtgtcctgccctcacaagtgcagcgtccagactctcctgaggagcgaggtaggggcggccgggcccggccgggagtctgtggagtcctcagggctgcgtgcctggctccccttccctgcatagccgaagcctcacgttttcccagttcgtgagagtcatgtgtatggcagacaaacaaaaaccacagcaaaaagccttatgccattttttggaagtcagaagcaagcattagggttaaaagctacagtgtatggccgggcacagtggctcacacctgtaatcccagcacttttggaggcctaggcagatggatcacctgaggtcaggagttcagaaccagactggccaatgtgctgaaaccccgtctctactaaaagtacaaaaactagccaggtgtggtggcgcgcacctgtaatcccagctattcaggaggccgaggcaggagaatcatttgaaccggggaggcggaggttgaacagagccgagatcacaccactgcactccagcctgggcaacaagagttaaactccgtctcaaaaacaaaacaaaacaaaactacactgtggtaaattcagagcaaagattgtgaagcattaagaaaatgggaatattttacatacagtacaagcaaaggtgacgaggggtttttaaagcaattttaactctatagaatagtaattgctgtaagattatctcaagaacatgaattaacttagagacacttcagaaccattttgctcacacatgccgggtggaggacagctcccacattttagggctgccagaagggcccctgtgtggcctctcccaaaggttgcacgtctcacattgcgcttggcactctttctttgagacaggtagattttgcattgacttcacttgatcaggatatgtccagttgggaaaatttcaaggattcttaatgtttctgcatctgtcctgacggggagctcctttagttagtattctgggagtcatctggggctaccctgggctccctggatgtgtggtacgctgatctaaggagccggctcaccttttcacctcagcatttttcaacagcctgaaattttaccactggatactgggtaacagggagaaccagcctcgcatgcccctgactgagcaagagggcccatgtggggctagggccagggactcagggtagaggagggcccagagagccactctcccccagggtgtgccctcccagcaccttgaagctgatgggtgagggcaaagtcttgcctgatgacagtggcctctgggccctgaatctgcccctgggaggagctagggaaaaataaatgtaaattattgccacaactggacaatcctctgttaatgtataaagagtctgtgctgttgaaataatttctttttttttttttgagacggagtctcgctctgtcactcaggctggagtgcagtggcgtgatctcggctcagtgcatgctctgcctcctgggttcacaccattctcctgcctcagcctcccgagtagctgggactacaggcgcctgccaccacgcccggctaatttcttgtattttttagtagagacggggtttcaccttgttagccagcatggtctccgtctcctgacctcgtgatttgcccgcctcggcctcctaaggtgctaggattacaggtgtgagccaccgcgcccggccaataatttcttatttaaaacattgttaaacctgcatttctgttgggtttctgatgaaaggtgcttttgagctatagattattcttgcccctattccagagatcctgtagattccccgagactcagaatactgataataaaaccaatttagaaaaagacccaacaccgaatttactctagtacactgaaaataacatacatcaaacccagtgtgtcagtgtgtccctggcttaacatgtaatagcgttgacactcaggtttgttattgcagtaatgacactggaagaatacattccaagtttttaaatgaacctggttctgcgcagtcttcacactgcgtttccttgccagtcacctgtcacgtgccttgtgggcgcttcctgcaggggcagccggtctgggttctgaggagcagcaagggcgtcaggctgccaggttcctaccaccttgactctgccctggctctgagaccttccttgaaggttgaccctagcagtggccgcatgggcccctcagtcccttcccgcagtgtccctcctccttagtttcgcagcagggatccattttcccctctgttgtaaatatccacctagagggaaggaccgcctttgtcctggtagactgagaagttgtagaacttagctgcgccctccaggaggatgtgctctatgagccttgggaacacatgcatgctggcacacagaagaacacattcccggctgctgcacccacacacccatcctcccaaaaagagtctgttttctgtgaagaagatctatccctagagtttcctgatgggaatttcttcaataaaagacaaaacttctgctcagtcttggggcatgataaagaaaaagaccaaactatacctcatttgtattagcctaacacatgactctaagtccttaaaatgtaatcctttccattcccttttctcttgttagggcatcataagtaatttttatttgataactcaccagcatttgagctgagcaagggacttttttcttgcaaaacgagttacctgctcccagccccacctaattttcctgccatcaattagagttgacagtagtaagagtgtatggttagactgatcttagaggtctttgaaaagctacctgagtttctggcccttacagagggaaaaagtcttttcagatgaaggaaaaactcatctgcacttatctcaagtattatgagtaatggtacattgtgtaagcttgctttgaaaatatatttatttttgtgtaccgtatattaggtgtgtgacccagttgcattctgaatgctttctatttttttgtgttttcatgcaatttttgtttatggtctttaaatgtgcatttcagtttatgttttttctttcttttttaaattctggcactacagatggcatgtcacattgaacaatttgttctaaagaaactggaagtttaagaaatgttatagtaaatgtattcttgtatattggcgtatatgtgtatacacgtgactagaccgtatatttactgcatagaagtctaggcagcagatgatatatacacacctgtagcgataaacaccattcttaatagtacagctcagatgctatctgtgccctaatatgtttgaacattttcatgcaaacgtttgtgccacaactcacgtctctttcccgttgcagttgagtgcacacttgtcagagtgtgtcaatgcccccagcacctgtagttttaagcgctatggctgcgtttttcaggtcagtatccgacatttgtccttcccagtcactgacattctgccatgagagaaagttattatattaacattttaacatgcaagctctggactccttattctttgtcatgaaactgaaacaccctgttgcatgggtgacgaaagccacatgcagcaggtgggatgctcgctttccagttggtggtgctttgagacttcagggagacactgtgctgaggtggaagttaatacattaagagaagtactacatccaaaaccagctagtaatgcaacaggtagacttgacatttggtggggttttcagatagattgttacggaaattttagcagttacctgaatataagcgaatatcaaactgagcatagtttcaacagcgtgtgtgtcagtacacagccataacgatcacacacgtgtgtatccataaatgcatttgatgtacatgtctgtgctgactctgaccccaacgggggacagacgcaaaatggagcacagctcatagagagcacacctccccgagaacagtgtggggagggcatctctgttgctgccgcacatgtagtgtgagaaatctgcatctggtgttttgttgttgtttattttttaacacatctgagattgctagtgaattggaactgagttttcatttaaatatatgtatcttaaaactatcaagaggcagtatatgttacaattaaagtattttatattttatgtagcaccaatacattattatgaagtcagtacagagagattggcatcttagtattttctgaggaagagaacagccaaagagtaagaatgactgtgccttcctttgctttagtctctaacaagactgagcctcccctgttctgtcgtacgtagtatcattcattctctctgtgtatgtgtatatatatgtttatatattgcaacacttatatcaacatatatatatgaatattctatgtacagagtatatgttttggagatcattaaaatgctttctgtggcttcttaattttctaatagcaaaacaaattatatttcagacaaattattttcttaaatatatgaagtacaatttcatgtgcttattcctgactctaaaatggtctacatcttatgtactctgtagattgtatttgttttgtatgtaacttttctaagaatactggaatggtgaagagcaatacatctttggatacagtgtatttgaactaatacattaatactttagtaaattcttttgaatcctgctttgcttacgtgtttactagactgttgtggcagtatctcgctacaactacaggtatctaaacattttccacttatgctatattttaatgggaaaaatagcttataataggtcaagaatgagtttaaaatttaatttcttgatattacaagtgtcaacccttgataagaagccacttgagatgagctgaagggatgcggagataaccctgagatgctcactgtggcactgcagggtgctggctctgctgctcctggcggcctcctcacctgcacgcagtagccaggtggccctgagcacagccctccttaggcgcagagattccctgttcacttgacgcaaataggtctcccctctttgtgtttagtgctgcttttagggtcgtatgttagccgttctgccctttgaaatgcagcgaggttcgctgaatgcctcacatgtttgctctcgcaggggacaaaccagcagatcaaggcccacgaggccagctccgccgtgcagcacgtcaacctgctgaaggagtggagcaactcgctcgaaaagaaggtgggctgcacactttcctgctgctatgggatttgtatcatctcttcagattatttaaagacaaaacctttttgtagttattaatgggttttggataaaagaaactatcaagagaatgtcaaaaaaaactctgtgtgatcttgagcttataaatgaaggtgttttatttttgttatttgttttttaattgccaagcaagtgtgaagtgcttttttaaagtcaatcacattgtgattattttagcatccatccagcacagagatgatcagatgcccagtccccaccctgctgttttttttttgtaaacaaagttttattggaagacagccatccttactcactctgtgttgtctgtggcttcttttgctcgaaagcagcagagttaagagacatgtggactgtaccgcttgagatactgactacttggctctttacagaataagtttgccagcccggacctgggtggttacccctctaaatgcgttaaacttctgtgttttttacaagagacaaacaggaaaaaatatttgatatgattacaattgattttgtcatttgacaccttgtgaaacttggtgcgctctccacatagacagggccacttcccaaagagactctcccatgctgttctttttttttttttttttttttccccaagacggagttttgctcttgtagcccaggctggaatgcagtggtgcgatcttggctcactgcaacacctctgcctccctggttcaagcaattctcctgcctcagcctcccgagtagctggtattacaggtgcgcaccaccacacccagctaatttttgtatttttagtagagatggggtttctccatgttggtcaggctggtctcaaactcccgacctcaggtgatctgcccacctcggcctcccaaagtgctgggatgacaggcgtgagccaccacgcccagcctccatgctgttcttaagaggccttcattgcaggcctataggcgcaggagcaagcaccttcctccagtaatgctggttctcagtggagtttgttctgtgatgttcagctcagtggggccttcttttcatgagaagatgaaaacctctaagaatggatagagaagaagttgttataggatctaccattgtggcttaattacaaaaatataaacttaattcaatattcaacaaacgtctattgagaacttgtagtaggaggatactatggtgaattagaacagccagtggagttgacatttgagtttcgtaaagatttgaatgtcttgtttccagtgttaaatcccagcaatttaaaatgtaaatatactgcaaggagtctaaaattttaaatagaaagatttccctttaatctgccataagagagtgtttcatgtaaatgcgtgagctgagcttgagaagcagcaggaggatcggcatcctgtgcacacacacggagcagaacagcgctgatgagcagcagtgccggactcatattcgcagaatcctagccatcttcccgtgagcatagagcatctgctctgagttcaacaatggtttacctaggaatcttttttttccctctttttgaagctggcattttatttctgtctttttaaaattataggcatagatcacaggctttttatctttcatagatgctgtgtttctcatttagaaggttcttcctttcattttaaggataggctttgtggccgggcatggtggctcatgcctgtaatcccagcactttgggaggccgaggctgaggctgaggtcgggagttcaagaccaagctggccaacatggtgaaaccccgtctctaccaaaaaaaaaaaatacaaaaattacgccagcatagtggcaggcgcctatagtcccagctacttgggaggctgaggcaggagagttgcttgaacccgagaggtggagtttgcagtgagccaagatcgcgccactgcactccagcctgggcgacagaatgagactgtctcaaaaaaaaaaaaaaaaaggaatgggctttgttactgctgtgttagatacacagtagttgaacaggtctgcagcacatggttatccagcaggatggttgtggaccgtggtgtcatctggcagcctttcggggcctaatccctgtggggatttggctccttccttcctgttctgtgctcttttccccactgaaagtgaatggtttgcatcattggaaaccccaggacataccagagcagcctgcccacacacagtgcagcagtttctcactctgtcaatgcctcatgtgtttaaactatctccagccaagtcacgatggaagccccgagagtgcaggatgcataactgtgcacttccctcttggacgttgccaaaggactgatctctcccggactctgtccatcagagcagagtcctcgccctgttgtcaggccagccagctcggctctgcacgttctcattgtgctcacgagaaggtgtatggtgccctttgctaggtccaaaagcaaaggctggacaaacagcagagatatttatgtttacttaaaatgggaatttatttcttattatagaattatttagttggaatttcttaggttattttgttcatctgtcttagaaaatagaatgtttgagcgggttcacaaagactgatcctcagctgggcgcggtggctcatgcctgtaatcctagcactttgggaggccgaggcgggcagattgcctgagctcgggagttcgagaccagcctgggcaacacggtgaaaccccgtctctactaaaatacaaaaaattagctaggagtggtggtgtgcgcctgtgatcccagctactcgggaggctgaggcaagagaatggcgtgaacccgggaggcagaggttgcagtgagccaagatcatgccactgcattccagcctgggtgacagagtgagactcgtctccaaaaaaaaagactgatcctcacattcatagtcaaactaaagaaaaactgcaaaatctggacttaaaaacacccattttatattttaagagagcttaaatggaggggaaatgtaaagcccaccaaagtgggctggagtaaaggatgttctcattgcagagaacctcggacctcctgggccggtgttttgccggctccttggaacacacctgccaggtggactttcctgtgcctatggcatctccctgctagaagagtggaagcagtgatctgcaggacctgggagttggattcttcgattaaataaataaataagtagtttaaataagggaagtcctaaagtgaaagaagttgagtttagtgtggcatgatgtgtgttcattgctgtaagctgcttctgctcatactcaactgcttgatttgttggagagcagtggcgcaattatggctcactgcagcctcgacctcctgggctcaagtgatcccatccagcctccccagtagctgggactgtaggcgtttgcaccacacctggctaatttttgtgtttttttgtagagatggagtttcgccatgttgttatccaggctggtcttcaattccttgggctcaagtggtccgtctgcctcagccttccaaagtgctgagactacacgtatgagccatcacagctggcctattgacaatgttttggagacattactgagattttttcaaaagagttggcatacatgtcatctttttgcagggatatgagaataaagagtctgagaattctgtcccgtctttgacagatggaaatgaatgaattgttactttcagagggacacaactaccacgcgatgctgcatatggcccgctccacattcgtgcaggttgatcacttgtaggagttcatggacgtatgaggcaaggaaggaaggaaagcctttgcggagtaaaatcctaggaaagtgaagttatattttgcccatgagacattgcaagttttgtattccttagtaaatacatacttgttttaaaataagacggtgattgcttcaaaagatgtctcttgacttggccaactgtgccgaatatgaaaaggacacccatctttaggctggctaccctttagatggacagcatcgggagtcagctctttatcacatctggttttgtgccgagatgccctcgggccatcacctttgtgaccattggtccccacgcattggtggttttagagcgtacatcgttggagaggcacacatcggatctggcacagagcttagggtcttctggggtggagaccaccaccccaatggatagacagagacactcgttaatagatgggggatcaagatgccctttgtaaaaatcttgtgagaaagaaaccctcgttggagttacccttgaacttttcatctttgagaccaggtgttaatttgtctttgggagctaattatctttcagaaagattttggaaaggtcaaatgtggggttggaaatgctcactcagcaagccctccctttggctgatgtgggttgcaggggctcttctgcgcttccgtggaagggtatcctcaggcatcagctctgcctctccgtgttgagggtgagcaggctggccccaagggtgtagcacccatgtaattttttgtattctcgtcacgctctcattatgttggcagagctgttcaaactgcagggtgtggcccctgggtggatgtgaaataatttagtaggttgtgaccagcattgtttatatttatggggtacagtgtaatgttttggtatatacacacacacattgcggaataattaaatcgagctaattaacatatccatcacatcactttgtttaaaatctgctcccccagcagtcttgaaacacacgttagtatgaatcacagtcaccatgctgttcagtgggctcaaaaacgtccgcccctctgtctaactgaggctctgtgccctttgcccagcagctccacaagcctacccccactacccacctccaccagcccgggtaaccaccattccctgcttctgtgagcttgacttttttagatcccacgtctaaatgagagtgcatcgtgtttgcctttctgtgcctggcttatttcagttagcataacatcctccagggactagtattttcttaaatgaaatggaataaaaaaaatcagggtgcattgtaaattattagggcaagtacagctttatgacatctgttttcagggatacacacacacgttggtataagtggggtgatacataagcatctgtttcttactatgttacctggtcaacaattgaaaaatactctgataaaagatttgctagtttttagcaaaaacttgaaaaagcatctgatttattctgaaattcaatcagccgctgcactttgcctcaccctaattactggaagagattctgagaaacactgtttatagcattccctattaaattaggactggctgggtatggtgactcacacctctaatcccaactctttgagaggctgaggtagtaggatcactttaggccaggagtttgagaccagcctgggcaacatagcaagaccctatctctaaaaaaattatttttttaaagcctaaccagacatggtggtggcatgtacctgtaggcctagcttactcaagaggctgaagtgggaggatcacttgagcccaggaggtcaaggctgcagtgagctatgattgcaccactgcactccagcctggggacagagcaagaccctgtctctagaggggaaaaaaaagaaagaaagaaaagtaccaggactgtcattttctgtgtgaagggatttttttcttctgaaactctgtcaataagctaacagaaggcctatattgtgaaaatttaattgatattgttgttaattaatatgaaaaccacttttggttacattaattaaagaatttcttttttaggtttccttgttgcagaatgaaagtgtagaaaaaaacaagagcatacaaagtttgcacaatcagatatgtagctttgaaattgaaattgagagacaaaaggaaatgcttcgaaataatgaatccaaaatccttcatttacaggtaagaatcttaggactacggccagatcaaagggtggaggagcttgcctgtgttccccttaagggtttcttagcaaactctttgagctgagtccttgacctttgcaagcagaaaggcaactgatttctctggcctaagtgaaggcttagaaaaggcagctggactagcacaggcccggcctgggaagccgcaggtcagcgttttcaaactgccttttctctggagagcaagcctccacccctcttccatgcctttgatctaccgttggagaaataagatgcgaagcttgtatttgttaaattagctgtttttattatttaagatttcatattgttcatgagtagttgctgtgtgcaaagtctcacttcctgcagtgaggtgctgtgcagcccagctactctgtgtgagctttccagtgacacgcgctcacccgctgggtttcactgtggaaatccacacgcacctccagaagaacaaaccagtgaacctttgctcccctgaatagaggcgatgatgtaaaggggactgatgaaatgtcgcttctcctgtcttctgtcgtcacaggtgtctgtggggtgcttgttaatagatgatcattgtagatgctctctgcacattcacttactcgtgtgcatttgtgatagcacttcccatgggtgtgtcacacaccgtggaagaatcactcatgtcactgaagggcctgaacttagacggtgtgtccctagattatctggaagagaaactacttctaatagcacagagtcatggcatctttgagaatgccttttctccaatttttgacattggagatgagtcatagtgacttgaattgcgtagggatttattaaattaatttcatttttattatattttgtagttatccagagagagaaggagaaaacacaatgaaacattagattgtattagaaaaggcacaagtcattagcattaaatcaagccaaataaagtacaatgtttcttaaaacaccaagcctcccgctggaagcccctagcattttgctgagggcccagtgatgtgtcagtcatcagactggccaaggcgactggtcaggccactgctgcggggccctggccatcctgtggcccgcctgcacctgcgctccctggcaagcagctctggctgttcatgagattattgctgtgttttgacctggggctcagagaggcactggaaaggccggggaaatcacctcttaaaatagccacaacagaaggaagaatgcacaagtactggattcatttacaacaaaaagttagaatatacacagtgatgtaccaacgccccatcccaaacctcacatttcctctgcattcatcttcagtttctccccttccagtcaggtgttgtcatttactttcctttttagtcgagtttaatcactctatggtatgtgatttctacttgaaaacttttgtgattggatgaaccaatgaagcataagtcagaaagaaagggggaagccaagttgccaagggcagagaagtgaggatggagtggtgacggcagcggtcagtgtcccttgacctgtgacgagtagaaggtgatggcgcacctgcctcttccccacaggaggctgggcgtggcggagagcaggttgtgtttagggaagggactcagagcaggctgcccgcgcctgattcccctgagtgcagggacacggctctgcctgaaacatgtgaaaactcttctccatgtgacctgttgagcaggcgtggtctacacagaaggtccttccaaccgtgtggttttttgaaaggggaaattcagtgttacctttgggaccactgtggggttggtggtctttggccaggaggattctgcactgtccatcctcaggaaatgctgattgaaagccttctgatgcccagaggtgctggctgtgtgggagctgcacggggccaggccatccctctgctgctgcaggccccgcctaccctcttgagcagcagcccagctcagccgtgttccccactgtttcatcctcagagcccttcctgttgccccaggaagggtttatcgtaaaatcttactgtggcccagaaaacctctgtgcctggccaccggtcaccttcccagcttcgccccactccctgcgctaaagtggacccgctcattgttccttgacaagctccatgctgctgcacagatgtctttttctcctgcttcccttcctggccagctccaggcactcctccagccatgtttgtggaccagctaggtgatgagggcacacgtcacttggggtcttcttctttcttccttgtctgattctccagtagaccctaaagccctggtgatggcgggagtcgaagcacagagggcccgatggcctggctgtggcagtgggggtgcaggcagggggtcaaggagtggaattcaagagtgtctttgcttttttgcctgtccggggaacgatgagttcttaatattttacttcttaaatatcctgtttttctttattaagaagacagccaggccggatgcagtggctcacatctgtaatcccagcactttgggaggccgaggcgggcggatcatgaggtcaggagatcgagaccatcctggctaacacggtgaaaccccgtctctactaaaaatacaaaaaattagccaggtgcggtggtgggcgcctgtagtcccagctactcgggaggctgaggcaggagaatggtgtgaacccgggaggcggaacttgcagtgagccgagatagcgccgctgcagtcaggcgtgggagaaagagcaagactccgtctcggaaaaaaaaaaaaaaaaaaaaaaagacagcctaggccggtaggccggacacggtggctcacacccatattcccagcactttggaaggccgaggcgggtggatcacgaggtcaggagttcaagaccagcctggccaagatggcgaaaccccgtctctactaaaaatagaaaaattagctgggcgcagtggcaggcatctgtaatcccagctactcgggaggctgaggcagaagaatcacttgaacccaggcggcagaggttgcagtgagcaaagattgcgccattgcactcgagactgggtgacagagcaagactgtctcaaagaaaaaaaagaagatagcataggtgcgagcatgacccaggcttctggtgtcagtggactagatgaactggtggttcttacagtcagggggtccacagggcacacgtagaggagcacgcactgggacagaaggcagggacgtccatccacgcggccttcactcaggctgccggcaccaccgggcttctcacagcgccgggcttgtgtgccagggtcgcagtggcctgagagtgaggcatcacagcaggtgacacggttgcagccctggcatgcaagtgtataaggctcacgggctgatgctccctgaaggcaaaccttctgatttggattgttgatgtggagtgcagtctgtctcttcagctctgtgtcggagtcttttttctgtacaattccatacctgcacttgagatttattttttatagaaactgcagtgactgagtgtagaccgttcttcaaggatgaaatcacgtttgctgcgttttagagaacacttgatgtgactctgcgttctgctttgaaatggtgccattgatacagatgaagtgcctgttttaaaaatagcccgagttcccttgctgctcatggagacgccttttatttagtcgtgctggtctgtgcatgcggtgcacgcatgttgtgtgttcctgactcgggggcccctgctgtgtgggggagtccttgctggagactccccgttctgtgcttgaggtcaggcgtgcccttgcgtagcacaatcgcggggaggggtggctcggtgccatccccctcttaacctcgggggcctgaggctcagcgtgaggcgcagcttgtcttgggccaccctgcctgggactcatgcttcatttcggggtttgctaagttacaaagggcgtctctcagacctctgttgatcaggttttcattaactttcccctgccactcgcgagcacccctgccagctcagtgtgcgtgttagaaggtggagatgcgagaggcttccggtgctcactagaggagccgtgtatttggatgttcagtgtcgtcagtggtattgtcccccagcaaatagacttggtgagctaattaaatatccttctgaacatgtatgattgtgtaaaataaagggacagtgacagtgtcagtttaaagggacagtgacagtggaaagaggtgttctttagagaaattatccttactttttagaggttaactaatatcatgtttcttggaaagaacaggaagaataacactgcttttacgcccaaaaagccacccagacctgtcatgtttgtgtctttgtggttaataacagccagcaaaggtgctgaaacctagatgtttaaaaatagacttccaaaaggagaagtgaattcagggggccctggggcccgcccctcgagcacccggtgtggccctcagcttgtgaggtggctcagtcattccacagctgcattgagcactgaactctccagccatcacaagctgcttgaaaatgcacatcattttttgaagtgaaaaccctttaagtccctggcttcatctcacaggtggacactccagccccttaacacagactgggccaccagggcggagtacagctcccacccctccaggtagtgacaaatatgagcagcctgtgtgttttgggaaagggctttctgaattagttaaatgaagtagcataaagtcaggcctggttactggcagcctcgtgtgttcgtggcagggtttctgcgttcctgcctccctcgctggggcctggcagcctgagtgtggagctggagggggaagacccctgcgtctgcagcatcggcccactgggtttcacctagggcctgaggacatgccttggggccctttcctgccaccatccaggtgggaggggtctgaggagtgggagtcttctcctgggaccctggggtcgttctggggaaccccctgcagccacagagacaggactgtgcttctgccccagacccagcagcagggtaggaggcctttagacgttccaagggaagatgaggccacatgggcatgattctggcatcctaaacctgagaccctgtggcagccatgcagggccacctgtcccgtgggacctgcacttacaggggtgaggcctctctgggaagcagggaccctctgtattatggcccccgaggtatacgagggctgcagaggagatgtccatgggagccttgtggccccgcacaggtgctgtggcctgggagaagagctgggagggacacatgggagtgtgagggtgaggtcggatcctggtatctgaacaggagagctggtggggttggctgatgccagggtgtgggtgtgtgagaaacaggcgggcaggcggcaccagtgccactgtgaaacagggaagcctgctgtgggcagcagaagcatgagctgctgcctgccccagagacagtggagacctctcccctggtcttctgaacacttgccacctgtcactttgctttcctgatggctctctgttgacaaagcaagctgacttagtggagcctcctgttgttttcttccatgtggcttcatgtcacctcgagtgctccctgccggcacaagcacttgatcccagggagctcccaggaggcctgatgcagagccccactcctggagtcagagccgcgggtggcaggcctcatacaggggcctctgactgttctgctcctagcctgtctgtatttgatggaaggtggtgcagcattttccgagtcctaactgtgttttgctttttaacacctttggtttggaagcgagtgatagacagccaagcagagaaactgaaggagcttgacaaggagatccggcccttccggcagaactgggaggaagcagacagcatgaagagcagcgtggagtccctccagaaccgcgtgaccgagctggagagcgtggacaagagcgcggggcaagtggctcggaacacaggtgaggcaggggccggggccgggccagcagtgtgcatctgggccccgggcgagtgctggggcggggtccgtgggatgagggctatgttaggtacatgtgccttaggacagttttttctaattatgggtaacacgcagaggtgtgatgactttcctactgaaagtcccccagcaaagacaaacgtttcccgcgcaggcttgtcccctccgtgtgaggccctacatggtgtagaaagtaggggcagctgcagccacgggaagctgcaaagccctcctgggagagactggccgcagggtgacccacaggacaggcccaagcgcagatggcagaggccaggacctgctggtcggggcgccccagaccccactcctaagggccagggggcagcagtcccaccgcgctctgccagcatgtttctgatccacaagcagatgtgggcctatggctttggggactgaaagagtattgggaatatttacatgaggaggattaatggcagaaaggaacacagattaccggtgtgtgtgtggggccggatgaagcaggcagagaatgaggttggaggagaggggagcagcttcgcctccaagagagcagaggccacctgtgggtgctgaggccggagggaggagtggggagagcacagctgtctcctgctcccaggagctcccaccagcgggcttcccaggaagccacagtggagcactctgtcttggaccctgcagtgaggtgtcctttgacacacaggcaggtcaaccgcccaggacatcccctgtcagcagtctgtgcctagtaatgtgtccagacagacagggctgtgggcatgagagctgtggtagaactggggcagggacctgggctcttccctgggaggcggtggcctcaggacatcttctacacagttttgctggtgttacccccagaaaccacagtgatttttatattgttgcttcagatgctggtatgactgggcatggtggtgtggcctatagtcccagtgctttgggaggctgaggcaggaggattacttaagctcaggagtttgatgccagcctgagcaacagagcaagaccttgcctctttaaaaattaaaaaatgaggccgggtgcagtggctcacgcctgtaatcccagcactttgggaggctgaggtgggcagatcacgaggtcaggagattgagatcatcctggctaacacggtgaaaccccatctctagtaaaaatacaaaaagttagccgggcatggtggcgggcgcctgtagtcccagctactcgggaggctgaggcaggagaatggtgtgaacccgggaggcggagcttgcagtgagccgagattgtgccactgcactccagcctgggcgacagagcgagactccatctcaaaaaaaaaaaaaaaaaaagagccaggcacggtggctcacgcctgtaatcccagcactttgggagatcgaggcaggtggatcacctgaggtcagaagttcgagaccagcctggccaacatggcgaaaccctgtccctactaaaaatacaaaaattagccaggcgtggtggcaggcacctctaatcccagctgctcaggaggctgagacaggagaatcgcttgaacctgggaggcagaggttgcagtcagctgagatggtgccactgcactccagtctgggcaacagagcgagactccgtctcaaaaaaatgaaataaaataacgagtgctggtgcagctttgctttcctaacctctctgacgttcacctgtctcattcaccaaaccctcctcacctgtggcaggcctgctggagtcccagctgagccggcatgaccagatgctgagtgtgcacgacatccgcctagccgacatggacctgcgcttccaggtcctggagaccgccagctacaatggagtgctcatctggaagattcgcgactacaagcggcggaagcaggaggccgtcatggggaagaccctgtccctttacagccagcctttctacactggttactttggctataagatgtgtgccagggtctacctgaacggggacgggatggggaaggggacgcacttgtcgctgttttttgtcatcatgcgtggagaatatgatgccctgcttccttggccgtttaagcagaaagtgacactcatgctgatggatcaggggtcctctcgacgtcatttgggagatgcattcaagcccgaccccaacagcagcagcttcaagaagcccactggagagatgaatatcgcctctggctgcccagtctttgtggcccaaactgttctagaaaatgggacatatattaaagatgatacaatttttattaaagtcatagtggatacttcggatctgcccgatccctgataagtagctggggaggtggatttagcagaaggcaactcctctgggggatttgaaccggtctgtcttcactgaggtcctcgcgctcagaaaaggaccttgtgagacggaggaagcggcagaaggcggacgcgtgccggcgggaggagccacgcgtgagcacacctgacacgttttataatagactagccacacttcactctgaagaattatttatccttcaacaagataaatattgctgtcagagaaggttttcattttcatttttaaagatctagttaattaaggtggaaaacatatatgctaaacaaaagaaacatgatttttcttccttaaacttgaacaccaaaaaaacacacacacacacacacgtggggatagctggacatgtcagcatgttaagtaaaaggagaatttatgaaatagtaatgcaattctgatatcttctttctaaaattcaagagtgcaattttgtttcaaatacagtatattgtctatttttaaggcctcatctggtctctgttttaataatttgtttgtcagaagaccctgaagtatatacctaggtcttttttttgaaagtctctaaattcagaatcattttttaatttaaagttctacaaataattgttactgcaaacattttattttaaaacgttgatagactgatatttcttggaagaaaatataaaatatcaaacactggttatcacttgtgataggaaagagaatattcaacctgttgttatttctcgttagaaatgtaaaccttcaaatatctgtcgtagttaatgacacgacttcacaattctgaacggagcctcgctcatggatgctgtgcatcattttcagatttataattgttttcaccctaaaatagggcatccgttgaactttggagttctaaacaaaatcctgtaggtgtttggattctgccccatgtgttcggacgagctctctgttgctgacagcaccggccttcggtctccatgtcaggggtgggcgggtgactgctgagggaggcccgcaggtgtgtttctccatcccgtcatcttgctgcatgccgtcaacggtctccgaaagcaacgttgtgcgtagagctggtggcatacggcccacgtgccttagatgggacatgctgcttctccaccctgggtttgcattgagcatcattctagaaagtgctagtttaaccagacttttctctccaccactagatctttgtctctacaagggccctcagacacctctgcacctgctgaggggaagccaggctccaccgtcggcttctggagcctccgctgcttaattaccacagattccaaatctctaggccccacgagtgagccgcctggtccaagtacggcctggtcccaccctgagggaggcaggtgtggaacagaagccgagcctctccgtgtccccaccggggccgtgggcacccccacagcccgaagcagaaccctctgagcattccagagaccgctgctcgggggcctgcccaggctgaccaacgggcgctcctgaccaccaccctggcgggaagggtggccacggggcccgtcgtcccagcctgtgcctgcccagatggcattttctcaactcactgtttactgtctctcagtgtccaactgtgattagaagcctggagcctgccccctgcaccccttttgctatgcaccacgcttcatggtgctcttaccactgatgggtgctacacgcgacgggtgcttcttaggcaaaaccaatgtgtgcgaactgtcacacctgtgccactcgcccacaagccgcgcccacaattggccagctgggccgtgcacgtcagactgcctgcctcggctctccccgtggccgcgcggggacagcttggtgggtgcccggtggcccacctgtctctggtgctgccatctgtcctgggtgtgccttcgccccagtgcctgctggaagtgccctccgtcgcacccctgtgccctgagctcccgtgaggggcccgccgcgccctttcgcggtcgaagcgttccgttgttcttatctgcctttcctttccccgctctcctgggattactttgggggaatgagtatccttggttctgccctgtgagggagtcgtgtgtccctgctcataaaggaaggacttcctgcagaagctgcggaaaactactgttccctcgaaggtgtcccccacctgaggcctgtcccctacctgccctcaggtagttttcctgaggccaggggttaacaacagggacatccctgcaacttccccttcacaaaatgtataatattagatgaaggatatgcaacatcttggtctagtaagaaccgtttcctcccctctgggttgaagtcctggtgtggcccccagaagcagcagtgcgtgtcactgggacgtctccagtagcccttcccaggcagacgctcctggcgggacgccatggggcccacctgagggtcccacagacgtaacctgagtgacaggagtccttgaggatgggatggcctatgtcacacactttgtccttgaacctgagtgatgggggtccttgaggatgggatggcctgtgtcacgcgctttgtctttgtgtttggttgtatcggggtctctgttctgagtgtgtcttcctctcatgtactcaacacagtgggcagcagcctgggacggcgtcccctctcccggcggcgggcaagccttgcgctgctccaccctcggcctgggcaccctcacttggcgctggccacctgggccagcctggggccatggtctctctgcagctgaggcccagtggccccttgggcagtgatcggccctccccgcatcacagggccctggcagcaagcgggaaatgggggcgcacactgtgtgcttgggggtgctgcttgtttaccacacatgaccagactcccagcaggacagagctgctcagtactttacagaaaccaactgagtcgtttgtgcatgaattaagccggtctgcttccccgtcaccttcgtaacaaaacaacgtcccctctcccctcgcctcgagcagtttcttcaggacaccgtggctcgggctgctccctgctgccaggcacgctggttggctggcctgggcccggctcacgtgaagggcactggctcttgtgaccacactgagccacgtgcaagccgcagccgggcctggaagcctgaccctctggttctagggcttgtcccgcggagcctgcagagctagacgttggggtgtgtccgtgatgatatgggggccaggctgggagtagggcctttctagcagggttgggtggctcagtgagggtgtggaagtgggggacccacggggcctggctttgggactagacatgccagccccagctgggctggagggagcctgagtgagccccgacatacgctgggcctttcagctcgccgtgctctggtgacacacaggcggccaggttgggatttgtgtcaattctaggagccatcaagcatgaatgtggttctgtctcctgagcgcaagcctcgccggacccctgggcgaaggcctggacttgcagatgtgtgttccctgtgcgggtggacagagggggcccttatgacccacattgcagccccattccaccaccccttcctccccagagcagtctctgccgagggacagcacctgtgtcccttcgatgccacaacagccagttgaacaggggagccctttgctcaggcagcttctcctgcctctccctcctttctccttccctgccccatccccgtgcccttcttggcctgtggcgctggggagccatggtgtggcatactggggctcctgctccttgggccacttcctcagcccgggccccacaggcccaccacctgccagggctcccactgcactggctgtggcaggaggcttccccatgaccccgtgtggcccagctcggtgaggatgcagttctaggcacagcccctgggacagccagctgcctcccagaccacgtcagcctgctccagggtcctcagtcaccctgggccaggggccacgtgtcccatggatgtcgaccatgccaacgtcacattccagcaccccttttgcttgatggcgtctggtggtagtcagcatggtggacccacatcctacagccagaggtgatgttggacaaaggaaggggagtctggatgggtccttaaacgaccattctgtccgcagcggggtcattccttgtcagcccaagggagggccggggagtacactgatcccaacagctgggctgacacctcctttctcccctgcacggggaggattggcctgaggaccgtcaccctgtgcacagccccagtagggtggcagtgccactgtctccttgggccgttgcaggattgggcgggtgcagactccccttgcgggccccttgctcaatccccggccctcccagactcctccctctactgggggtaatttgtgtgtcagaagggctctggcagagctgtaaaatactgttttttaaaaattttagtccagatctttacttattagactgcagaaggagagctagggagagtgggggaagcccccttgcttttgtatctgtgaggtgaatgagggtctgtcacccaaatctacttctcagcccatgaccatagttctgttttccgtttgcaaatctcagtagctctgttttctccaaagtagaatgtgcgcaccggggtcctagccaggcgaggtcagtgtcggcaggctacctggtcattattgctgcctcgtccaggctgatgctgatggtcacaggcacggtggcatcagggagccgggccagcaggcggcgtgaggcggggccagcagctcactgcaagggcattttccacctgatcctggtgtgccccacatgcggtggcagggcagacgtgtgaagcctcggccgtctcggggctggcaggtgtgcgggtgaggaggccccggtggccaagcagagcctgcgtttcatttctcctgctgcactgtgtctagtctgtcttgtgaactctcaccgtgaaaagaggctagaagtccaggatcgctgtaccgctcctgtaattaggtgatgactggatttgacaacttagtcccctcagacaagtaagataccctccaacagcaaattcaatgacttaattggaaaacacacaagctggcatgatgtccggtgatttctgtaagaaatgcctgtaggagaaggtctgtgaagtgtggagggcagtgtcgacgctgcacagcatctgcagattcgcagcctcttctctgccggtgcctctgttcggttctgttacccaaaaacaaagaccaaagaaggccaatctctcatttgaccctgtctttttaatctgcctgttttaaaagttgcgtctgtagtagccgcttgctgtgaagacacatcttgacagtccaagtgattttgtgaccagtgatttgggtcctgttttccgctcttctaagaaaaaacaaaaagaccgtgagttattgcccagcaataatcatgttgttactgtgagttagcaacatgcctgacttcctgatagcattactgttttctagttttgtttattgtatattatgtgtggttttatttggtatttatttgtgttttgaggtcttgcaatgtttttgtgtttctgatgctaataactaaagtttgtaagactgtagaatgcaaaactcggagatgctaaactgtcttattagaggaaaataaatctgattatggagtctca

SEQ ID NO: 607 - DNA, 134023 bp, Homo sapiens; identical to SEQ ID NO: 606

SEQ ID NO: 608 - DNA, 134023 bp, Homo sapiens; identical to SEQ ID NO: 606

SEQ ID NO: 609 - DNA, 134023 bp, Homo sapiens; identical to SEQ ID NO: 606

SEQ ID NO: 610 - DNA, 421179 bp, Homo sapiens
ttttttttgcaaagattgttggaaataatccttctcttgtacctagaaacataggtgcaaatttctgatatctttgttttatctgcattcctgcctttcatgaaagtccctcttgattgtgctgaggctgtggctcagcgaagacactgaataaatacgatagccactgttgcttgttgcttgtccaagtcttcctggcttctgctgcaagagggggatatggagaaggtgggccagggtgtgtggacccgggcagaatctggggaagaagcctgccattcgtctttctttcccacaccaccgaacccactgcccttcccacccccacagcccttttatgaaatcagacaacgtggtaggtggaaaacagcagggcctttcctctgggttttcaaccagaagtgatattccacagttttaactggttactgtgaagtccaagcggccagaattgtgaaaatgtccactgaaacactgcaagcggtgtacttaaagacagtaggccttttagattttgttatatattttttgtagtgctcttcacaagtggaaattttttttttttttttacttttttttaaaagatttttttgtaaagaagggttgtatttagaggccagtagctagagatccaaccagtggacctcttgaagcactaccaggccttaaggccaccatccgagggagactgggaaaactattattcacccaagcctccggaaatgtaatgtaccagcaggcaaaaaacagttcttcatgtagtacaaaatgaaacgaaacaaaaacaaaaacagaaagtaaaaatgaaaccaaaacatttcttaaattctagtgccatagcttttttgtttgtttgttttttgttgttgttttgttttgttcataagaaagagagaaagatactacttatccgtcagacacatgcatcctcatgtggtcgttgaactgctcgatttggtcaaactttgctgggcagacggagcagacgtaagtggtcccctccgtgcaggccaccacgcctggggggccagcgcgggcacctgggggtgtgcctgcagggggggtcccattgctggcactgtgcagggccacgtgtcgctccaggagggtcttgtgagagaacttctttttgcagatgtagcactcgtaggacttctctccccggtggaggcgcatgtgcacgttgagggagctcttctgggtgaagcgcttgttgcagatactacactggtatgccctcactcctgtgtgtgtcaccatgtgcttgataaggtaatcctttaaggagaaggagcgccaacagatgctgcattggtggggcttctcacctgttgatgtaggaagagacagcaagcaggacagagcgagacatagcaagggatagagaatgaaggacaggaaaaacaagacaacaaaaaagaaaaataaaacaattaaaaaataaaatttgattgcttaatggatcatcctcgtttggaaaaatccaggccctcctagcctctcatgtgcagagaaattttgctttatggtgatgccaggacagttttgttttccatttccctgtgccataaaacggctttcttggaaagctaccagatattccccactaaaagtcttcaaggtcactccgtggaaaagggagggctacttttgaagggggtcactttcagtgtcctgattaggggatttagtgtttcccattaacattatcaaacaaatagaagaaataagagagaagaaagatcgttggagacatggggtgctctagaatccttgagaactaaggatattggtcactatagcttggttccttggggtaagtccccacttctagtagtctaagaaatacacctatgtgttgattgtgagtttggaaaatatttgccaacacaggaatacgttattttgaagagctatactttcaagtttatctattttagacagaaatctttctaaaatataacttaagggttaattgcctgttctctattgactgtagtgagctgcagattggcctcatcgggtgtagaggctgagtaggcggtgggcaacatgatgatatcagactcaaatgatcctattcaaatctgggcaccaacacactacactccactctgacaaatcaccaaatgcctctgaggtatacagtcctacttacctcattgtgctggtgttgacataaaatacatatgaaatcactttgcagaccaccaagagcagtgtgggaatacatgcatggtattcttattacaaggatacctcccacccccattaaatgcttccatatgccttttgaactcttgggtcaatttttaaaatagttttcctgcgtcctcctttgctctcagcctgttggcggaaacccttgtttttcctcagtttactgctttggtttggcttagaaaccaaatgatcaagtttgttacaaacagtaaggtaaataataatactcagtgcatgaggtattcttaaagtccatgggtccgtgacatctctttaagatgattacttaaagacttgttttctttgtgctgtttgttctcagctctgctcctgacaggtgagatgaactgcgtgtttggtccatctctaccacctcattcctgactgcccagtgtaggccctcacctcagagaaaaaagtccttccatgatccaaactaaaactgaaagcctctgaaactccttaggataatatttcaacatttggactatgcatcaaggtaagaagtcttttaaaatttgagctaacttccacttaaaatatatgccttgactgtttttcattttttcccattatgaaataggagagctttgatgtattatggtaatagcagcaatgaaaacaatcaccatgtattgagtgcttactatgaagcaaggttggtattaagtgctgactatgtagcagggttggtattaagtgctgtatgttcatgatccattttattaaactttctctcatcaggaatttgttgttattgtgttttcaaacataaacagatatgttttgaagcacactgaccagacagtatgctgcgtaagatcacatggttagaagataattttacttttagattaaaacaggaaaggttagggaagcctcattgctaataatctcaatttgctgaagacttcagtctatgcatagtgtttacattggtaccttttttttttttgaagtaagagattccctaagagagacagtcatgcatgtttttagctgaaacatttctgtcagctgtaaacatgcctggaagtcagctggtctttgctatcctcatgctttcagacgatttatagaggctatgataggctggccaactatcatttaaaacatgtccacctgtcaccttttatgggaagcgtgccttaaattccagatggtattttggctgctaagaagttgaaacttcacctatgttaaaatgctctgctgtttgaaactttcaccttctgtgtgtttttcctcgaggcaaggtcactgatgaagactttattttcacactcttctaatctgtctataaattgattcctcatagttgtcatgtttctctctatagcatatataggtatgttgtttgtgtgcatgtagtattggttctaccattaattatccatgtgaccctgggctttttaagtgttttcatttctctgggtttatttcattttctgtatgtgaagagttggaccaggcagttgcacatggtcctttgtggatttagtggtcctgagtccgtggtggactgcaacccctgaggactctagtcctggccttgtcagtgaatgacccaagggcaacctacttagtcactgaatgcattaacagtctcacattttaaataagacaaagtatcctgttcccttccctgccacagaacaatggtatgttacttaataaagagaaatgtttgcaaagaacttgggagctccttaaaggaaggtgctctctataattattaaggtgctgtgatggtgaagtgtaggtatttcagaaactgtcttactaaatggggtatattttcagattagtgaggtgctcacaactttcatttctgtatgaatttgaaacgcagtcactcagcaggaatgaatgattgtgttttaagaaaattttttttcccactattttcttgcatattacttacagcaatcccaaaatggttttagacattatgcataaaatggatgaggtctgtcgattgttgctctccaagtaaagaaacaaaaagtgaagataaatggtcagagatggttttccaggtttaagcctatggtcaggaatggcaagtctgatttgtcagaaggggacacaaagtaaaaagtggataattgaattataacatcaaggggaaggtcatataagttccttcactttaaatgatccattttgggcctatacagatgtaggagtcagatatgaattccatttccttggctgagtgacttgggcatgtcatttaacctctataagcctcagtttccttatctataacttgagaataatatagtaagtacctgtctcgtgaaggcgttttgaaaattgaagagataaagcacttagtacagagcatgtggtcattttaagaaaaattaaactgttccattcatcacaaaggaaccaaggataaatgaaaccaactgcaaaatgacttgcatggcatatggaagtcaatcctgaatttttaaaaaattatttcagataatcagtaaaacaagtgattatattgcagctatgtaattcagagttaaaggtatcgtctactctctcaattacatatgcgaatggcaagaagtggtatatggataaaatgtcagcacagagcacagacagaggatttcctaggaaacccgtgactgagcactggaggcacagaaaccaaacagcaagggaagaaactgagggggaggcagtgccctttactgccttgccaagggtgttgggcgtggtaaaagtatacgtttttctcaatttttcaatgcctgctcatcaccttcttctcaaggaccagctctgacacttaactctaccatgactgaaaagtgaaaaaaaaaaaaaaaggaagaaagatcctgcttaggttagaagatgcagagggttctgcctgaagctcacaaagttcaagtaaaagccatcctaatgggtaaagacaccccaattttgaataggaacctcttgcactgggggctcagcaagaacccacttattctactgatttttttcccctcattttaaccaaggcttctcctgagctgtgaaaaagacaatgaatgctgttatcaggagatttttcagaagcactgttcctacctgactctcctgttctctctgcctccccatcatctgccctagtacaatgccctcctctttcgtgagtacagtgatgggtcaaaaaaccaagacagggtgcttgatgagacagcaggcagcaaggaaggaggagaaagaggagaaggtgggtagcagaaggtggccactggtgaggaaagcagaaggaacacttgaaagtccaggtcctctgaatggggaacatcaagacacgaccagaaaatggggaaggttccatattaacaatggaagtacattcagatggaatcatatggagcttttactggctgcagagtctagtctccgtcaagagacgtctgtttaaaagggggcccacacggctgggcaccgtggctcacgcctgtaatccctgtaacttgggaggctgaggcaggtggatcacctgaggtcaggaggccgagaccggcctgaccaacatggtgaaaccacatctctactaaaaatacaaaaaattagctgggcatggtggtgggcgcctgtaatcccagctactcaggaggctgaggcaggagaatcacttgaacccgggaggtggaggttgaagtgagcagagatggcaccactgcactccagcctgggcaacagagtgagactccatctcaaaaaaaaaatggggggcccacacacctgagatatcagcggtgtgattgcctgccagcctttctgttcattccctgggatgtgatcctgttgccagcttggactgtgaggctaagagggactgcctattgggaacatgctgcattcacaaaatatctgtggcttcagtgacaactaagatattttagttttaagcagaactttggagagtttcatccatgctacttgacttttcttaaaattttgtgaatagagtggatattaacatccccagaaaatagcatctccaagtagagagttgtactaacatcttgaaggtcatctaagaagtcagtagcacctgagagtataatactagcccaaccagattatcttcctctcccttgttaacaactccttgttctctggattatgctgcaaaatgtatgatgctactataacacatattaatggctttgatagttttacagcattcataattaagtgttttcacataaattatgttattcaattcaaagagcaatcatgtaaagtaagtactacagatctgaaaaactgaggcttaggtcagttacagaacttagccaaagtgactcagccagaaagtggtaatatcatggccttctcactccaagccttatacttgttactttacacccactggcttgatataattaatagtccaagctccatatgaggattaacacattatcttcatatgactattatggcccaatcaccaacattgttatgctactattgttactatgtctatttacactgaattcatggctgaaatagctgaacttctcaaagtaataagcaaaattaccgtatgtgcagaggataccaatgggctaaaaacagtcaccagtgaacgggctgttgataatatgattcagaaaacgccaaaatatttatctcttgtgggtaaaaaaaaaacacgaaagtgtgaacacagatatgtgtacaatatattctatagcaaataaaaaaagagaaaaaacaaagaaatttaaaactcttgctgtgaaaagaatgtatctgtgtataagtcccttgaattaaattctcctggaaagcgtgttcacattttaaaattttcttttatttattttatttcaatagtttttggagatcaggtggttttcggtgaatgtgcacattgaccaaatgaatgggcatgtgaaagtgtgatatacatgtatatatacgtgtgtgaaatgtatgtctctgtgtgtgtgtgtttccgctctcacagagtttacattctaaagggaaggtgtaaagataatacatgatgatatgaataatacaagtcagtcctgctaaataccagaagggatacatttgccatgtgacctatgtaatttggaagactcaacttacctcatatgtgagtgattagtttctgtgatataatttatccactacaaaatcaagctttgatccataattttgatttactttttctaaacagattcttattagtggaattttaaaaaatgttatgtaacaaaagcaacctgatgccattcttctaattacccaggctcacctctctagggaattgattctcaacttcagcatgaaccagggcttgttacacagatttctaggctccattgcctgagtttctgatttaggatgtctggggtgggggtgaagggtgggggaacataatttgcatgctgctagtgtagggatcacactgctccagggttatctttgaatttgccctattgcttgccttccacatccatgttgacaccaaggcttatccttcttgtattctctgtctttccctttcatttccattcctttatttgacttctgcttttttctcttgatgaagggggtagaggggagcactgctttcttccctgacaggatggtttgtattatctttgtttttttctctctaattctgttgctttcaaacatgcccttaactcttagtttcctttctcacaacttttatgaagctgcagtaagtgaatgaaagaaactcctagagataaggaagtcctccgtggtttgtttagcagtggataaagagtggttaggtgagcaattttcttttactgttataaaaattgttaagaaataaaaaaattcttgttatgaagaatattcaagagcaatctaaggagtataaaggagtttcagagtttaaattccaaagaggaaggacacatgtcaagcatgtattattcagagacaggaaatagagcaaagaaactaagtgtctcctgggtagtaggggcgaaaagtaataatgatgaggatttttaatttttctaattaagtaacactttgcctcttctgaaaagctctcacatgcatcatacgtttacatcaaaaggcagaaaaaatcatttttattttaaactcaaagaaatagacagttgtgaaattaactgatttgttgaaggacacacaggcatttagaggaaacaaaactggatccaaatcatctaattacagtacaatcgtctttcatttatgcctctactttaaatttttgggttataatcactatgaaatatgctttacaactaaagcttccttgattcttaaaggtagagcttagctccaaagccaatatgatggactacttctttgtctcaaacagattttttttttttttttttttgatacagagtcctgctatgttgcccggggtggagtgcagtggtgtgatctccgctcactgtaacctctgccttctgggctcaagtgatcttcccatttcagcgtcccaagtagctggaactataggcatgcagcaccatgcctggttaatttttatagtttttgtagagctggggtcttgccaagttgtccaggctggtctcaaactcctcggctcaagtgatccacccacctttacctcccaaagtcctgggattacaggcgtgagccaccatgcctggccccaaacactttctttcatgaatgtggatcattaacatagagcagtacaagattttaattggaatatgaatcttataatttattctcttcaggtttttttttttttttttttttttttttttttttaagagataggtacccaggttggcctcgaaactcctgggctcaagtgatcttcccgcctcagcctcctgagtatctgggactattggtgtgtaccatcacacacaatttatatctgcagttgttgaaagcaactaccatctatattaaactttggagttactgaattgctaagacagttactctgcaggtctattggtttgcatagcagctgtaatggagagaactcaaatttctttttaactttgtcaagctattctttttttttaggactctttttggttagagtatgggtgggaacacagagtccaactctactcttacaagtatccccgtgctttctagaatctttttatactaacatttggactttttgctttgaatttttatcacttccactgggctcttggaaagttttgaggctccatttttttatgttttccctagaaattgaaaagaactttgtttggaaatgcgagctacaatgaacccaggtcttgaattatttccacatgttccggctgtcttgctttttgaaatctagaccaattgttctaaaactttgttaggttaggggatccttcagttagacaatagtcttgaaagactgataggatttccaaactgccactgccaaataattctggaatgaaagggaagagcattacttcttttaaattaggtgcctgattgatatatgcacattattattttcagatggggctatattatacacaccattacaataacattcataatttactgaggatgttcataatttactagaaaactgaagtccacattttaagcataactcagatttataaaatgactctacctatagcttttgcatctgtgtctgagtgcacaaatcctttgctggttttcttatgtccaaatctagttatctcggttaaccacagaatccttcagtgaatccattggagaaatgtatttatacatcacgaagatactttttggtagtacattgaaaattttatgttgcaaatttaaagacttattttattatgtgatctaacagaatgtgtgaattttacatctgataggtctacttgaagagatgtacagaggggagagcagatatgtttatggatccaagaccagcaaagtcaactttggttaaggagatactttcacagatggtccttcctgcacccctcccccatgttccttaatttaatggcttataaatcagctatccaggggaggaaaggatataaactatgtgacagcactctataaatcataagatgctacaaaataaaaacattactatttgattaattcacctaataatggtgatatccataccatatggaaaatttcttgtgatttacctctggttattagtacattcacatttatcccaagtaaacaaagcaactcaccactacccaagtttcttcataaattcagtagtgagtcactctgtttatttggaagtgtgaatactgtgatctttaaaaactgattctcataaaagtacatacattaatttacataatgtcctgacttacattaccctgcaaagaaggcaaagttcatcttaagcaacgttctgtttcagttgtacaattccatgtttgatgccttgcctctatctctgttgctttccttcccttcagtccccaatctaaacttcactgttttatgtcttctctcttggattcctactagctgatctgagaaacaaggttgttttgagaaactaatttgttttcatgtatcagaattcgagtatgtaacttttccctggtaaattatttgtcatttaataagggtattctgaggccaggcacagtggctcatgcctgtaatctcataactttgggaggctgaggcaggcagatggcttgagctcaggagtttgagaccatcttaggcaacatggtaagaccctgtctctacaaaaaataaaaaagttaaatgagcgtggtggcatgtgcctgtagacccagctacttgggaggctgaagtgggaggattgcttcagtccgggaggttgaggctgcagtgagccgagatcatgctactgcactccagcctgggcgacagagtgagaccctgtctcaaaaaaaaaaaaaaaaaaaagaatttcaaatataatgatcatcactgttataggtattcttaggtccaagagaatctaggtgacatcacaatcgcttatgtgctcacttatatggaggcacatccatggaatgcccaattctatgggaattccatatctctgtaccactatggagctatgaaaaaggattggctgagagatcagaagatcttagctctggaatcatagaatccagggatgaaacatgatcttgcccatcttgatgactgaatcctgtgtacaaaatccctaaaaatgttcatccattctctccttgaatgcgtctaattacagaaactcactccatttaaaggcagtctatctgatattagagcagatctgattgttaacaaaatttttcttttattttgtggaaaggatctcctgatagcatccaatcattggtctagttccaccttttggagccaaactatacaaactgaatgtctcctcctcttaaccatcttaataatagctaccacttatagagcacttattatatgcttggaagtactctaaagacttcacatgtattaatttattctcaaaacagcactataaggaaggcgtatcacgattattctcattttatacacaaggaaactgaagtatagacaagttaagtaatttttccaaggcgacaaggtttagtagtagctaagcctgaatttacacccaggccatctggctgggtgtaagagctcaagctcttcctgactacagtatgctgcctctgaaacacaaatacttgaatatggcttatataatgacctgagtcttctcttctgcagtctggacatccctaggacatcccttctccataaagggttcctgtgacggtgtctcttggtggcagggtgctttgttcttatgatgggaggaacacagttggggtttctagaagaggcttgtggtggggtctgtttaaaatctgaaagatgatcccaaaccttcccttctacctgctctcttaccttgccttcccacagccccctcagcccctgctgccaggcctccaggtggggtgacactcacctgtgtgtacgaacatgtgcttgacgtagttctgtttggcggtgaaagtcttgttgcagagagtgcactcataaggctttttttcgccttgcccactggctgtgctgtggcctgcggatgaggccaggggctgtggcgctggcagctgtgcagtaaaggtcgacagaccgggctgggacactgtcacaaactgggtctgctggcctgccaggggctgtggcaggctgaagaggaaaggcttggggccactgcccgcgggctgggtagtgaagagggctggcaggtaggtgttgccagctgtgccaatgacctgcgtgttgctggtcaaggtcagaggcatcctcaggttgctggtgagggtttctgtctggcgtaagtagagctgggtacttggcaatggctgcccgatggacgtgttgaccgaaggctgttgtaggacgctcttgtcggagctgttgctgacagtgataacagtgctgtccatctccacttcattgcttctctccggagaggaagcacctgtttctagctggtttgtctgcggaccaccctcagcgggggcttctgcagcctgctcgggttgggtgggttcagcctggctgtcccgcgccgccccaggcccaaactgctgctccaccgagtcaggctcggtgcctatggaggagctgacgcccgagtcgaagctttcacctttgggctcactctcggtgccctcggcctggtctgtgtcttccgtgcactcctcggattcgttgcgttccaggatctgcaccctttgctgcccgtagtagtcgtaatcgtcctccatctcctgcttgatgtggatgttgcccactagggtctggatgcgcacaggccggggctgcttgcggcagtgcgtggtctcgggggtggtggacaggtagcgctccatctgctgcgagcgctcatggatgcgtgtgatccagctggggtcttccatgtggtggtcgcggggcaggccgagcgcagtctcgtggtggctgaccactgcgccgctgtaaaaagagcgctcgccgctgccattctgcatggagcacgcgtagagtgccgagtagatcctgtccacgctgtgctgtgggtggctctgcaggtagcccgactccgtgtcgctgctctggcctgacgtgcctgactcgggagtgccccgcggcgtgtcctggcccgagtcctggatccccgggaacacatcgcccacgttctgtgacacgatgcgcgtgcactcgtcgatgactgttttgatctgcaggatgctggcggccgtgaggatctgcagagcttccgactgcgagacccgtagcacgccgctgtacatgaagtcaatgagcttttgcactgactgcactgacaccaccgacgggatctcgatgtcgctgtagccaagcagcagtttgtcctggaagaaggggctgccggctgccagcacgcagcggtgtgcgcgcagcatgctcccgtggatgcgcaccgttacgtcacagaagtggccacggttgcgctgctcgttgagggtctcgagcacggaattgctgaagttgtgaaggttgatgctgtgaatgcgctcggtcatccccttgcaactgatgtcacctgcagcatgtcaacgcagacacaaaacagggcatgggtcagatctagctggttgcattcctaacacctaggtttcaggtgagtaatgctcatggctcctagaagcactgcccttacatacgcaagtggggagatggacaggctgcggcatacaagctgtaggtacgatgacctgagggaaaaggaccttgaattttgctccaattccggcctttagtgccgcagccattttgggtatccatattaactccccagagcttcggctgaggtagagtggcctaataaccagatgatttgtttgcctgctattcctacagcttcagcaaagaactgaaaggcaaatggaagacttgttcttatggaacactaaacctccactttatttttatttatgtatttatttactttgccttcactttagacaggcctaagcccagattctttgggaaagtttacatttcccccaacttatcaaagtcccttattttattcatacacagtgaccatattcatagttaacaaataaacccccttcctattaagtcatatggcatattatcaaaacccacaccatgtatgcaaaaattattggaaaattcaacccagactaagatatctaccaaacagtcatgatcatgctttccggatgatggatgggctacagaaagcaatctgctagctaaaggggcactccatggctgctttctgtatctactcattcttcttgtcatctctgacaacctgtttgagcactttctagggtggttgcatgtgatatggaaggttttctgaattttctgaggcttaatgaaggaggaatgttaaaaaggtcagagatggcagttctgacccaggagactacagtacattggtgatcatatttattatgcaaacagggcactttcaagagtgaaagagagcattgttaataattaggccaggatagcaggagtaagccagaagtgggatatatgatctccttgggtaatagggtgctttatgtacttgccacagggaagtattaaacagctcccaggaggaaggcaacagctatgtggaggctgcggatagcctgacccagcgccaccctataacgtaggctgttatggcaagggatactattgataagatttggattcagaatgagaaagaaaacaggtggctacagcagtagatcttagggcttttctatttttctagctcatctctcagatggctctagagaatccccctccaaataattcttcaatcagattccccattcttgcctttacaactgaacaatcagcttgggaaagtgaaataagtgggctttcaaaaccaaatggcccaagcactgattgttggcctggacccaaatctctctgtcttgtgagaagccacctgagaggtaacagcctgcagataggaagaaggcctacctcctcaaactctttccgctctaccttgcgatagaagacttgttcaggaaactctgagttcaatgagcgtttctaccttgcttcactcaatcaccctcacatggtatgagcttaacttaataaatgttcaataatacaatttgcactaatttgtataagagcattctttctcgttctgactctatcaggtctgttatgtgcctaaaatattgtattaggctacagattccatcgtttttacttatataagacaagttctctttgccagattaaagaattaaggtaaatcccctgtaaccatgtgaacacaaaatatggccccaaaagaaggcacaaataacccaggaagggctgttcaggagctcaatcagcagcagaccaaatttcaagttcttgctgagttcgccatacatacataccatgatagtaatcacaagataacattttttaggggttacagttctaactgctttctgtatatgatttcatttaatcttacagcaaccatgggaagtagatgatattattcccattttacagatgaggaaactgaggccagagaaactaagaaacttgctcaagtacacacaggcaattgctggtagactggcatttaaacccaggcagtctggctctagagttcaccctcttaactgcttcattatattgcatagtttgccctttactgaggtctggcccttagggatccacggctctgttgtaaagctgtgtgaaaggctttgtccactactacctccagctacttctatacctatccgtgatttagtgtggcttttatgtttttaggctgtgatgctttgacatagcctcagttgtgtaacttaaaggacttatttttttagatgtcacagtgcaagaagtaagacaactaactggcactatggtttaggattttctatatacaattttactataaccaaggtctctttcatttaagtaaaacaataagcagtaaaactggttgtgtctgtgatcatctctgtgtaggatggatttattacaacatttttttctacacaagtgaaaacactctttaaacatacatttgctcataacattagttacaacaataacactagagatgtcatatatgacagttttctttcagataattctgggaagtagccctatcacaattatcacaataattagtatccatgtagtgtttgactgtgtatacaacttttttacatgtaacatctcatttattccttacaacaatcctatgtgtgttctgaacaggtttttttttgttttgttttgtttgttttttttttttttgacagagtcttgctctgttgcccaggctggagtgcagtggcacaatctcagctcactgcaaccttcaactcctgggtttaagcgattcttgtgcctcagcctctcgagtagctgggattacaggcatgcaccaccacacctggctaatttttgtatttttagtagatgagttttcaccatgttggccaggctggtctcaaactcctgacctcaggtgatctgcccgcctcggcctcccaaagtgctgggattacaggcatgagccactgtgcccagcccttcaggacaagtcttattattgctatttcatataagagaaagtcgaggctctcaaaatgtctaaatgacttgcccaaagttttgcacagtagcacatggcagtgttgggattagaaactatgcctcttaaagctttttccactgcataacagtggatcactgaggaatggaacttgaagtgcccaaagatcgagagttatcttaattctcagcagagaaaaaagaaagacactgaaagtaatgatgaaggttgctttagagataagaaatgaacacagataatcacacacacacacacaattccatgagaaaaatccaaactgtttgaccagattggattgcaaattttgttcatctaaacaatcaagttatctactgaatagtctgagttaagactcttgcgataatattgccaccaacttcattaaaaaccacagagacaaacctaaacctgcacacgtacacaacctgatctgacatgcctggttgaattttatacacacaattcttaaatatctccctgagtacactggccccacactgcagtgaacagccatgaaaagctgaatcgtttttgctgatatgagtacagatgcgaagggggaccctgcctccccattcaagcatgcctcattcctccagcacacaatgctgaggcaattcctttcccaggctttcttttatttttaacactaatacagtgggaaaaagtttctgccacagcaaggcaaagtccaggcttttgtgagcatgtccttttcatccaatgggcattaatgtatagattccaatggaataaatctgaaatactctactgtagaagatttgtcccccattgaaaacaaatcttgattagatggttattcagggagtgtataggaaggaatggtgtgaaaatgctaactctattctttcttagattggcactgaataggcatttgggctattcaagaaaaaaaaaacacacacacacacacccaaaccccaaccctatcaactgtacaaaaccacaaaactttacatagattatgtgatcatgtgtatttggggattcttccccacccaaaataaaaaatgcacagtgttatgaacacaaaactgatggcaaaatgaaatagtgataaaaatagttctctgtgttttaaaataataacttacctcctttttactagagtaaaaatacagagtcagcttgtgatggcattccctcaaaacatggaaggaattgcagtaatgaaagtcatcatgtattctaagagactgttctgcgagagcacaacacagacggggctaaagcaggggtgagtaccgaagggaaaatctgcctgtggggaattggggatagagggcctgactctctgttttgcaggaacgttgctcctgcctgtcccttaagctgcaggggtccagggataggacttagcatgagaataaaaagctgcctgctcacaagagaaaatgagcaagaaaggaaacagcaggcaatacaatctcttttaattaggtgtgaaatccagttctttctcaatcaggagagcaaaaggatatataaaatgagactagtgcaagggtaagatgctacagagggggatggggatttgaagtctctggacttggaaggaaacatcagctctcaaatgaaaaccaatataaatttcggtccagttaataagcctaagtcaagtggcagggccagaaagcccttgagctttcaatttggggcaccagatgaggttagtgggtcttgcacatgaaacagggtgcagcttgccaagttagtcacactaggaaagagccagtcatctctggagaaaggggggatgtattttggtgactgagcccccttattctccaaaccccctgcctggggtaagacttcagttacatgtactttacctcctcatatatgccaagggagtcctgctgaatccctgcactataggaggtatagtagtttcttgctaacaggttccatccacagcaaatgactctgcaccaccccactctctctttctatctcattagtatcatcacagtcttgggaggtggctgggagcactggagaaatcacacatgcaagtggaaggcagcaagcagacaagatctctttctcctatcttggctctatatacctagcatatcccagctgctattacctctgtagtgagactagggagggtcatcagcctatgggagggcgagctgtacagttttacttacccattcttgggtgaaaaggggggtgttttgggccatctcccaataaaggttctcctctatcttccagattgtctaagcccagtgtggaggaaccatcaaggatttcagcacgtttttttagccattggtaacagaattcttcacataaaacatatatcaattgttgaaatttgcagaaatttgacttcgaacttgcagaaatttgactttcaaacatgtttgcaggaatggctacctatgaaagttggggactagctggatgtgcttttttagtcactacttattattttatctagacaaagattaaaaattactaacttgtttacagtatttacaacaccattctatttatgatcccaatactgtaattgggtatgcctttaatattacctgaatttttattcattcatagaacatttctagagaatacttaaaagtatttaaaggtccttggttttatgtttgggttttggggggtatgtatagtttttataaatggacatgtttatacttttataggaataaggtcagtggctttcatcaaaatctcaaaggggtctgtgttttccccaaattaagagctgtggattgagattcaggcatccctctttaaaatacttgtaactactttccataatcaaagcttctaaaactgatgcaaactttgtgattgcattactctgatgcataaggtctgttgaactgatattttccatttacttaagttgagctgatactattttgtatgagaaagcaaacaatcttggccaaaatgagaaaagttacttttcagaagagaaatattttttaaaaagattgaaagggaagagagaaatgtaggtaactactaatattagcagaaatctggattatgacagacatatagtttacaactgttgaagctaactattatttagcaaactttgttttactcagagtaagtcccttttgacagttaagacaaatccacagaagaattagaaaacaccctttaacatcttttgactgttaaaaattagatattgtggtataatttgaataaaaaataaatataaactcaatatacacatctaatcagccaaaaaaatagtttacttgcaagatctatagcacttgtaatggggagactgcctttctttctattttcctccttccctttcttcctttttgctgtcataccacgaagttttactaagtttgaagtatggggaacaaagaggcaaaattgagaactagaaaaacatttgctctgtgattttcaggcccatccccaaatcttgacttatcttccattcctgacttctttttcctctcttcactccaccaaaaaataagagctttatactttatctaaggctgagaatagatttacagtactagtgggattttacaggtccaaaggagaaagtaattccagaaaagtctttttacttggccttagaggtctcacagtctcccttggttagcccaggcctttggcttgcctgattttatgttaagtctgctgttctctctaagaaaggatgagggcatgcctatccatattgtaaaactgtaaatacaactgacttatgaatgaagctgctttgggggtcacttgaattttcaccaattcattagtgaaacatttactgagaataccccagtataaatggaaccataaggatacaaaggatcttaaatctaaatcaatagaagaaatttatccataaggatctttgatattggaaacatatattaatcaatcaacttctcccagacctcagtgctcaggaaaagctgtgttttgcttttctttgtggagcctgtgaatatcataactgatcatgtttccctcttggctctgttcactagggagctcagaataaaaatttaggcccccttttagcaactatgtaggacctcatggtatgcttttctatgtaaaattttcaccagcctcattatattatccattctttattttacctctactctgatttctttttttttgtagttatatagaaatacatttcctacatatttattaacaattgaatattaatttaagctacctcaaatcccttacttatgaggtgagggcataatcaatcaatcaacaagtaattgagcatccactttatgaaaccaattccaaccataagttaaaacttcagtcttgagtattatcacactatatgctttatgaattttttatactttgagcatctgattccaatgaggtaaactgttgaaatttactttacagtacagtttgtgaaaattaagttttactctgtgaataaagaattggatagataattccagacaacattctgaaagacacttacgccgtcattccaaagttgaaatgaaatgagggggagaagacttgctgggactaaggaaaaaagtcaatgaaatctgaggttgatgcctttaaatcctcttatattgtaaaccttttgagacaccttttaggagtttcattttttctctctctaaagcgctttccttacaaatttagctactgccctattgtaaccttttcctttgttcactaaatctggggaacaaaaatacagagatgctacatccgtgggtggtatacaaaaatgaaccaaaggatctacttaaattcacaaatttgtgctgtttgaacttggctttgaatagaccttaaagaaggatctgtatattcaattgtacagttaataagttaggtcttttgttttgcttaagaagcaatcacaaatttaaaaattgagtatatgaaaaccagcatcttcttacttgataatctgttcttgtggtctctacataatcatatacttattttatagaaaaaacagatttataaattcagtgagttcaaagattcagtataactctcaggtatggcatttctttaaagaatatcatcacacactgatgaattatagttaggtaagaaactgattttttgactttgggaaaacttttctctggacttaaacgagtgagaaaacagaactcaatagtgtcattaaaaaaaaaaaaagctttctggcaaaaaatatcattgagttcccaattcatagaacttcctttagtcctctgttgctgtgctgttctgaaactgcttttgaagcaggtcttcaaattcatgctcaaatgttctcttcccttgggtctttctaacaaataaaaaaaagttgcttccaatgagaccgctgtttttcaagagtatctctgtttgttggtaggaggggaatgcaagattttctttttttttttttttttgagacggagtcttgttctgtcccctaggctggagtgcagtggcgcgatctccagctcactgcaacctctgcctcctgggttcaagtgattctcctgcctcagcctcctgagtagctgggattacaagcgtgctaccaaactcggctaatttttttttttttttggtatttttagtagagacggttttcactaagttggtcaggctggtctcgaactccttaccttgtgatctgcccaccttggcctcccaaagtgctgggattacaggcgtgagccactgtgcccggccaatttctctatggacttgagccatgatagataagttcactgaggagtaaagaccttctatcccaaagcaacagggaaaagccaaggaaaaaagtaaatctgttttgttggatgactggttaaaatggaagcactgagatgatttgtgtgggctaggttaagagagtagctgaaattcatctgcgcacctagggtatagaaccaggcacgggaaatcattaaaaaaaagaataggacctaagttcctttttggctcatactgagatgaagaataagtgctgtcagatagaactcaaaaccttgggaggttctggtaaataagtaaagtagaaggcatactttataattattttaatcacaagtaggcattttatctttatgatattctttatatagtcttttgtataatatttattatattatttacatattgtcaaaaaagacattgagctatagaagtctcctatagctatagctaacattcaaattatctgatttcacttcactgatttggttggatttgattttctctaaaataaaatctctgtgctaatccaaaaggttggccattttgctttcctgtgtgtggattacattcatttttacttctcttctgctgaattttccgcagttctgaagttattgtggtttctctcctcaccaattcttatcatccccatgaaccttattcaaactttttccttttctgtgaagccttctgtgattactagagttcacttttcttggtttccactggttggtgaggtaataaactaagacattcatttttggcttgttctcactgaattagaaaactttcttaatgagaaggtatctcccctttcctccacctgtaggaatgaatggccaggtttttgtatactttataggctcctttgcctcagggagttgtggtttcagagcccattaagccctaaagaataaaccataaaacaaagagttttctttcctaatgtctgttctctaaaatgaattattaacccagaatgggtaaggagagtgaggctgattgatgctttggagttagagaattggatagcattactggagagaaaaacaatccactttccctcaaatgcagaaggtagcaaggtctctacttgcatacagctccagttggggtaattgcttggcacacttctggaggctggacataaaaaggcaccactttgagaggaacagtgatcatctgggggctgggccaatggtcaacagcaaggaccactgtggagggcatctgtaaacccagctagtgcagtagtgctggcagtcagaaggacgaggctcaatggcatctttgtggggtggtcaagcaatgtcaatgttggagaccatcatggactaaggacttagatttaatgagtcttgtaccaatctagggatgagaagggagccccaaaacttgtctgtatttcttgcgaatttggtgacaggggcctcaggtttaattttctttagaaaaatacgggaatttttttgtacctgaatgttgaggagtgttggggaagttcacctgaacttcctatacatgtagcacctaagttagttcttaccaatatattattgtttcttttttcatttgtgtctgtcttatctctctaagactcaaagcctcccaaaggctagtatcttgtcttgttataaccacaactacaatgacaactacaaatatgtaactggatccctcattgtgcccagcatgtttctttataatgtgtgggttctatgtgagtgcttgtttggtcagctcttcgctacacttcacaaacaagtgggaacctcagggcgcacatttactctgagatatgtctatgtgatatggtcctgacagggcttttttgcccctgaagttctgtgtaatgctcttcttcttgtcctttatttccctacctacccacagttctattttcaatagaatttaaagtccaagcaattgttttatgtgttcactgagttgcccacaaactctgctcattcatttatgatttctgatacatgccatgctgtctctgtctccctgattccatttccccagagagacagctcactgggtccccctgtcaacagaggattcagtggaacccaaagctaagccatactttgtaataaaaaataagaagagatgaccaatctatgatgtgatagaaaaatgatcaggccaaactccgatcacttttgcctatgttagggaagctaacctgcttggtaacagatgttacagaaatatctatcaatcagcattgataacagggtatttatatgtacattaacagtagtgtcaaggattgtttagaatattttctcttggtggccactgggtgtcctcatttacaaagtaaatatgcaatatttagtgaaggtcactggagagaataaaagacactagttttctctttggcccttcacatactggggataaatttattgctgaactcacaagcaggttatatattagtacagtttaaaaaccttcaggtcaaactgttaaaagtttataaccaagagtaacttattcagggtccagacatgaattttaaaggctgtttcctcaacagaggggactgtgatcagctattagaatgatcccttattcatttgaaaattggcatgggattttgactatctgccgagagagccagcagagaggagcagagaaggtcttaatttattcttgaaagaaaagagaacaccaaatatctctatgggatatttgttagattctgtttttatctcaccttttctgaaaactaattaaaaataataatgagaagataaaatatgtcctttgcctaggaaacctgaaataatgtgaaaaacattacaatgagctgggtcagtatactgattatcaatcatttcacatttgaagacaaagaattaaactattcctttatggacctgttatcccacctgtaaaacaaaggtgtgtatgcttcacagggatgttgtagggacaaatagaatatgaggcacacaaggttcctaggaagagaaactgtacatgagatagatttagggcattactagtattctaattgaggctgagtcacagttgtatatgacttgttcctgctggaagacagtagtcaaggccagagctcacacagccaacaaatatgttctgatttgctgctctcagacactgagtctgacacactgctcagcaatcacttactgctccctaaagtggtattttgcatttctaggattgtcattgtctctaaatttatacttatatacatcgctgatgaggttcttcccttgcaaaaagaaatttcagccttcctccaattcaagatacaggcctactattgaatacataacagtacatggccttcaaatgtcatgcctagccaattagctaatcctttcccaaaataaacttcactgtaatattttttttttcactagcatacatccccagcttaattactattctctggcatgttatttcagtacataaattatcaatatgattttgtgtcaaaaccaacaatttgaccaggcatgttggctcacacctgcaatcccagcactttgggaggctgaggtaggtggatcacttgagtttaggagtttgagaccagcctagccaacatggtgaaacctcgtctcttctaaaaatacaaaattagctgggcatggtggcgcatgcctataattcgagctactcaggaggctaaggcaggagaataatttgaaccctggaggcggaggttgcagtgagctgagatcatgccactgcactccagcctaggcaacagagtgagactctgtctcaaacaaacaaacaaacatcccccaacaatttatgcaaacaacatcagggaagctaggaagctctatgagctattctctgccgttcagatatgttcgattgtcttactagctgagcttaacagccttttctgtttttaaaggaccaccatgcatgcctctagtacagcaatctctaacacttaatcaacagttacgtctacagcaatacacaatagccaggtcactttcaccctgagattatactaaaggctcacaatatgctcagagtgtatggaaaagtgtctcatttcttctaaagatccttaaattccttgcttttatagtattatccaactgattaattagtagattcatttttcaactactgtagccccaaagatacatatcggcagagccctcctgattgtattttacccttggccttttctccttttagtttcctcagtttgcacctgtaatttcacttttagaacttctctaggctcggtggctaaacaccacacagcacaggctttatctgatgtgccggcgcctggtgtggtctaagacacactggtgttttgttcttgaagtacaggattgatgttctgaaacctaggctctaacacaaaggagatcattagctcattttaagtgtctcttttcttccctcccagcctcctcctacccaccccaatacttccttagtcctaagcactggcagcagatggcaaccatattccaaagctgagtatacataaaatagtgccatggagaacagagtggcttcaaagttagcctttctattcaagtgggatggcggggacttctggaggagtgaactcatctctcattcatttaatcctctattcattcagccaggaatttgttttcctacacatccatctactgtccagccagttgagggagggtgggcatgaagcatctctcttgagggcccttccagcaggagggcactaagatttctatgccaagctcttgtttccctgggccagctctgcctgctgctgatcaaatcatgccattcctgtaagaggagcttgggaacacagtgtgtagggggtggatttctcaagaactatctccttgctagactgacagtcacatgctgtattccctagacaaagattagacccaggaaaaagatgaaacaaggaggaggatgtggggttgcagaaaactgtgcaggatgttacagtaacgggaggtgggagtgggaaaacctttcctttttgttgtttcaaggtttgctagagcttttgcctaatcatctgtttgagcatcttgaaaataagtatctatttccatggtatctatcaaaaacaggcaccagattatactacaaagttgacctgccatattgctattagaattaaaacatgtagcagcttacattcaaaagaaagcttttctgtttccccagcatgaaaagcagagggtatttgtgatacactttgttttgtaggtctgctgaatgaaaaaaataatcgggtaaaaaattagtacctatattttcacaaatgggcataatgcttacaaatgcactacatcattattttagcttcattctccccacaacattcatttattcattcaacaaacatttgctgagcacctactcctaatttgtgtaagcactttgctgggtgctagggattcagcagtggacaaggtaaacaagattccgccctcctgaattctgtcacctggccaaaataaacatttaacaagtacgctgctagaattttacttgagaaaaaggaataattcatcttacctagtatttcttctgaatctttcttaaacatatttcttgaaggtccagactcctttaactaagaagttctatcttaaatctctctctttccattgttatattcattcctttcttggttacaatgtggagagttcagattgcaactgctatcatttctggggggaatgggggtgggactgtaaccctgagaatccttgcttttcaaactacacatatattttctctgtaaatattgtaccatctaatttgcgtctttggattttgttgattagccatcaacatgtgatttaaggaatactgcatatgagatgcagaaatcatgactcagtaagttattattttaaagctctattttgggatttatacagacttgtgtacagtctagtttggctttcaatctaatctgcaactattactaggaggcttttagatcaagttccatacccatgtgtctctggaattctacagtgagaagcaaaagtgctcaggagttaagagaagcagacgtccgaaattatctccatgcattaccaaaaaccgtgggcaccacggcacggggaaaacttaccaggtacaatgagccagtgactgttactgaatttcttaagattacacttttcccaactactgcagactgcttcagaatagaagaaggtaagtaagcagggtgattacaagcaatcctcctcggaagtgaaactcactcttctaagtttacctctgttttgaattatttcagacaactctcatgccatcaagccgacggactttcaaaaaaataaaagatgcatttctttacttgtaagtatttgtctttgcaaagggctctctgatatggtagcacagaagtttgcacattctaaggatctgatgttttgccctcttcgggtatcccggctggaaggagctacggtgaaagggcacctaaggtgaatggacagattgtagatgggtgcacacaggaaaatgtacagctcctacaatgtattctgaggtaagagagcacacaagtccattccctataatttgaaaatctctcttctttttttattttttagagacaggatctcactctgtcacccagggtggaatgcagtgggatgatcatggctcactgaagccttaacttcctgggctcaggtgatcctcccacctcaaattcccaagtagctggactacaagtgcacaccactatgccccgctaactgttttgtagagatggggtttcactatgttgctgaggctggtctcaaactcctgggctcaagtgataaatccacactggcctcccaaagtgttgggattacaggcgtgagccaccatgcccagcgtgaaaatctcttattgactagaatgcacttgaagacaaaaaggaacttaacaggttaacactagaatgtaatgctataatattaataacactctaacccttccctataccaagaagacaacattcagagagatttgaaacttctttcagccccagtttccttatctgtaaatggggtgttttgtaataagattatgcatattagtcctctttcatttttaggaaaaaaaaacatacaaatgggggaataaaagaaggcaaagagataatggagaaacttcccagtctattcaggcctgaatccaagaagggacaagaagaagggcactggcttttcctcgaagtgaaggatgtaactgtcttacacacaatctcctcccatagatctagggcttttcagcctcagtcgttctcagggggaaaggatggggacctgcaacaactttcacttaggctgcatcaattttagttcatattaataattttcaagcacttaaaactgtagccgacactcaaattcacggagcgctggctgtttttctggtgctgctttaagggctttacatgtagtgttccatcgaatccttctaataaccctatgagatgcatactatttttattctcattatgcaattatgcacatgaggaaatggaaacatagggaggttaattaaaggcacataaaatgcattcataggctgaagttcatgttaaaaagagcaaataagtagaccatgggggtgagaaaatattttctgaatattggaaaacaacacatagccccagtcttagtccattagcaacatgttcaagaaatagctttagcagtctgttatcatacctgcccccaccctgaaggcatatcggagggacccgagaggacatcaggagccattctgcattgggatgttcacagggacctctcctcattgcttctaagttcactcttgggtgccaggtttgagggtgcagattctgattaggatatgtcctggggaagtggctttttccttctgttagttctctgaccctaatgtaacaaaatctttaaacctgtgtcccagaacaacacgcaggaaagaatatgaacctctaaaagaaaggcccagtaatggtaccagtagagtccaaggcctccaggtcaagaactcctgctctggagcagggctggaagtgggggcacgctttgcctgtatcactgcccagtgaaaccaggcctgctttgcagtgcctgttagcatgtcaacccaggattacttaggccacttcaggaatcccaggatctagtcacccatctgggacctttaggtcaggaagaaaatggaatgggctagatttatgaaaattggaaaaaatccagtcaggtgtacctataaagacctacagtatttccctgagaaaatgacatgtatcctttaccctggggttaacttctaaaagttttagtttagaatttgcatgtgtcttttccattagacacagagttatcttttgtagttcaaacttatatgcacctttctttcattgtctcctttacatctaaatacctggttaagatatgaggcaaagagataatcagtgattatatagggaagaacgtgattacagtaaaaaattgaaggacaaagttaattcagttactgctttttgaaattctttgtagtattctacatgccacaccaagcttttttaaaaattctgtactctttggtctaatatcttggtataaaactgataacataaccaagctaaaactagtgaggataaataagtaggaggaaactcatttttagaattggagaggaaaggaaaaaactcctcaaggtcaattttgacatcaactataaattcatttggccttgtgaaattataaagactcatgttcaacattgttccatgtggttgtttatataattttcagtagtgacaaaataatctccttatttagttttacaggtaatttaatagtagaacaaagtatcgtttgattcagttggttccagatcaccatcctacagtagaagtatatcagatacttttgtgtacaggtgggattggcctttggaatgtcttggaccatcacagaaagcagcatactttaagtaaacaaattgaaaccctccctacaaataatgaatttgaggatgtcccatgacaatgaaggtggccttgagaacaacacataggtttgttattagtaattacagagctacctgaattgggcatatcatgaaagaagtacacagaacatggcttttaaagaattatgctttgtcatttcaaaaacaattgtttttaaaaattgttttaaaaattgttaagatgatttaaatgttcaaagtgtatgacacctatcctctgcttagtgttcagaggttactgagggtaaggaactgagttaatatttgtgaagtaataatacttgtaaaacattatttctcataaaaaataatagaaagcaatgttgagaagaagtagagaaagaaccagtataatataattactgcctcactgggcttgggtagtgccttcaaattcctttcacatatatttaccattccaattgccctgtgaaatggaagatctaattccttctcactttgcctatttaattgcagagtctcccttaacactggtttttctcagtctataatgggctaggaactcttgtatcataaaaatattcattactccacttttgagttacccattcattatttctttttaaaacattaaacttgtactttgtaatagttgctttcccatttatcctatgtttgctcctgaacccctctttatggtcttttttgtgacacatctgattctgttttcttgacaacaatcaggaggctagtaatcccaaaacctaaggtaatcttttcctaggtctctccctcgttggtgtctgtggcacctgatactgactgctgatccttcctctccctgatggtctctctgcactatcctggtttttctcctatcccttagaactctcttttcttttcctctatttattcattcttcattctctttcttatcactcatgtaaatatttcccaaggttttgctttccttttttctctcaacaaagacttctttgaagtttactcccatatttatggcttatagtgctcttggccaaagtgtttgctagtcctaatctcacgcattcctgctgtgccccaggaccctgtttgtaactcagtgttagttgtctccactgggaacacctgtggtagctcatactcggcactatataaaatggaattcaatttgattcctttaaatgcttttcatctttacttgataccttggagttatctttgataactgcctttgttgtaactaacactcagctcccagagctgtctaccctcatccacaaaatctgttgcacctggatcctccccattcctcctattaccgcccccttcaggtcaccaatagtgtgaaatactgacagtgctgtctggaccctctccttcctccagttgctccttctcacatccaggctgccaaattagatcttctcaaaatcttgctcatggtaggccctacttaacacccttccacagctctgcaacagaggtgcaaacccctcatacctagtcctgatgcctcatttccagtctttcaaaagagctcaaatggagccatgtctaataaacctacctagatattactgttaactggattaaaatatactttacaaactttctaaattctcagatactggtgatgtgaggatacatattgttttaagattcttggtggtggggtctgtttttctccacctttgtgtcctcatggaactcactgtagtgacaggcacaaaagatatattctatacatacttgctgagtgagtgaatcaatgctccggtgggtctctgtgtatggggacatatctttaaccacgctgcatggaagttgtttgtgaatgttatttgatcttctctacaagactctaagtctctgagcctagggctccagtttataaaactgcgtcctgcacaatacttagcctgtggtcctccacattgaaagcatccactatattgatggatgaatagtcctgactcctttctgttcagagaacattaagtttgtccagaagcagacttagtaacaagcagcataaatggtgggagaaagggcagggttctgtttctgactctgtcattcattatgctgggaaactttcgttataacacttgtgttatttgggcctcagttttctcatgtgtacaataatgggtatagaccaggtaacctttaatcttgcactgctgataaaaagttagaactggcacacattcctcagagagaacaaatgattcagaggcagaagaaaagcaaaaaagaaagcaaaaaaaaaaaaagggattctgctgatgaagtaataaggtatgtgattatggtacctagtgtgaggtgactggtggaaagatccgacttgaaatttccttaaagcaagaagtccttaaagaatcctcatgcttgctctcaatcaatcctaaatgatccaactctaagggcagtagtgcatgtggcctcttttattttaagtaaggatgtgagaagtcttgacagatatggagaagcactaattttatataatgaaatctgccatgaacagaggaagcacacatgaaactgtcactagcagctgtagataagaattaaagatgtattcctgcatgggatgagatggcaagatgaagaacagaaccgtgaaaatcagcattgggccctaacaattacatgtggataatcatatctatgcactgtttgggagagcaatatgacacagtgtaacttgagccaatgggcattgagaccagacttgccaagggacctgggaggattttataagaggacagactgttagagtcgggaagggccacaaatccatgacaaagttccagcatgacacctgtaggtgactctggctccatgaatgaacttttctcaacaattagttattctgagccaggtgtggtggctcatgcctgtaatcccagcactttgggaggccgaggcagacggattgcttgagctcaggattcgagaccagcctgggcaacatgatcaaatctcacctctaaaatacaaacaaacaaaaaaccccccaaaaaactagctggctgtggtggcacaagtctatgttcccagctactcaggaggctgggtgggaggattgcttgagcccaggaggcagaggtggcagtgagctgagattgcactgctgtactccagcctgggcaacagagccagaccctgtttaaacaaaaaagaaaaataaaaagaaaatttattttgtgatttactgatcaaaatcatcactaggtccttcagaatactttctttttttttcctgagatgcagtcttgctctgtcactaggctagagtgcagtggtgcaatctcggctcactgcaacctccgcctcctgggttcaagcgattctcctacctcagcctcccaagtagctgggactagaggcacgtgccaccatgcccagctaatttttctatttttagtagagacagggtttcaccatttggccaggatggtctcgatctcttgacctcatgatctggccgccttggtctcccaaagtgcggggattacaggcgtgagccactgcgccttgccccctcagaatactttcttactttgactggctgtgtggaaggaagggttcttttgcctattagaaaataagtagatgtcttgctttattatatatttggaaagcaaatgtctctgaaatggatataggattcagctcagctgaattataacaatagacaatgttacccaaatacaaatcttcccatgattaaaatgaggcaaagtataagaaggcctcagtgtcataactgaactgttctgttttctgaaaactctgcgctctgtttgtgcctctatggttttgcttctttctattccttctgcctggaatgccattacttctgccttctactttacaaatgcccactcctttatgatccagtttaatttcatttttggtgtggagctctttccacttcaagaggctctttcctcgggggctctgtagcattttgtgcatactggaacactttaattctgcatttatatttaccccgttatgttccaaagtgtggggatggggtcttattcctatcttcgtccctaatcttagctgaggacttggtgcagaatgagggatctgataacatttgatcaatgactgaattaatgactaaatgaatgaatgaataagaacgactaccagaaattactgcattaagtgactatggaagaaacccagttaaattggtgttgtagggaaataataagttttataaaaagagggccaatttaaaaaatagaggtagattaagatacaaagtttcaagacctgtgcttttttaaaataagtgtgtccccaaatgcacaaagtggaaactctaggaaattagagcaaataaaaaaaacgaactggccttccaatgtataagtgctggactaagcactaaaatctctaaataaagggtataaaaggtaacgaaaaaattccaaagagattatatatcaattaactaagaggcagaaaggtgactttttaaaacgggaaagactatctttaatgacaggaaatccacatttaacagatgaggggcttacttggcaatgaaatgacagaaaaacagtttaaatgaaaagataaatatataattccttacagaacatagaataaagcagaatgcagaacactgggggcaacgagagcacttagttgtaccaaagacactctattactgcttaactgatacggaatttattagaaaattaataacaagccattggatagtaactgtctgtggttgttattccattccattttggctatattttctctgcaaattagtgtgaccctaaaatgttttcaggattgtccaacttgtcctaaattccataaataaactctttcagaggatgctgttttttgccatgtctctattacggttcttcacagatggaccatttttgtccttccaaagtctaagaataactctttcagttatcaagacataccaaaatccagttcagctgctcctgtgggattccagttagtttagacacatctgctgagatacatgcatttgaatccaaatgaagcttttgtttgattatacattttgaacatttatggaggttttctggggccaaaatgtttttcattttttggcacaccaaacagagatcttcagttataaacactgccttctgagcacctccaacagaaatccaatcttttcatgtgaacaggtgcctcaggaagtttttggaaggttttacactgaatcagctttccgattggaaactttctgaacatgcagtcaaatttgccaaagagaccttcaaacttgcttgagcagttttcactcatacagacatacattcacacatacagacagcccaagtaaaagcaaatcagagccctgtaaaactgaagtatttttcttaaaggttaaatatcatatgcaaccaaactgaacaaaaagaaatacacaacaggagacagaatgaacggatagcacgaggttcttcattgagcgtgtctgccttaaagccttacctagagtttaagctatacatcctttcagtaaagttttttatttcatctggtttcaaatatatactcaagcattcgcatttttaaacacggcaccatagagtattgctactaacgcctttcaatcacaaacccgttcaaacagttattttgaaacactgccttctctaacacaaatgggtaaaccagatttaaatgtaaaggaagaaaaaaaattactctttaagtcaggggttctttagcaaagccctcatcttacctgattccctataacttttactttccagtttgaatacagcatagactaaaaagttgttatagagtaaaataactttttaagccttaagcctataagtttttacagagtaaaatcactcccccagtgggcatgcctgcaattcaaggggaaatctgctttcaagttgttctaatggccccgaaccagatgctctaagatggccagaaacctttgtctacacccacttagcagatttctggctcgttatcagggactaaaaggtttattcacagaaatgaataatttccttcgaaatatcccttaccctatttacatgcttgcatattccttccattttgttttccccctacagctttactaagggaattaattatctggaagaacaggaacatacagtaagtacatctgagttacaggatgagacacagtatgtcatctattaggcctggctaagaccagcagctgatgctaaatgggaaggaacatgcaccaaatgttttttaatcacaaagttagtaattaattgctctttaaaatacattttatgcttctttctgtctgtgtacatgaaatgcacatttattacatgccaaaaattacaacattatggtttaaatgtgactggcacggaagtccggaaatcagagttaatgttcccacagcaactttaattctgtccgtgtgcacatgtagagctataatagtcttccgttccaggataatacgtatagatggttttgggagggaagctaaagacccatatcctcaactgtagttacaggaaaaaaatcaaaggataaaagctgtgctcctttccacatacgtggataaaaacaatgtccccacacccagtgttgtgtaatcagggaatgaaagaatctgctgtgatgccagcactcaaggggacagtttctgttgctgtgggaacctgaactttgcatttcctgactttggggtaattaaaatgtcagccttaatgtggcattaatggagtttgccataaaaatcttctgttttgttctctaaaaaattgcttaaaagttcaaaatgagccaagtgtactaaaaattttaatcacacagacttgggcgggtgaagcaaatggttgggagggggaggccaaggaaggtggatggcaagagttggaaaaggaagagcccattggcctctgtgagtgtccagccccagcagaatgatgctacctacggagctaaagttaaacccacccacacaacagtttggaaatgtgtaaaggttcaatgaaaaataaataaaaactgttcatgcgtaagtgcatcttggcaaagacacaaaaaatgagacagtctgatgaggccggtataaaacatgggaaggtaagtcaccatggatatcagcttccaacaaaagaaagacatcagaataggtggatctacagcagaagtagggaggacggccacagggaggaaaatcacttctttcaatgggagccttatttgggggaaaacaaaatggaagaaatatgcaagtaaaagttctggtcgcgtctatcacatgtatatgactgtgatgtgctacagcttgatagctgtcaagaaaggtttttcatatggagagcttcgtctgctttactgacttggtttagtcctgcttaagcatttaaagggagcacttggctcagctcatactcagcttgcttagtgagtaactgctctatcaaacacctagggtgttttttacccttcagattccataactcatcttaatgccttccattatcaccatgtgaatttgcttaccattagatttttagcaatggtgaagaggtggtaagctagggggtaatgggggaatattgctaaaaggaaattgtgttagtaggcgcactgcaaagcaacatacattttagcagcaatattaacctcatcatctcacaaaagaaagcatatctcaactatatttcttcttgttttgaataccactgggatcttttgccgaatttgaagaggctcaggaggttaaacagccaactgagaatttagggggtcagacttgtcatctttgctgtaaaacacagcctgtgtccttcatatgcaaaaaagatggtggcttacccacccatgtcagttcatatgcagagctgacttttcttttgtggcgatgctttatccatcatgttttacaacccagtcaccaatatgagtagttgcacattttcaagatgcctgttcagagccaggaatgccgtctttgggctcagaacagagaattccaataagaaatgctctcacaatgagagcaaatccataaacacccctcggtacccaaatgagttaaccacaagcgagtcttccatctacctgggtgtcaattttctcagttttctcatctgtaaattgggaaggatcatactgacaggatatgggcattaaatcatgactaagaataattttgctaaacacatgacaaataaaaaggtgctataaaaattcaagcacttgtgaaagcttggaacaacacacactggtggaatgtttctgaagttaaagagactaacaagtcaagggcactatttttaaatgccccaaatctgttagttctaaataggaactgaatattttaccttaaagaaattaggcttttaaattaatctatggtaagaatgacatttgaaagtaaaaaaaaaaaaatcctcttgaatgcaagaagagcatccaaaaattttaacagcttaaaataaacctttttcctgtcttctctcaagcaatctccaaatggacagatttctgtgaatctttcctaaaaacaattttcttctaagtgtaggctcaaatcaggacaaactacaatccaaatatatttggagaaaagtataatcaatttaaacaacaggttggaacagagaagacttacacatcttaatggcaaaatcaaagtgactgtctaaaaacagctggagatcaggtttctcctcctggtttgtttttccaactgagctcacatccactggcttccccagggccaccaaggagatgtatggtgacaccatactcacgctgttcctgaaacttacttcatgccaatgctaaggcctggccagaggatgcttatgataaagcacaataagtgaagcccaatgctttttctattcacaaaacattcatttttgctgtaacagaagatttctagcctaaggcaattctatgtaatccatacccataaggtgtggcagaaagctgggtaatgaagacctgcatgtagaaactccaggcccttcaccacaggaacgggctattttcctggtgggaagggacagtgtgcacatgcctatgggcactgtgccactctactttccaattctttctgtcattactattacactgaagattgccaggcaagaaggtccaaggatgtgactattaggacggtcctcagaacacagtccctgcttctgccccctggtttctctatagaagcctcaacttcgactgttcaaatcacataggccacagagatttgtctcacgttacttcccttttcattttctagtgacggctagaatatggtcttagcccaaccttaaatagaacaagctctcttcaccccaatcctgccgccagctcatttccctctctttagagactatcatgatgaagcaagtagagaatggaatctcctggaccattgtctcttgccttctttgcagaattttacatttgttctgtcagaaaaataacaataaaagatttagaatctcatttcctaataatttttgtctttgtggacaaaattttatttttgaaataaaactttgcaggtcttatgttactcattttaaagaagaatatgccagttatttgcatgttaccagacatcctttatggagatcagttcagaagagttgttgggtatgttaagactaaaaggaatattcttttggattcgactccaaagttatttcattcctttccattgtcaacacacatgtttctttttctctgaagtattgggttacatttcagaaaaagaaaaaaatctcctaaacgtgatttatcaacttgcttaaaatagaattagaagaagtgactcccagattagtgggaagatggcaaaaataaacagcaaagaagtgatttcaatagcgacgatctcattaagctgcccatttccaaatttagcccttaggcagtttttttaattaaaaaatatttttaacctggattctcattggctgtgtgaagtctgggtggcttctgaattcttggaagccattctcttttcttctgtaaatttatgctatcctttaaccacttcaaaataaattaaaaactggaaagacagaaattcagccaagctacatgagactccaataactaatgcaaatctgacttgtgttatgtaatttcaaaatggatgtttccttgtgtctaactggccttctgaggtccacatttggttgttcaatttagtaattgtggaagtgccattatccagatcaagaataaatggataccagcaacaaaacttcattttctgggttagtgttatgaaaagaacgtgttttatgtaattaatcagccctttaaggccaaatggcatgtcacctggcttttaaatacactctagctttgcaaacttatagatattggctgaatgaaaatggtggcacattacttttggctgctttagaagaccaaatgcaaagagctcgctctgaaagtagaaaagccagaacccagggtagaagcactactccaagcactgcaaagacaccatcaccttagtggtgtactcacaatcagatgacccggtgtgagcgtgagagtttgtcagtgaatgtgttgagtggatgagggctgggtctggagacaaaacagcttcaaagttcaggcagggaaggcccggcttggcgctggatccacccggctgagtaatctcattctcctcagatgccttctggttttcagctgtcttgggtttcttcctgaaaataaacaaagggccctttgaaggaactgactgcatatttgggaaaaggcatttttagaatctgttaaagataacttgattttttttttctgaagggggatgggagggagtccagtatgtcccttgttttaaaacaagctgattcttgttttttttccctccagtaatggcctaactgggaacacatgaaagcatatgggccaagcaaacagcaccacatttggactctgttggctgcataaaaagaccctgtcccagaactttagacagcttgagctacgtatggctgacattatccaagaaagcatccctcttccccccttaggagttttaacatggtctggaaaaatactagtggaagttttaccgttctagcatttgtcaggaagcttagagacaggactcgtggagtaatgggaggagcactggactgggagtcaggagacttgagctaccgtactagctgtgcctctaacttgctgtgtggccttgggcacctcacttcacctctctgggcttcagtttcctcatctgtaaaataaagggcttggattagaaggccttaaaggttccttccaactttaaatttctactcatggactacattaaggaacattcaactttcctgctcttattaagattttattttaaataaaatttcaaatcacaatttaaatttgcagcctgtacggatgagggggtagtgatgggaggtttctgttagagtagcaagtgaaaagtgaaaagaagagcttagattctagtagctaaagagggaaggtgtcatgcagagatttttctactccaactctttactcatcctacgcctaagatttttgatttggtgcatcgtcctggagtttagggtgtgattgtgtgtttgggacatgaggaagagaagggtgaagggaattagaaagtaattgttactaattgttatatggggtcaggaataggaagtaaaacagcacagctatcagtcagctcaggtctcctctccccaggacaatgcaactgatatgaaattaacaaatacttagcttatactacacagaccctagaccacagccaaactggtttattagtaatagttcctgaacatttctccaattcccttggatttgtgtctttttctatcattatgtggacatgaccagaaaaagcatttattttatttgtagaagactatgtgtggtacagaatttgttgtaagtagatttgtttccatgtttcccttgtttctgtgagcatggtaatgtacttgttatgcagaatattttgtatttaaatttgttgtgctgggtagttaaatctgccctcgcagaatatggtgttatgattagtatgctgtgttttcagtccaacaggttgtgaaataaaatctgtttcttcagagggcaggaggcagagatggcatggcaaagattagaatagaggtgaggctttcagacatctttttcagtatggaggaagccaatacaagagaagcaacaaattataagaccttatcaattgatttttgaatggtgactatgggagtaacccccaaatcttgagtgtctacatggaccctgaaggagctggtattctgattttcagtttaaagatgtagccaagatcaaagttgctaaagcccaactcctttattaaaaccaatgctttctctaaggtccatatctctatcactgttgtctaccaccaggttggaaacctcagggtcactatacaccttcctctgccttaaagccaattcatcagtaagttcttacagttctgcttccttcatattttttctcacatctgtgtttccattccaatttcactgcaatcacctactgctttttatctagctgattgtttactaactggctctccaacctctttcactcctctagtcctgtttctttgcattcactaaatctaagatgactacattagcctgacactcaaggtcagttccgtatctcttctaacttttctcatgtgtcctgtatattggccatactgtaccctcagatttcttgaatatcctccagaacatcctgggaatctacattctgggctctacatctttgctcaagttttctcttactttgaatatcccatatttcatctctgccctgttgaaatcatacttattatccttcatacttattaaatggtgtcttcatcttataactgtcttgattcctctctgccaggtaggacttcactccccacagtgaattcctccctaggtctttctccgaaatgcctaagctcttttttttcttaatcttatttcactcactcaattttatttcaataatggctatttatgtgcatatccctcttgtgagactgtaagctctctgaaggtaaggaaatgtcttagttattttagtattcctagtgttcacctattcttttcttcttccttctctcctgtcattcattcatttacatattcattttacaaatatttatgatgtacccatgatgtgccaacatgggctaaagaataaaacaggactggttccttccctcccagagtttactgccttgtctatactattaagcaatgtagcttagacaaagctgtcattcaataattgattgtggacagaatgaaatgaagctgaaattaaagtgtattttaagaacggtcatagtctgaatcccaattaagtttcctactttttatgcagcaaggtagcaaaactacctgactggctgcttttgctttaagtctgtgaggggtatttaataagagcaggactattttgctcagtaaggctaggctggccctcatgattcatttaaatatagggtcaaaacagtaatgacatatgtcacctagcagaaaaaagtgtttatttttgatattcatagacagggcctaggatactttcagatgtgtgcttcagaaaattaagaaagctttctttcaaacataaggacatagcaaaaccaccaatatattactcttttatttttaacactgcaaaaattatattgttcttcatatcaatgcccttgtttccttccctagattcgctcttgtttcctacctgacatcttgtatcacaccctcctgttgcctcagtgatcactttgggagaatattgatagcacagaggcattggagctacctctataaacaggaaatgttagcaactcaacctttttggctcacccccttatttgtcttatatcactttacttacccttataccactgggctgtttcccaactgtccagataatagagaactgctcaccatcctcagaagcaattcatgtcctgtctcaccctctctaatggttcttcggactcctttttccggagctgagaaaccctaaaacatagcacccgtttacgtctagacatgcacaggtgctgtgaattgaccccatttttgcagttcatagtttattaaggaggaaagaataagccctgtcataattagttgaaaatacattttgaggctgtataaaaagaattataaacatggcacatctgagggcaagtcttttcaagcctctgtggcgatgcactattccctggagcctttagagggcagcagcacactggctgactccagcggatttcagagaggcgaactcccgaccagaaccttcctcctggtcaccatgccaaaggttgatttgccaggctctggcctctcagtctctttcttttcagttctcattctctctctctctctctctctctctctcattctctctctctctctctcattttctctctctctctctctccaaccccttcctcctctctctctgttaaaattatacactctgatgaagtcgcccctcaaccggaaaatgaaagctccaatgaaaaagttagacaagccaacaacaacaaagaaagaaaccagggaaaaaggaaaagggggctggtgacagggaaggacttaagaataagaaaagggcagatgtttcgcaaatatatgcaaagcaaaactgggtgtaccctgaacacttccacagagaaacagaccaatcattgtgcacttcctcccgccacactggtggagctctgcattcaaaaaaagaaaaaaaaaaaaggcaaaaaagcgtggccgcaggcacccgcctttcaacggtcagttctgacattctgactgaacatctctcaattgtccaaggagaacaaaaacattttcatctcctcactgcaaacatttctgttatgagaaaaggctgcttcaagaattgggagtgtgttttaaggagactggcggccgagttagccagcagagccttctggtttttaactctcattgtgctggccccagcaagaagttttaggctgaaacatagcagtgagtaaggctgtggaggatgttggctctttcctaactagaccatattgtatgtggaaagaaatatgcattaaaacatattgatgatatggtaggtattaagcatgttaaatgcatggaaattaaccagatcggcggcatttgatgtatatatttcacactcttttgcacatattgcacacatacagtgatggcaatgctttctgcaacatatggaaaaataaatattttatctgtgtgagctcttagcagtctccagggtgttgagagtgctctcttctttcaccctatcccaattttctctcttcactgggctcccaccctctcttgcacgttaatgtgccttttacttatcagcttggtcttttcctatctggtaagtaatgtgcctgttacttatcagataggaaaaaattagttggaacctcctattggctcatgataatttagaccagtgatgcctcccccaatcttactggagtcgtaacaatttccctactcttttccccaacaatacattaaataggcttagtatctgggcaggagagaaagggtaggtggtaacaaaccaccccaataagggtggtagcggaactgcgctccactacctattagctgtatgtcctgggtagattactccgcatctctgagcctcattttcctcatctgtaaaatgggaataataatacctaccgcttagggttattgtgaggaacaaatgagataagccatgtaaagtgatttgccttgtgctggcacatggtaagagctcaataatggtagttcctctcatagggattgttagttctgtgatattcatcatgttagctttaagaagacatttccgggcaaggggtggtagctcatgcctgtaatcccagtactttgggaagtcgaggcgggcggatcacgaggtcaagtgatcgagacaatcctggccaacatggtgaaatcctgtctctaccaaaaattcaaaaattagctgggcatggtggtgcatgcctgtagtcccagctactcaggaggctgaggcaggagaattgcttgaacccgggagtgcagaggttgcagtgagccgagatggcgccactgcactgcagcctggagcaagaaaaaaacaaaagaaaaagaagacatttcccttcatttcagtaatctgtttagatatctagattttgggtaggggcaaatggattgttattgtagcaaaggcagaaacaatgttaggaccagcaatctcttcctcaacatttgatcttgctgtatacttcctgacatctcctttctgctcacatgtttgtcattgctgtggctacactacaccatgagctccttgaagctgagggttgagcaagctgcacttagcctatagaagcccatcaagcctggacactatggtctattcattgagaccaacctatgggactctggcttatcgtgttttcttgcaatttatcatttctctacctggtctgatgtcctcacatcaatttaagatattttagtgattaaacacattttattttctcaatcttattttttttaaccttggcagggctgatttataatttttttttcagtataatttcctcttaactgtatcagtcaggatcctggcaaaaatagatggcacatgcaaagtttttagctaaagaggatttaatgaaaaaactgtatttggagctgcagatgaggttaagggacctcaagagagatagcaccaggtactagcaatagtagagactgccaggtactagcagtagtggaaagctttaaaccatttaaactgaaggggcaagtaaaatggtgatgaattctgagtccagtcagaattggagttgggaaggagggctgaactaacacatttcctgacctctctcttcccccactttcacatctcctgctgatgtctccttttggccaaattcaaagggaagcccaaggacaagagagcctgggtaatgtagtccagaaggccagtcttctgggtcacacatcagggcaaaagaatggttctggggtttttttgggggtagaatggggtggcaagactaatcaacatatgtgttcttctctcttatactttcaattatactttctggaaggaaagacagaacaaaataaaataggttctgtcttagcttccatgtacctattatgtcgaattgccattcacagagcaagaaaagagaatgctgctcagccgagcagggatttttgtttgttttgcttgctgccatattcctagttcctagaacagtgtctggcacatagtaaatggtcagcaaattttaaatgactgagtaaatatactcacctctgccgtgacagactttatatatatatcatctcattgacttatcacaataatctggttaagtaggcagggccactgagcattattgtgcaggtggtatggggggggtgggtaggtattaaaatttaatatgtgcctccccaacccacttccaagccttgtgactaggcccgaagcattgtcaacccaccagaagagatatacttctgtaaatgattcacattttaattttttatcctctttattgatttttgcacctagcaagtttctgttttattattattatttctcttttatgcattggaaagccaagtttctgaatagcaaagactgcaaagattataacccagtctgtccattctctagggcccatgagaagtaaaagcaggcactggcattctgcacagatgaaatacttcctacgacaggaatacatgctcacttgtggacttctctgtaatctgtaggcaacatcagctcctgatttctaggtctggatctgggttctctgtagcacaggaaggtaagagtgataagaactcttttccctcttaaaggatatagaaacttttaaacccatctgcatcatagtaaggctgtgttatctgtatcagcatagttactctgtgatgaagaaaaactcagaaaactatccagatgtgggaatttctcgggtattccttgcacttgaacttaaggatgaatgaaggtatatacaagtaagttccttgtgtgggtgtggactgaagaaactatgtttgatcttctgtcatgtctttagtccccagtaactcagtcctattagtactatagaacacattcccctccgggaaaggcaggcctgtctatcacctacacagcagcccccatcaactatgattcagttgactggaagcattaaaggtaaaaaagcaacacaaaataaagcaaaactctggcttcatccctttaggtttgatttataccagaatagctaaagacatagaaatatgaatgtaaatatcctacctgaagcctaagagggatgttagtctcccaggtttagcgttttccagtaacatagaagtctgtaaaacaccatcccattacctgcctcataacatataggaaaacttgtgaatataacaactagttattgttttaaaatgtgtaattaagttactttgcatgcagaacttctaaataattcaaatgactggcttttctattggaaaatagcatatattcatctgttatttcagcaatgattaatgaatacttgatatcaaactttcatcagtattttcccataggtatcatatcccctaccccaaattatttctgtacttttccttgcaaggtctctacttctcctacataaatgccttgcatggcgggaactaaatcaactacacagacccatacatccagagagcagaggtgagctggatacaagtggcttagagatgtggtggaaggaggccagagctccaagggaagggcagcaaggagacaacagcatgggttgcagctcagacaacaggtaaataaaaccaagcaaagctgctggtcacagatttgaccagggtggcaagaaatgacaagctaccatgagattcaacagtggcacggaaggatgatgagaagcaaacagattaggagaagctgccaccaccgtacatagaggcacagatgaccaagcagaacagcaccagtccctgcaaggtgtgctcagatacagctcagcacagccatctggccaggagggaatgataatgcacatggtgtgcactgcagccgggaagttgagaaccgctgtgggcacctcaggactgagtctggttaccctgctgatccaagaaatgaagccatctaaaattttgcctgctttcacaattttctgtgtgtgtgtgtgtgtattaaacaaagtgaactaagaagccttttattggagacataatgtactcacagtagtttcaaaatcaatggtgtcactcttcaggtaaattactccaaggcttgggcctagtgcagatgttcattggggcagggagcagagagcggctgcatctagatcagacaaaaaacaaaaataaggttgttaaatgaacaggtgatggtgatggcaattatttattttgataggaaagaactttgggacttgagtgagaggttggttgtttggttctacatctttgcaccagagaatggcgaggtacggaagggagaatggagaggatgttgtccaggctccattttcagtgctttcacctaactgcctgtgcagcctgggacatcaacagtaccctgtcagtgcgggcggagctgattttgtggttctgacttagaagctgagttgtgggtgacagtgggggaaggaagtagaaacagtgtccttcaaccttcccacagttgattcttctagtatccttttcttttttttttcatttattatatttatttattttttattcacacataaaaattgtatatatttatggtataaaacatgttttgatacatgtatacattgtggaatggctaaatcaaactaattaaaatatgcattaccggctgggtgtgctggctcacacctgtaatcccagcactttgggaggccgaggtgtgaggatcacgaggtcaggagatcgagaccatcccagccaacacagtgaaaccccgtctctactaaaatgcaaaaaaattagccaggcgtgatggcgcacgcctgtagtcccagctactcaggaggctgaggcaggggaatcgcttgaacccgggaggcggaggttgcagtgagccgagattgcaccactgcactccagcctggcaacagagcaagagtccatctcaaaaaaaaaaaaaaaaaaaaaagaattacctcatgtatttatcactttttcatggtgagaacacgtaaaacctactctcagtaattttcaatatatactacattcttattaacgatagtcatgaggatgtacagtacatctctggagttattcctcctgtctaaccgaaattttgtgtcctttgactgatgtctcctcagcgtctggcagccaccattctaatttttgcttctataaattaagcttttatagattccccatataagtgaggtcacgtggtatttgtttttctgtgcctggcttttctagtacaaaaaaaagcctattttttccccatatatcatggatgacctctagattcatccatgttcttgcaaatgacaagatttccttctttttgaaggctgaatagtgttccattgtgtacttttaccacatttctgatattcttgatttcatttcagtctctctctttattgcttagttcttaatgtattctagtgacacccattgatctgggcatgttctgagcattccctctgtccttcactgcaaaggctccattttcttccataggctctaaccctgaggacaccgaattaccctattttttcccctatacctcagtctgctattctgccttcttcactggcttattttctttcttctgttctctaaatgtagacattcctctagatcctctcctcaggctttgtctaccccagtcctccctgacctcaacaatcacttctccatggagagcatccacattgctatctttagttctagcttttctacagagctgcacacccacattctaaataacagctggttattggttcattcgttcctttgtccattcattcagtgtttatatagcatctatgaggcacctggatgaatacaacagggtctctaactttgagaagttcacatcgccatcaaatactacacaggcttttctaattcagaaagtttagaacttaattcattgtctttcctttaaaatctgttccttctctagacgtcccatttcctgccattggtattctcttcatccagttacgtgggcctacagctggggagtcatcttcaattcttccgttttttttttcttcctatatccaattagctacccaatcctgtagattctactctgattgtgattcctgaatcaatacctgttttctataccagcccctatttctccctttgctacctactgtgaggacatctatgaaaagctcctgactggtttcacttttccagtttttctttacctcttgtccatccttcacacaaacattacattaatttttctaaagtgcccttctaaacatatcacttctttgcttacagtcctccttgcttattggattaaattcaaacttctcagtttggtattcaaagctgctacaatgtagcccaatctagtttctcactcttatctctacactccattctacgctccagcaaagtcctactctttcctaccatgttcatggtatttcttcctttctttcaatgtctacatgtagcttcttcaagggccatccaaatgccacctcatttatgaagcatttcacaaaggagagtgcccttcttaaatattattagcacattctgtactactccctttgcatattctaccaattagaatggttatttgtgtaatttgtcttccttcttcataagccctttgaaagctgagacaatttttactctgagtaccctatagtgggccatgacttcttgcacgttaagtttgcactaggctgataatctgctgaactgaatttaaaaagaataaaccctcttgccttgagtcatagaaacggggactaaattgaaaagacctaaaagctcatctgcttcaaccccctcatttttcagacgaagagatgaagggaactgacttgctcaaggtcgcatccttgttagtggctgggcaaggataacagacataaaaggccacagactaatatttatcagtgcttacttggcaccaataggcccaacagatcatcagtaatgacaagaccagagagagggaggttggggtgtgtaacctgcaaaaatatattgtgttccaaaatataacaaatttgcttcatttatttgcttcaacaaaccgaactaataaatatgttttatagttaaatgttgtctaaaaaatgagggtggatttaaaaaacaaggaagcaaagttttctaacattaccagcagaaataattatgacaatactgtcaacaccactggggaggaggtgcggatggttaatgggtacaaaaaatagaaagaatgaatacgacctactatttgatagcacaacagagtgactatagtcaataataacttaatcgtacattttaaaataactaaaagagggtaattggattgtttgtaacacaaaagataaatgcttaagaggatatatgccccgttctccatgatgggattatttcacacggcatgcctatatcaaaacatctcatgtaccccagaaatatatacacctactatgtacccacaaaaattaaaaacaaataaaatgttaaaaataccactggggtgataaactcaggctgaaaataagaataaagaaatttctcatgctttggaaaagctgtgtgttcagctggagttcttggtgaaaacatgcagtaattccgtggttaaattcattactttgtagaaacaaactattggcaatctgctattatgccacattaacacttctttttccacctagcttagcctagtactcattctctaggtttgtttaaatgtttacttgtttttctttccttatattactaatttacttgtagaaatgcatagacaattgcctctgagtctgttcaaattttcttgccttgttcttctcttgtagtagaggaaacattagttgtttctcttctctatccttatcctcaaacagaatcattttctctcacccaaagatgaaaagcccaacaaaacatgctgtggggataatagtgtttacctaggtgaggaaaacagacttttccagggaatctcagtaattattacttggccagaaaagctcagctcttaaatgttagctccaatactacaagacctcatctgcatctcccaggtgagcgcttgactcactgttactcaccagaggaaaaccttggtaggtagcattaatcaaactctttttggccagtatggtggagccatgctacgcattgagacatccattaaatagcatcaccccagcagccacacaaacagcaaaatgggctcaagagctcttcattgttctttctaacccatcataaggctggacagattattgacacttcaccagatagaacttacttctccttttgccccctggcaactacattaaaatcataaaggaaatcactcatcaatagtacattgcagtgaaaaattatctggcaaatttacaaatcctttgtgtaattatataaatgtacattttaaatatatctaaaatctgatttacattgtgcattttataattaatacaaccatagtatgtctgtcctttaattaaatccttctttctcagtcccacatcctgctgctataatcttactttcatttttggcaaagtgtcacctagctccatcttctttccccttttgccttagtacacacctgagcgtctattaatcagaaccactgcatggtgtgtcatgttttattgcttaaagggtggttacactctaaaaaagattcggtgagaatgacttcatggggtttcacatttattctcttttaatgactttcatatccagtgtactcggtttttaagtcaaaagataattttgaggggctgctgatgccacaaattctccctagaacctgaaaatccagctgttgtctctgcttcttacatcatcactgtaataaagaatctgctcttggaacccagctggcaagtttcttgatggtgtcagaggcgaacagacagtaggtcacttctctacagcccgtttcattgttggcgtttctgcagatctgtcttggaagcccttagagagcagagctgttatgaaatacactgccacatatcaatgtaaggaactttctgcagatgtctactttgagtatggcctgtcccagtcctaggaaatcacaccacatcgttctaaaattatagatggggggttcatgattaaagtttacaagaaaggtaatagtaacaataacagctagcatttattggatgtctaaattttatcagggactgcaccaggcatttttataaatgagtatgttcttgtttaaccctcatagcaatgctatggtgtatgttttagtatacccattttacagataaggaaaagtgagacttaatgggcttacgtaacaggtcgaagtttagaaagctactggatagtgaggccagaatccaaacccagatctctctgagtctaaatctgtactcttttcactatataacaactgttccaatgcagcatggacacgggacacatttctagttcccgctgtgatcacagtacaaggaagatgcttatttccacgatggttcagagccactggaaagatctgggagcacagactccaggagaaggaactatttcagaaactgccaataagtatagtcccttccctcctcctttctaattgcagatgagaatgtcctctaacagtcttctcaaactctaatgaacaaacgaatcacccagggcttctgattcagcatgtctggggtggagcttgtgatcctgcatttctgagaagctcccaggtgatgctgatgctactggtctgggaccacaggtcttatttctgacactctcctttctactagggttgtttttgaaggagcagttcaagccaaataacttggctaacagttcacacagccagccgactggcttctgattctaggccagtttgtcaggtcatcaggcattacacagaattcaaggagttcttagcatagagcacactgtcaaaaaattgtttttagatccccaagggttttcccctctctctggaaattcaaaatgataatgtctctaacatgtaaagttcctatttttttacattattgttatttttaacaataattatctggtaataattcaaataacaccttccctctgagaaattcaatgagctttactaaccttaattgtctaacagcaattcccaggtgaagataaagctgtctcaaagatcatagtaaatttaaaattgttccacttccctcgtttctttgccccaaatgtagtggtgagttagtggggacgggttactaattggcaaaggcccactatcataatttgaggcacagcaaatttcataaaaaggatacatctaagaaatatttagcagagaggtcattgtggggaatacaatgttagaaaaaaaagagttagaaagtgtaagataagaaaagagaaagcaaaatcaggactagctgatgacctccgatgagacatttaacctctaggtggctcagcttttctatctgcaaaaagaggaggttggttttatgatttttaaggtcccttaaaactctaatagtcccctgagaaggaagatgtgggaattaagtagctcatcaacctgttaaaccattaaacatgttaaggaagtctatttgacttttaactttttagctaattacccgaaacaaattcccaagtctacgtcaccagccccacctctctggaaagtggtgagaaaaccatttaatgaataaggcaccaaagacatcacggccagataaactaatcaggaacaccatcgtcagcttactgatgctgtgataactattttactttttaggttttagttccttaattaaccactagttaatacccatgtccataagaaacacctctgatggcttgaagacccctgggatggccctgccaacacaaggtggaatcacaatcccactgtttgtcacattaaatctatgttaattttctccatagagacctcttgattcctctttgacagttcataaactctgttaatataagttgcacatcccatgccatgagcgttagcattatcagatacagttgattcttgtttaaaataagagatcttttggatcagagtacatgtaaacacacacacccacacacccacacacacaatcatgaatttctggtattaatgaatctggcctggtgatgggaacccctctattatgtcaccggatactggaaccttcttatccagaaagcctgccacaggtcatgttaataagatcgttttaaactttgtaatgagaattctaacatgagcatgatttatgacacagcattttatttggtattatcagagtttcctataccttacctcttacagtgagtatgtgttctgaattaaccattatagtttgtggtaaatggaaaaaaaggtacagagaaacatcacagtggcattactccagataacacactctgtcactgttcccaaagtgaacatcatttccctcttcctgctcccatcacttcaatagtaactttggctattactgactaaatgcttaccgtgtggcaggcattgagccttttcacagataactttattttcttacaattactctttgaagttgggaattatattcccattttatagacgaaggaggtgaaactgatactcaggaaaggtacagttattggtcatcagtcatgaaggcagagggtagcaaagcagagttaagggccaggttctaaccacatgttctagagcttaacctataccaggctcacaatcaccaaaccactgatctgccttcattccactcctcttcatttgtgatccccaccattggcttaggctagattcttcttcatggctctctcatgtcttcttgaatatttcttgaaatttctcaaaaccttctacacttgatttatgttttccctccctgtattaataatttaatccaaaaactcattaacacttcttttcaacagactttatcaccccttttcttagctctcatactccttctaaattactcttttgaggcctcacatttgacatcagatgttccacacccagctattgaactcactttcccagaagcccaaggaacctattgttttcagctggttcattagtaggccccagttggccttaccagatgtatttgtccagtttgatcttgccccatgatcaaccatttcaacactgtcctcagtaaccatgcagatttccttccttttctaactttctatgtgcagtgcctccttttacattcatcaactgtgaatctgtatcaccattctccatttgctcccactctcagaacaaaaggctacacatgcatgctacctggacctatgctcctgcccactgtttccaggtacaacctatggcagtttttcttagtttgttctcctttatgaagtcccattctctttttcagttgatgagctagcatcctagtttaataaaaggatctacaccatgcagtgtggtaagcttattagctctcatctcctctaatatctctgaattttcattattttatttcctcaggatatatcttttcccatgttcccttcgtatcttgaaggttattctctctacttctctttatcttcctttggtttcatcagggatactttctctgtagctgatagcatatcaatttctaatagtactagattaatcatcaccacataccttttttttttttgtcccgcattcaactcctgcccttcaaaaatcttttcagatggtgtatcttaaagtgtgtttcatactggaacttcaagatgcatctcaaaaaaagttcctcagtcaagtaagtttaggaaacactgaaaactatatattctattttcaaactcgcaagtgtacacaggatattaaggtgctggaagcctaatctttgtccaggcttaccggattacagactcccccatccccctttttaatggaacacttatttaacctcagaatatgcttcgggaaaagatgctttaagggattcccctggttccaaactcttaagcctgggctcggaaattcactgactccctatcaaatgagtcctctcagatttcctttccattaatactccacatggtctaaactggttaacttatagggtgtcagaaagactaagcacatttctatctctgagctactgtatataccagtttggctgcttggaatacctttatcacctttcaaaaaattatataggacttttttctccttcagggtccatatataaaaatgtatcctttatgaaattttcccttgtgaagactgctttagcccataatgttttctgccactttttaagtacttcaataaatggttatggtttactgcctgtttgctatattattagcgagggtgtacatcctcttgggtaggaaccttgttttatacactacagagaccccagctttttgagcacagtaggatgttataaccatgtcatcggttaatataaacagaaatggatggcattaagacatgatggtttaaaacccaatttctgtagctattggaatagtttaagatgctaacagcccaggtgaaatgttccatcacaatattgggaagaaacactacccgccatcactgccattgccctgaaaatgataccatgtgtgtctaaggatgtggataaaggctagatacagaagagcaaaggcagctccgttcttaggtgaaagtaagaatttgcattagttaacaccaaatggcgataagattaaaataatctaggaacatcaagtgatccatgaaaggaatcactggaatataccaatggtaaaattaccattcataatcattaaatcatggtaacttgatgaaaagaaaaaggatattttcctacttaaggaagtcagggtaagtattgtctgaggttccactgtgtgctattgtgcctggtatacagaatgtgtagcaactatttacagaatctgctactgccttctagtcacattccaaattctatctctttgaatcagtctggagacacaatacattggtgaattcaaggcagcttggcaacgactggcacaacataaaaccccaaataatgaattccatctttcccataaagctcttttattgacacaacatacaacagcgcagggcaggttgtctcgggctagtgtgtaataactagatgttaaggggccctgagtttttcagattagatgttatctgaagttgggactcagcaggttccctaacagtgaatttttagtgggcctacgactagaagtttggtctcttgatgcttagtcagggagttttattatgtgagagagaaaagtatagctttctttcttaaaactgcagcaatttcatattttagcagaagagaaagtgcattttattagagtataacctgtggagtattttgctaccttcctggatataaagcggtatacaaacaaaaaatttaataaaaagctattttataaataagaatgtttacttgtgtttaccttaaaataggtatagcttgtattatttaacatgtgaaatagaaggataatggtaaaatttcataaatataaaattctgtgtccgtcttcagttaaaattcgtaacagtgtatcagagtgttggttattagtagtaatcaataataagtattttttaaattggaatttttattgcaggagattattgggtgggtgaagctaaatggcctagatgttttcctgtcatgtcaatacttaagaattgtctttctgggcaatttacacatgtgagagtgaaaatgaagggtggcctgcctattgggtgtgtaacaggccaccggggcaagactgctattttctgagagccatgggcagtttctgcaataaagtatctgagtttcttctttttgtagtaaaaataaatagtttacttttatgttctgggtgaagcctgagatctctggatctctttgctggatttcactcttggtgggggcagggagatactattggcaatgctttatatatattgacctagacatgttaaagattatgtggtactttcatgaacactctaaaaatgagttctccctatcatgagttgcatagatgaggagattgaggtggatggggtgaagaggaaggaaagggcagtttaagcgggctagctaatgagtagtagaacttaatctaaaaccaagattttcagcagaaaatgctttttttccccaaaaaatgccatggttgtcaacaagctttgtagcaaatctggggcagagcactagatggagaatcagaagatctgccttgtcttcctggatctggtaagaaccagccgtgtgaccatggccaagtcactaacttttgtgagtcttattgttctcacttataaagtcatgagcaaggaatcaatgaatggcataatacttgtaagctgtaaaatctctctcttgtaaaatggtattgacaataatgtatgctttgcctatcttataaagttgtgaggctaaaataagctgatccatgtggaagtgctttgtatagtgtggagtactgaatcaatgttgtctggaagatttaggaaagggtcccgaatgtgtgtgggaactgacagccagtccacttccattcaggttttaggagaagctataataaagcactggcagcagctcaaatcccactccatcctctcctctcccagcacgctgcagagaatcacttgaggaaagttacttgagtgggtgagccaaatgctcaagttccaacctttctgagtagaagccacagtgaatcctgagccacaacacaggtgacaatcactgttcctccaggtgtgtctgaaacactgggggaccctagggaaggaggtcagacgtcactgctcctgaggacccgttttctcctgtacacagctccagcccacatgatttcacctggcagccccaagagacaaaaaggatccagaattagcaggagcctcctctcctgataacctaagtgctctgattgaaaggcagagggtatcaggagaatggctgtaccgagtcggcattgatttctccagcctttgtctgtgtctggtttctgtctcgtttggaggtggttactgttactacaagcagcatgaatcatgtctctgttaaaaaacagagcttcaattgtcttacataacccctggtaactgaacgtctaataatagcaagccatttccaggtagggaatctgtctacctcccagacacacacacacacacacacacacacacacacacactactcccaatgcttcacagcacagtgagacagacagggaggagacagaaggagaaaggggacagcacaattgaatttttttgtgttttaaaatatattgaataatcatgcatcatgggatctgataaccaatatacttagctgagctagtttaataaactgtagaaaacaagaattcttctttaaagtatttgaaagtatcccaatccataccagacagacaccttctctaacactcttatactgcataaaaaccccaaacccccaaaacagagtggggtgaaaatttcactggattgtctgctagcttgtaccaactagcttcaactttcaaaggattttttttgtcctcttttttgtttgaccagagagtgatattccaaaggttcttggccgagatcatttcataaaattccagagagtgaaaggcaactgaaaacatggctgcagtgttccaccatgcagactatgtaatgtcaggcacttttgcccgagccactttctttgacggagatgactttccatctgaggacttacatttttcccatgagtacactctctggcttgtaatacatgatgaggtctttttatacttgatccccactcagctacccattaaggtggctactgaaataaaaaaaaataataggagaggctgaaaaatgatttttgaaaaatcacaaaggtaggattttctttaaactaccaatttgtttgagaacaaatacaaatgctggataggaagtttaaaagtttatggggaataataatataaatgtataacatatatacgtccatttcctcactgcttcaccttgcccatgctaggaaaaatcacttaaaggctgtattttttgagtgtgcattctcagagtgaagtagctgtacatatcatgtaaattggactggggaaggacttcgcagaaaattacagatggcaatcacatcctgccagtcatttggtctagaaccagagaagaaaaactttcttttctcttttgattgttcagtaacatgaaacagtggactagactagttcaaaccaaagaatgttttagggcacacccactttgaggaccagcacctggctatgctacatgctcttcaattgtttaggcatataaaaaggagtgatgagatggttatatgtcaaaatggctgttctccctccaaacaggatttgattggcttatttgcttttggagtactctccaaatccataaacaaaggagtattgaattgaagaagcaaacaggagaaagaaaaaggctaaaaaggaaaagagagaagaagaggaaggaaaaatactaatttctcagtattcctatctgcaaatctggctggatttgataacaaaactcctactactgttctctaatggtctttgctgcatgccatatggacatggcttctaaaggggatgaattctaggttttcctcacaaatatccaagcacagaacagcagggatcttgacgactaaatcatcctaactcacgacgaggatcacagaggtggaacatggctgttgggactagattcttctgcttatttcatgtgctttgtgaattaaattgttcgtagagttggaaagctggtggactaaatgttttaataaaaacagccatgagacacaacagttttcttcacaaaggctttcccccctagctactgtgaatatattgctgaatggttctgacttctggaagggcaggaggtttgcctcttctctttgcctcaaaaaccaggcttattctatgcatctgggagatgattatacttacccgaaatttcaggatactatgtcagacagttccttcacagtggtgtgtctggcacctaagcaaggacttggtgggccagacacatttaaaatgtaaaagtggatgattatattattttgcattgtaacaatgagagtatttctggattgtagctgacgtgtagatcatcataaccatatgtggcacaacaaaccacacaacattgcatcagaagcttgtagttaatatttttaaatgattgattattttgaaatagagaaatggtggatgcttttttcgacctctttaaataaccacttattgaatgtctattgtcagtgatggactctttcttcacagaagggagctgggctatgccagactctcaccatgttctttctcctctaacactgaacaaaatatcagtaaaacaccaagtacagctggttttgaacctagtaagaaatcagtctgtagtaatgggccatattggtaataattggaactggtgatatcgatagcagtgggaataactgacttacaaaggcacagcagttcaggaacgtctcagggactcagagtgggtaaatgcgtaaatctgctctcacctatttatatgctccaacaaatatctggaactctagaaacttcaagagtctaatatgatcaggccacgtttataggtattataggattcatataaaataaggaggcatacatgttgatctagtgagcgtctccatatttgtacaacactcaggatatgtctgagaacacattttaatttttagaatcagctatagaatctggcagttattataaagcaaacttcacttcaaaaaaattaactgagaagccagatgataatccagatatacaaaacaacattggtgggataagtcaaataattctctaaaatgattatggagaaactgaagaaatgaagggcacctatttatcatatgtgggtccccagccacgtttgtaatctgttgtgtgaccttgggcaagtcatgaaacttctctcgagtctcatttttctcatatataatgtgggagtgttagattagatggtttttaagattctttccagtaataacatttgatgattctaaagtaagaagagatgaaagagtaattcctctttcctcttgttttggtaaatacttgctttctcctgctccgtgcctatgcagtttgcagtgagtattaggtttctggactcaagaagtcaaatagtaaatactgaagctatttttccttgtacacatggacaaatcataggggaataatccttcctttctttgtatatcagtgtctcttctcaaatcagacttatgcctaaggtaatcacgatcattctggtactaataaagatttttcctcatccttcccacaaggccctcacccatgctcatgaaagcttatgtgattgggttatttctatatttatgtcttggctattttttctctttcaacttgtttatgaagtccctggtaagcataaagctgcaaaaacaaaaacaaacaaataaaacaaaacagctctgtttgaataatttacttcagttgaagcagtataagaaaacatcctaacgccgaggggaagaaaacaggtcataaaaataccctggtatcttagaaaagactaaataaaagcttatatcaataatagtttcatatgttattgtctttcattttcaaagagaatggtacatattggctttatagtctggtgtacagacgtggctatttttccccatagctctcaggtcagtgcatcctcaaagccaagaaggcccagagcctgccgagctagctttacataaacaaaggagctacacagaaaacccaatacccggagcttatatcatatcctgactaggcactctggttacccatgactcgctcttttccatctgtgccctgattctctgctggtttaattcccttcacctagaatgccctcagtttgcctccttttactgctcagaattccctctggacacaactcacgactagcataagccccatttccaagaagcagcttagtttgacccaacttagtttgacccagcgaaaattttcatggatagcaagtgaaaattagtccttgtgataactggagtcactgaaaccaggtatctaggaagcactcagagaataccagagaaaaactttcaagggttgcagtgtcctcataggaggaaaaaaaaaatcctagctttaagaacaagcccaatatagaagctgtggtatgtaagagaaaagttgtagccatgtacgggaggaattgtgttaaaacagtctgactttttttttccaataaaggagaagagatcctctgtttcttaaaagaagtttagtcattggatatagcaacatacagtgtcataaagtttaattgcattaattatgaagctaaaatgtctacattttagtagagagaacatggggcatagctaaatggcgaagacataggaatgtgtatacaatttgagtttcacttcctccaaatctctcagttagaggatccctctcagtctgacggtcttatcatcaacagcttcacaaactctgacaacacctggctgggtttaagggatgggccatgatatatcttgagagtaaaagatggaatgaaactcagaaatgctgaatgcttttatatatgtatacaattttatttatgtgtatatttatatatcaatatatacaaacatatatatttgtatgatgtttggcaacctcactcatggtattcctgtgaagtaggcatgtggtaaacataattagcccattaaacagatggtagggctctggcatatctcaccatattctaaaatggtggagctgtaagcagggactaaagagagtgtagtttgatacatggctaactgcaaatctctgtgaattgctactttcctaaagacaatctgggtaggctgcatttggctgagaactggggatagtttaggaagctttaaaaatatacaaagggacaacttttcacattcattcagatatagtatcttcatttttacttactagaggcatttttttttaaaaaacagctttttatcttaactcatctgtgttccaagcaaacttccaaattgctgagcagattaaaaaaaaaaaccctacatgccaagtagaaacactgggtaaatgttattttttaaaattgtcttaacaaagtgcacttttggaaaggataaagttgaaaagacgtttggtactgtaaacacttagctgtcattgtagcacagtgaccaaatacgtccaaaagcacatgtaatgaacttttatccgactgaattatatgaccatggcattgccactctatagtacagcaggcttcagagatcctgttattaaatattctagcctaattctttatcatttgaaataggatctagcagaagtgaaagagttactaaaattaagacttgaatttacaagtgtgtttgaactggcttcaggaagacatgaaacatcaatacatctggagaatagaacttgcaattgactgttctttaccatctggtctcaagaacattttctgcttggaagttgcataagcaatgaaaaaacacacaaacaacttcctgtaccatgtttttggtcacttataatgacgcattacaaagtaaaccagctaaatatgagcaactgcgccttactcgagatgacaacatacattatataactaagatcaatgaaaaagaacatctttattttaagagacctggacttaaaatattcaagaataaacatccttccttctaaggtgtttgtactccttctaaggtgtttgtactgagtagttttggctagacaggtttgtagagtcactactacaaaacaatccctatattttttcaaactgaaaaaggatataaaaaagcaagctatattgaggaataaaatgttccatatattttaaaatgttttttaatgacataaacttgcctttttaagcagtaaaatatattctacacatgtttttcatagaaaacttttacatatctttgttttcttaaacacagtatgttgatgtaatttaatttttttctatgatacagggtcatccttgtgactattcattgttcctgttttacaggaatacacttttcttacttgtggtgagaactggcctcatcccttggctcagcctaacggccacagactgagctatagcccactagccactgccatagccaactggcgtcactgtcccagtttttcagacccatcgcctctaaatcctctctgctaaatgtattttctaatgtgctttggattagaaaatcaaataaataagaactgtagagacaatactgcttgaatgcagggtttggtagaagatttgggggaaactcatttggacacttgaaggtcttcagttacttctttgctcagggttgtaactcagagatctgaactaccagaaagtggattttgaggtattattgtgtaacacagagtgaaacatttatgcacttttattgcaaggcttcttattttaaacagggttgtccagaaatccattcttgattactttacttgataggtctctgatccattatatttcactcccttgatttcctccagcaatgtaactaacataatgacaattgggaagtaaagaaatagcacatttttaggataaggtgagagagtcttggtaactgacttcatcatagtgatggaggcaaaaatatacagtcaagttagaaaacttccctggactgctaatgggaactctggcctgactagacactgggaaaacattaaaaactgtgaagttatttacattaattttcagtgttcagagaagtaacatctgatcatcttttttcctcttctccaaaaggagaagtcagaataattcgcaatctgtgataggatagggattgtatcgaaatttgcctttttattacctctgaaaataggatttctaagcaaactaataaccttaaaactgttgggaggaaggatgggggaaaccaaatgtaacctatatgaggggggggaaacatctttaactactttaacatacacacatctgataagttactgaaaattcttatttattttgaagttagtgctgaagaaactctatctgttaaaacttagaaatctcagttcaaagtacatggaaatattccatgatcacgttttcagctcattctagtcgtctgtctcccagtttatttgaactgatgaaattttacaaaataaacttctttagctttctagagttacgtttttacccatgtaatctatttgttaatttttgtagcatgcttatatgataaaaaatactatgtaagtactgagtttgcttgttatggattatttctggatacagagaatttgcaagaaacttcagtttacagcagccaaggttactgcagactaaagcagaagttcaggcataaacttgtcttctaccagttttccacaactttgctgttgacagcatctgaggacatggttgatgagttctgaaaatcattcacaacattgctaatgtttaggaatcttatagctttgccggacctttccataatcacgagagaaaacctttgacgaaattagaacaagtcctcataccctcccttcctttcttctagtgatttttttttttgtattggaacaatcgaaagattcaatgtttttaaattccatagaagactaacgattgaataattttctcacatctctgtttgcactttcgcagtctggttgcattgatttgtgtctcacaagtagacatttcctttgttggtcacaaatcaatgctacagaacaaacctgccagcacattccacccccacccccaattttttgcagtttaaaaacaaagcacatttatatactttttcttttaaaaattactttcattggttagtaatacactaaaagaagacaaagcctcagagttaaaaatccccgggagaaggagctcctctctagctggtctctgattctctcacactgcctggagcaaagaactgcctagtgggagagcagcgctcgtccgccgtccgctcctggtgtgctctgttaacccaattaaggtcctcgccttcatacatcacaaagctgcccaaagcaacacactgtgatgtcacagtcagatatgatttcatggcaggaaaaaaccaaaaaggcagaaaaggttgaacgtactctgcttttattcaaatcttctaagagggggaaaaagggaagacttttttttttttttttttttttttttttctgagagaaaaagagcacaagctttctgacgtgaatgtgaaaactccgttctgaagataccctggtgcttttaccccaagtggataagcatgaataaagaagcacaaagaaacactgtcatcaatcagaatgctcttgcctacacttagctacaggtggaaagcaagcaggcacgatttgatttacctagattaaaagagcaattttctatcttccttttttccttttaaaaatagccaatcgattttggcctagctattgctgactgtacaggtccattttaatacaccactgattaaacggtatgttcatggctgaaggcactacagcaggaacaaacagaagcagctgaaggaagggggtgggggacaggcgagagctccaaaaaacactccacgaaggccacaactactcggcacttcccccgtagacagttgatatagcacattttaggcttgaaccagctataattctgggagtttgaagcctggaattcatttagctttttaattctgaccttaagaataaaaaaaaatcaaagctatgttttttaaaaaacacaaatgagggaaatattgtgtcctaaactgcaatgacatctgaaatgaagatgtgcctcagaaagatgcttcttatgaaacacttgaaatttcataagttatagaattatctactgaaagaggacctagttgtttagagactttgtttagtgaaattgcatgtaaaagaaacagaaagaaaataggacttttatatagggtgactatatgttgggattcatcaggcagctctcagaagagggagaatatctctactagttctagaaaataaccatcttgattatcatgagaaagtatagcctttatcgaagtctgggtggcaggaaaaataaattagggagggaccttctcaggcaactcagagagagacccaacatccagcagatgtttcttctgagaaagacaaggtccatctaacaggtgagacatcagctgaacaatggatgccaggacatgggaagtggctctgagaatcagcgaactccatgtttaaaaagtcaacccactttttttttttctgtttgcttactgattccttgttcccttctctcctgttttctctctccaattatcatttacttaatttgaaattctggccttaatggggacagaaccgtatccagaggtactattaagataagaaaattcaggaagaaagatttaatgaggggcttaggagtttttggaagaggaaaaggacattagagagaaacgagggaaaaactaagaaattaaatatcagcctcagcacggtggctgtagaagaatagcttctgagagacacagatggtctgcattctccagaacaaaaacaaacaggaagtaacagggccagagccccctctccccttcattcctctctccagtgtaaattggaaaaaaactgaaatgtgttcacatcaaaaagttttccttcaaactctagcaagtgaccacagtaaaagaaacaagagagcgctggttccagcaggtaaaatgctgaaaggatgtcacatcgtgggggtgaggaagaaatcagggattaaatacatacagtttggagaaaaatcaggctctatagctaactaatgatgaatggagcagacaggtggcagatttgaggtccggaggagaggaagggctccattttgagccgcccattttctggaggagaggtggtggccgctgtggaaaatggctactcctggggtgcatagggagacaactgacttagtggagggaagggaagaaataaactagggagtcatccagggacacatcgagttagtgagggttttagtttggatgataacaagctcttaaaacatggctttgactcataaaaaatgtagctgggatggatggctacttacagggttaaaagcaaactgagagctcttctattcccaaatctgaatgctgaagtgctgcctagaacagcaaacatgtacatgcaaaatatcaaaaatacacaaagtgggggtgcagaggaggtgcaggatgcaccagtcacctccttccccacacccttcaacagcacagagctctggcagggtcatcaccagtaaaactggattcttacaagccattccacagagagaaaccatcccaggtcccccatggctccaggcatcagtgaggacagttttcatgttccaaaactaattggacagtaaggagtgtctgtaagaataaaagcgggtgggaatggaggatggaaataaaagggaaaaaaagtgtccttgttgaaagttttaaattacaggctcagtaaaaaactggcattccaccacatccggtctagttaccaaatggaaaaatagggtcattaacatgtttatttgaattacattagtccttctctttcatatttaatttattctgttagaaaaaaacacaacgctctgcatgctggtgaaaggcaggggtgtaatggatcagggagctgaaatacaatgatctttacccattatctaccctgctaaggcttttcagaacttactaggatcattcagggattcttccctcacaagggagggaagggtacagaaagatgtaaggtacagatgctactgagtttgttaaaataatattgaagcacatttaaattaaggagtggaaggacgattttaatatggaaagtttacaaaaagaagaaaagtttgggataaatgacctcttctgagactgaatgtccagatgcaaggttggtgctaggcttacggaacatctccacatgatatggaagttgtagaacattgtgttattagtattcggggtattaaaaggcgaagtctgcaggatgatctcatgaggcttgctgtcatccacaagaggtcagggcaacttcagtacaagcaagtataatgcagtacattcaggggaaaatgaaacaaggtatattttcaggaagatgtccagaaatgacctggctatctttgtggcggtgacatggaaaggacatagacttagtatcataaggccagtccctgctctacaacttactaacaccatttgcacaagtaattcaatcagttttcctcatccataaaatgggaacatgaacagttaccatagagttgtgaggatcaactgagacaatctatgtgaaagtgttctataaagcactgtacaaatgtaagacatttattttctgaagacagtggtgccaagtgtgagccaagcagtgtgccaaatatcctcagaaataggattggaaacaaagcagggaatgctctgacaaagctgaagaggacaaggatctcccatctcagtgtgactgggtgtatcgctcactcaaacctgaagggatttctcaccgggatgctgaccttgggttcatagactaactccacagtaggttgccacccactcataatgagtcatttaaagttcaaatcttacttcatgctagcgatgctagcacagaggcaagcagttttaggctttttttggtcacagatttctgctgccattgtcaaaacagtagccccaacctctaactgcaacctagggcagccagcccaacctagacttgattctggtcacttttagtggaacaaattggctcagaaaacatcgccttctacttcttctttaggatatccaaaatgagcaaaaacttcagtctctagcttttccttaagacaagtttctccctttgctacaaacggaatcacatctttttgttatgattcttcctctatggtccagtttgttgaacattttgccagctgtttctaagctgaactttggcttaaatacaattgcagtcacactaagatcattctgttttgagcccagagcatagagtgtaattttgatagaggaaggggagagttaaattacgatcagctctagtaaaaggtaacggcaactcatgggtgggatactttctggatgaagtacttcaaaaaataaataaataaaaagaataggagaacgttcagtattaattaaaataatcatgacataagatgaagatttctatttataatgataaaatccaggcaaggatatggtaaatgtctataaagaaacaaaaggtctgggaaactgactatggatttctttttcaaattctagtatacgtgaactggaagtcatcttactacttttcaaaagaaacaatttatgacaaactaaagaactactttacacagtaggcaatcaacttataaaattcattaaaggtcgatgacataaatagtatcacaaaggtttagctaaattcatggataagtccatagtgggttattcagagaaactaggctatctggaggaaaataactctaattctttaagttagcaacaaggacaattgtgtcttatataacagtttcctgtccctgtgatcagaaaatgaatgctgaactgaaaggaccataagcctgaaccagaggggcttttcttataatcacatgcttgtaagaaagtagggactaactatagtgctgatattaagcctgctggggccagaaggtgcacaaattcttgaacctgcagtcacatatgtcacattacctaagctgtattatgccactccttctctgcagcaactattatcatctccatattacagatgagagaagtaaggatcagggaagttcagagacgaaaagtaaattaacaaaggtcacacagctggtaaatggcagatttgggatttgaatttaggattatctacttctgaagctctgctaccacactgctgctgttttctgcccagtagcctgatgtattaacagcttaagatgactaatttaacctgttaaagcgatatgaagtcttgctcttcatttgccttgatatctaaactgtgtgtgcagtagcttcttgtcatcaaatcatgtgctcatctatggctttacattaaagatgtctccagctctcattaagagggaacaaaagaagcaaacagatcacgaggaggtaaaaggcatgctgctatggattattatagagtacctcagactataatgtatattaacagaaactcttctctatcaactaatctaaagactcattcttagttttcctaatctaaactcaggtactacaatagaagtaatatccaagaagtgaatgaatatgatgaattccaacaacctccttgctttggtgactctaatgttgaatgggatatcaaaatggaagatgagaaacacaagaaatagctgggttgggggagaagcacgatgaggagaagaaacattagagaagaatccggagtttactttcccagactctaatttaatctgaatgagctttgtttctccacattttgaagaaaatttaagtttagtaataggagattgtgtaatgcaagagtgttgctagcctaaaggctgtgataacatatcttaggagctctgtgtccctcataacaaaagtaacaaacctttcaaaattatttgtggccttgaaatataatacaaaatacctgtatcttaatttctatccttgtaaaatgggaaaagttatttttatatgaaacaacgaatacataaaatactatatatttatataaaatatataaaatataattataaaatatataaaatataaaatgctatatgatagtatataaaatactatatattttatataaaattattatatatgtttacatgtgaataggagctatttgtgagttttattaaaagtctaggtaaaagtaaagtcatctatactcctttctctggggttctcttccctttccttttgtatatttttgctcccctttctctgccgcccccccgcacccacccaggattttaaccacagatgtaatgggtttctgtaacactggcaactcatagctttcacaaatgttcccttggctagggaccacccaaatagtgaccaaatagtgactctcactggctaatgaaaaatcaatgtggtttgatatcattaggacaaggtcaaaataatcctctaagcagaatttccttacattccctcaacaccaatgtgacaatctcgctgcaaacaaggcatagggatgtggcactgctgaacctggtaaagctatgtcattgttaactgaactaaaggaactatcagtgccaaagaagaaagagagtaagagaaaaatgtcagaaatgactgtctagattcagagaaaaacttgatgaaggggcatatagggatggaagacatcttcgactgatgaccagcagctttgaactctgcttctggctcttgatacaaatttgatgtgttgggtggtacaaaatcactacactgtctaggcctaaatgccttcacctgtaaagtgtgggactcctttcaaatctaaagttctgattttgtgtcttgtttggctggcttactcggttagaacataggtttaataaggttaacattagagattcagttttcatataaatcagatggcctgatataatactttgcacatagtacttaataaatatttgctcaatgaataaatgtcttggaatagagaaaaactctatttcatagtcaaggattctaatttagggttaaatggagtggggccaagagagagcacggggcttgatactaatgcatctgaactcctgggcgaaataacttaaaacgtgggtctcactgacattgagtcagtggtatcaccatatagtagttgtgctacaagaacaatcttactattcagactctttgaatcacctgaaagtgttcttgccagtagcctcttcccaaaagagataaccaatcctgagagaattccctgattttaagattgcataaatagctcatcaaatccctacaacattcagttgggatatgaaaattacagatatttttttcctcttcacttttcacatggaaaaacagaagtctgcttccattgcagtcaccccatctcctacaggggtgggaaatgacttagccagtattacagattgagccactacctctttgtaaatactatagttgagcatagaatttgcccacgtatggtacacccagggatttaggtggcaatcacatgccagaattttgctttagataatgagaatcaagtcataaaagaacttgtgaaaataaaaattgagacacttaataatatcaaccacctgatcattgtggtcagacatatgataatttcaattccttagcaatacttaaaaaaaaaaaaaaaaacaactaactaaatagagggattagaacctggaagataaagaatcaaacattagaacaagtaaccttggatcataaatattctctgacattttcaatttgcttgcaacatacagggttttgttttgttttggttttgcttccatgagtgtattgtatcccccactttctccccttctagaagctggctaagtatagacgcagacggtgaaactcaatcgcagagtgctgacagagcttctcttagggtctacagaacagatctactgagtctcacatctcttggtcagcagcgacaggtaaacactagctttattttagcagctcagctgcagctccatgggcagctgtccttactgcacataatcagtccctcttttcagggggttataactcaactatcaaaataccaaaatatgctccggtttgaaacttggtgtatagagtcccaagcccaggaatgaatgtggtttacttccaaatttaagaaaatattgagttttgtaggtcatttatttactattttcaaatatgtttgaagaatcttttaaatgccataggaaaatgtactaaaaaggacacaccattttaatacctttggtgattcattctgaatttcagcacaccactgaaagaaccaaatggtggtggaaaaaaagagtttgttttattttcttaccaaatacagatgttttgaccacttgggtcctcatcagtgttcaaaatattagtgtgttgtaacataataaaataaaggcgttaacttctttgttttgttcttttcagtgatgtgcagaatggattaacgagttcttgtttctggccctcgtataactcaaaaactcgtttcaacttaaataaattaagtaagtaattagttcataatatggcctaatcacctctggtattttgaaacaaacaaaaacacaaaaatggctgttgcacatttgcacttaattacttccacagaaaacactcatgtggactttattacaggtgacataaatttcaaatctaagctttgtttgtgatagaaacctgggttatggtattgtgtagacttccacgaagattctgtaaccgtccctactattttccttaagaaaatgaaaccacagtctatgaaaccacattcttgcgctcttaattggcaaaagaaagtgctttatttcaaaaactctggagaatagtttacttcctacagaggctcaaaggacgttaatataaaaggtagtatcatttctggaatttctgcagtgttcaatttttgctcttggagtctgaacagttcttgtttgcatacacgtctatctgggaattgctcttagtgatcaggacagccttatggaaatccttccagatgaatatactcaatagagcaaaaaatcttgctctgtctttaatgtaaaggaaaaaaggacttttaaacaagtgtgtaattgtgagttctagccttaaaggaactttcttggcttggatttcttctaccctccccttcagatacttaataatcaaagtatatgccaagaaactaatgatgcaaaccagagtattgcacatgaacttggatcgctttcccattgtgtagtgtgtgtagtgaccaagattggacccaaaaagtcgatgatagaaaatagacaatgcaacataatcaaggtacgcccaccttgggtaaattcactaacccatttcctatccttcataaatgcatataatgattctcagtatagattctgaaacttctaggctaatctggccatcagctgtgaaaggaagaaggatcaaccttgattagtaaacttccaggtcatttgcttggcatgaacccactgatgtgttagctgcatacctcacaattctttaggtgttatctgatgttaccaagcattcctgatgccctttgaatttcaatacagaaatctaagtacaactaaacatttccccaagctgtgacagccttatggctattactcattttagaactgagaccaacttttcttctgacatttgacctgggagagtttcttctttagctttctgagtcatgcaaatttattcaaattctgtattgcaacccttgtcagttgtggccatacattcacttagtgatatcttacacacaataggctctcaataaacatttgctttccagaatgaaactagccttatcataagaaaaaatggaatagatttcaatagagttataaatgaactagaagaaagactaatagatcttgagtatattaaaaaaaaaaaaatcaagcagtgagaacagttgggttttgatacagtttcccaagggaagtagtagaagtttcattactcagggcattttaaagtagaatagacaaaacactagtggggtatgttgaaataaaatatgcgtagtccgtctgtgaattagtgtttactttcaatataattataagtgaagcaacactgtaatgggaatttttcatacacaggaaagctatggctactatgtttccacatcgaccatatgttgcacatattggttgctgtggatgtgtatccctactgccctctagtggatgaaatgtaagacctacctgattaaccagatctaacaagctactggtttgggggtatatcaatctttaatcatttagggtagaaagaaaatagctgtgttgatgcattttccatcaaattataaaattgaagggcattaaaaacaacagaatcaaactctgtaattaagactgccatttaatgtttgttcgcacacggtattcatttctgtgtatccctgccaaagatccattgtgtaatgttgtcctcacatgacattaaaaacaccagttccctggaaaatacaaaaaagaaaccgtgctgccttgaaatacacggagttcactttcagaaacataaaattaatacagacacagtaacataatttggaacacaaataatggctacaagaaacttgaaaaccaggactgctccttaactctgagcaagcgtattagcagtctatgggtgtgctggctggtagtcagaagagggcaagcaaaatgggtttcagaacagggaagctgatttgagaaaggactgactaaacacatagtaatagggcaggaaaataactctaaacacacatttggtactgtgggtatatatttaatgctgtcacattgaggctgcttttcaagtgtagcacccagatgctgtactcccaatgaagaaagatagggacctgtacagttctttggcattttgtcattaagacacaggacaaatctgaaggccatcctctttgtataattttaattattttacaggatttagactttaatcactaagttttagtctcacacttagcatataaaataattctcctaaaacaccaagaggaaacaattatacaatctacgttgccaaaacaactgacataccaaagagaataaatgaaatccgaaagaagagaaacataccgtgtgcatgctgagtgcaccagggcaatggcccttattatgaatgtgggaaataaattggctaaatctttaaatatcataaattgttcgaagctggtgatatgtgagtagatgtacacttgaggggaggggaactgggtgggcatggcccagatcgctctctgagttagtgacagtttttacagtacataatttggtaaaaaagtattggtttagtaatgaaaggtaggtcccaatggacttctccttgtaaacttaaaaagagcaacagacttatctagatagagctacaaagcaacatgaaaactctcattacctgagtgatctagaagaaaatctaacttgataaatatcctggaagcattgttttcatctcaactagatttactgtatagcaattagcatctctatagatagatatggggaagcccaggagagctgggggtaagcagtatgggccaaaaggaggaaatacagccaatttcctacttagcaccacggacagagctgtcagcagaaagaaacatccttggagttatccttggtgttaaagaaacacaaagaaatcagtgttgcattttaaagatgcttcttatccccattgcgactggcagtctgggttggaattatgttccagtgcttccctgtagggcacccattggagctgaacgaataaaaaggtgtcttgcccgcctgtgcacatacaggaaggaaaggttgatacaggagaatgatgtctccttgacttttgtctgactcttctctggtttttgaaaaatcatagcactctgaagaatactatccagtctttcccatgtcaagacaagtccctgtgcatttcagccttagggtctctagggcacagggattgctctggggcacaactagggaaagggaataagtaaagacaactctaaaaggaagtaaaatgccttctattccatctcatgttatagaagattacaaataagaccctcttcttcctctcagttctggcctttatgaggtggaagtcactattagactctataactgaataacagattctggaaaattagaactatctctcttgcacttgagaagtcagtgggtctccttttctgtcctgctgaagccagatacagacaaatctagagaaccagttttatgaaagaaagtagcctagcacaaattatttggcattaaaccataccatcatttgctaaagacttggagtcaaagcttttctcatttgattgttaataagaagcttatatttctaaaatatcttgattaccagggaacttgtgggttttggctttaatcaattcttagggcttttcctatcttttgtttcttagacctttatgtccacaggatagtctagagagttgaaatttactttttgccagctcactatgcatgttcaccaaatggtaaagttctcactttaaagcccagcaagacaagatgagctctgtctgcccagcagcctttcagaggcattaagggtaagagagaaggtaagtaattcactatgcgtccccatttctataatggggaaggacgtcttgatacatttacaatactcctctggggatatttcatcagttatacctaaactctaatggacaataattgatttgaactttccacttagcacagagctgtaaacagcttcactgcagacggcagcaatgagccgacgttttgtaaagtggagagagattcagaaaacttttgtactgggtcatgccgtagcctaacagcttttgaatccagggaagaaacagtttgtcctcctggttttaatagctgggctaatcgagtttcaagcctgcagtaggtataggttatcttttgaaggcattccattttaacccctcactattatgatgggtttataacctagccataaaaatgtactcctgatttagacatacatcaggacacattcaaaaacataactttctgaatgttaatttcctggtgaaggaaaaaataagacattaaagtcattttaagactacagattttttttttttttaactctgcgtgggtggtgagcctttcagggaaaatattccctctcctccagtgtccctcatctggttgacaccaccctgtctctccctctcactcaacatcactttgtttcgggctgtatcttagtgcaatctcccatggaatggccccaaagactaatctgctacaaggcatgaaacaagcacaagtatagctctgttccatgactttcttttatagcctccctccagccccgttgaacacacaagtagatgaagtttagaagaattctttcactatttaaatcagctcttctgtctcactacggcatgatagagggtaaaatgaagagaaatgaaagactaactacattttacttagaccactacatcgtctgctcagtctatagctttcctattttgttccacactcctggaattctcacaatgggattcaaagctcacctagaagccactcttagacaacaaaggacacagtcccctttggagttgttgctgccacttctcttgtgtcaaagatctacaaaccttgtggctgtgaagtaggactttatgaacacacagcaagaaagtatattttgtgaatatactgcaaccggacgttacccgccttacatgaatttgacatggaatatgaattttccctcaattcagctgataagattgtaagagcaaaggcataccactgtcagaaaatagatttaccctgcacccccaattgtaattccctttctagaaatctacagaaaaaataggatataatcagacattttgtaagatgttgtccagattctgaaatgcattaaaatcaaactgaacataacttgttccacttggtcctgaaaattacattctgtagcttctagacatcaaacttagttctggttttgatgtaaccgctgattatttaggtaacactaagcaaggtactgaaccttacagagcctcaatttttccatttctcatttggggagaatgacacctgtgtgttcttatttattgatggatgagatgaaattatatcataagctactgaaaaaaatggtgttatatatattttgggtcagtcacctttacctttacagcagcatgaccaatgattggcaaagtagtcaaagtctacttcacccctcctgggtagaaggcaacatggaaagggtattttccatcatttggcagtaagggcctagctctacccatgttcttccccaggcaagcccttttctcccataatcaaagggcaacattttaatatttaatctttaaatcaaatatggcattctcaaatttgatttaaccaatgtctaaacttcactgagctttcagttgagccactaactccctctttcactgtcaagcttccatggaacactctttaaccacaaaattttgtacaatggtacctagtgagctcaaatgactttctcactgatcaacaattattagtctgtaaggagtttatactacagaacatcactctggtgtgtcaggctcagctctcatagacttaactaagcataaaatgtgctttacaaataaaatgcttataaaagttaacaaagaagttaacaaaagttaacaaagaagtggatgacttacattcaccctgtgttttataccttggaattcaaagttccatacttaatggaaatggggaaagcttagcaagggttcagagcaaaggccaaagaaccttccttccttgtttgcccaaaatattaaagagataatttgataatggtcattagtaagatgatgtgttaatagatgttccttacctataactcagattaaacatttaaaaagggggtttatgaagtatgagggattgagttgagttataaaattattacatacttcaggagatgttaaatcctcatatgaaatactctgatgttccagtgtaagttttatgaaatacatttgatccctatttatctgtgacaatttagttaacatgctactagagggcaggacaggtgaaccagaagagttctaggctttggcatctcataaaagttaaaaatgatctgtagagcttatcttgaaatactctttcataaaatgtatgtgtatgattcaatgactgagccatcccacatgctaagttgactacggtcatagggaaccaacctcatgtgaactgtttgatcccattattgaccagtctttatcaatgcttggcagaggtcaaggaagtaaatctaacacctataaaacaaataagcgatttccttgtttgcttttgaaaatgccacttactgattttatttttctttacagttgttagcagctgtacacggtcatattataattgtcacataacaaccttaattcagggacacatcttttgaaacaatgtattattcagcaactttgggtaaacatgcaatttaggagtggaaaagatgcacacagacacaagtaatcatagatacaaagcatggtgaatttctgtgccatgcacttcacaccccaactcatctcgcagggaaactagagaaggggcagaaccatttctattatgataattcacaaagggaggccatatagatatgcatgcaaagtctctccccacctctccatttacatgccaggatttcaactctgcgacactgagtcccttcatttagccaattagtccttccagcttcatgtaatgcacgccaaaaagaaggagaaatagaagtgctgacgttcactgctttgaaagttgctattctaatgccaaagctgcctcttgagcaatttccagaatgtattaacatgggagcaaagcgctattcctaaagacagggatcacattatgcaggggagccccgtttaacgtgtcacaattgcacagaacctccatcccctgcacgatcttacagttgtagtttgcatgggctcaagtttacggtctttacttaggtgaaacttaggaggtcttcctaaagaaaagaagcaatttaaaaatatctagtaagcaaggcatggcacatcttttgtaccatggcattgaccaagtccttttactgtcattctgaagaaagctggtcaaggtgtaaagcaaaccggcctctcagtttaggacagagtgaaggattcttcagtttctttctttctttctttttttaaatcaattaagtctaggttcaattttaattattttaatttggcagacatccctagaattttccctccatattaaggaccaagttgaaaaccattacataattgtgtagctgtgtatctgaatgccctcttatgcacgtgattctgatacttagtaggcaacaaggtgtcgctctgaaatttgaaaaaccattaattcttcagctgaccaccctgtttacagctgaagcagtgatagagattttaatatcgccttctcccttactcttggcaatggatttacaaaagccagtttgtgtcagcctggccctctacaaatttagctgttctttgcttaaatcatgacatttgcaagagatgactggacaagtcccccactgaggcagcatagcagaggtgaaggggcacttgaagtcctatttcttctacacgttgtctctgcttacttcgaccacatctgtcttctaggtctccttttcccaatacacaaaatttgaatactgactgagacgatcctgcagggttccttctagcccttttttgcttttttaccctaaaacgctcaaaatgatttctttctatgtctttggcttctataatttataatcttggctcaatcttctcccttcatttatttcctcaatattaccttttgtaactcttaaatatgctgtccctcaaagaactatcttaaggccatagttttttcttcttatactcatgcatctgaagggctgatgcactcatccatcttttctcataatctacctcttttagttagggttaactaagttagttaacttagataacactttctcttcagaatatctctacttagatggctgctagcccctcaaaacccaaataataaaaagcattctctctttccttttaaatcattctgctatacaaattctgtgtaaccacagtctaatatatccaatgcctcaatcttctgctaaacgttcacattttaatatattgcttctcatatagagccacttatcaaatttagaaattttcttatgatgatgttaactcaaatatacctttttaaactaatattcttggccagctcctaatcacattgtacctaggatatgaaaattgcctcctcagccgggtgcggtggctcacgcctgtaatcccagcactttgggaggccgaggtgggcggatcatgaggtcaggagattgagaccatcctggctaacacggtgaaaccccatctctattaaaaatacaaaaacaaaattagctgggcgtggtggcgggcgcctgtagtcccagctacttgggaggctgaggcaggagaatggcgtgaacctggaggcggagcttgtagtgagccgagatcgcgccactgcactcctgcctgggtgacagagcaagactccatctcaaaaaaaaaaaaaaaaaaaaaaaaaaaaaaaaaattgcctcctcactccaaacatattctcaatggtttgactgtcacagttccctctttagtcctccagtggctttctaccctacttcagatcaattgtgaattatagactcccagcactgaaagccccctccctgtaggtctgcttgtctaacctgtcagcatccggtgccactaaggcccaccttaatccacacagcaagtcgcttttgtcttctggcttccttccgctgagaatacaccctctccatctctgaactttttccacataagcctgcatctacggaataatccctcatgcactgaagaacatctttccttcattcagatgataacttaaacctcacttatgccagagagatttccaagatgattaccagccaactgttaaccctctaaaacaaggtaagaaccactccacccacctttccacacatttcagaaaaaaattatatttttaattgtgtattgtagttgtttataaattattttgatggcagcaaaatatggtatttaatacagtttatttattgccttgcaacttttaagtcttgatttcaaattggtataaaaaacaaaaatgaaaaaagtcccattttgttactttaatatatataaagccatttaagtctcatgctttttgagatctgtcaaccgctatgcacatgataggtatcactaaacacacacttgttgaattgaattgaggaggaaccatcttaaacagtttactcacagaggaggaaggaatcagaagactatgaacataaatattccatagcagcatctgagtgtaacaagaaataataccaaaatgagagtttcccaaatttctctcaccctcttgattgtttaatattatattcataaaactatatttttaaaaacagctttgattttaaaacgttaaatttacacaccaagaagtagacactagcaaagtctcatagtctgatttatttctctgtaatatatctgtcttgagaacatcagcaggaatacaccaaagaaatatgtccctcacgggatcaactatataaaaagacagaacacatcatcagcacaaaaatcattatccatctaatttctcccattctagatggctccagtgagcccctcgatcattactgactagggttaagatagagcttaatggattaattaagccaaagcaggactgcaatgcagaccgaagaggagaaggtcctgacacagatgagacaacaactctgttcctcttttattcaaatgtgcaagacttgcccacccccaagtactacacatttatactgtaaatagtctccaaaaataagatttggtgtctgctgtctgggtcttcccctcagcactcaccaacatctaatacttgggtgttaatcaaaatgtatcgtgtaataagaaattaaatgttaagactttctttttcttcagaaacgtggagaatgattgttaacagaggtaaagcagtagaggcagagcactcgttttggcaatcaaggagcaccaactaagggagaggttattgtttgaatgtcaatgtgactctgagagagggccagggacacagaatattcacaaagagctgaaaggaagaagtgcccacagccataaagtcacggggactggggggcatgcccaaaggcatctgtcgtaatagaaaccttgagatttgttcatttaaaggggattttgaaattcaaatgtaaaaagagaacaagataatccaaagggcacaatttggggcctttttcttcttgtaaaaagaagagaaaatagagagaatcccccataccccccaacaaagtactgtaccatagtggcagtttactctcacttttacgaaccaaatcaacatattaatgacttaaaaaccacgttcacaatggggacaatcagactctatcagacacaacattaaatacgcaggtattaaaagaaaaaaatgcaaactaccaagaaatacctcactccggaaatggtaaggctgacgaaagcagactatgtcattaataccaagcacaccagaaaggcatctatggagctagactgggagggacaggcctcatttgcaccaaagaggaagtgccctgaaggggcccagaagtggggaactgggtagattttagtctttttctttttttggtaggtggggggaatgacagaaacctggcaggctcctgtggaggtctggctgcccccaccatgttgagtcccagtgtctaagtaagtaaagaaatgaaaagacacctatctcaatggttgtcctgaaacagttttaaaagcaagtacaagtccccagcccctagtagaatacaaataatttcatttgtgattcttgcatcaaggaaaaaacttgtgctaagttcaaacaataggatacctctcaaaaagatatgacttctcactagagagaaagaatcaaattctggagtgggaagtgttttttaccttagtgatcttttagtcattttgtaaatgaggaaactgaggacttgccaatggtcacagaagttaattctgtagttggcaattctagcagtaatgaatttacagatagatttggggctatgaggaatccagtggaattgggtccttcaaggccttttatttaaacaattatacatatatatacaaaaaaagatacagggggagagatctatagatatagataagtctgtataaaatatattgctgggtagtaaaaagaggaccggtgttgtagcattttcactaccatggtcaagaagccacggactagattcatttgttcagtgaacaaacagttactgaactctgtgtgcaagtattataaaagtaaaaaagtacgattagacatagtttgtgctgtttcaaaaagagttaacagtatagttgttttatatctacaatacaacctcttaaataatcaagtagtcaaactaattcctattggattaatacaaatcataatcattaattttgaatcttgagagaaggcataaactctgcattatattttagttagacactggaaataatctggaatgtttctggtaccccacatctaaagattggatttcagctattcggtgcatttggatgtttttttccctttagaatccatcctaaattcaatgccctaactcggtagctcagaaacagagctctctaggcattgctgctctccttctgcccagtctctgagagggtattgaggttgaggatggggatgaaactaagaataaggcagagaacgttgctaagtcatgcttctttcagatctaacacatttgtagtcagacctctggccctccgtatccatgggttctatatccgcaaatggaaaatatttggaaaaaaaaaacctccaataaaaaataatgataccacaatgaaaaataacacaaacaaagaaacagtgcagtataacagctatttacatagaccttacattgcattaggtattataagtaatttagagatgatttaaagtacacggaaggatgtgcatgggttatatgcaaatactatcccattttatattagggacttgagcatttgttgatttcggtatctgtgtggtgggctggggtgggatggggtgtcctggaaccagtgccctgctgattggatatcaagggatgactgtacttaatctccaagtcatttcccttacagttatattttagtatatggcaaagcacaatgatttcctttgagatgaacaaaaattgagtagctaaaacctaatgaatacaattagtttaagtaatctggttatggagaaaaatcactagtagtaaagaagtgatcatattacccaagcatttctcttaaaaagaagaaaggagaaagataacatgtgagtgcctactacatttcagtactatgctaggttctttacacaaattagctcatttaattctcataaacatctcccagagcagagattgtttccatttcttctggtaaagaaactgaggcacagcaagattgtgttttgagcagacatacaaagctagaaagtaatttatggcactcatatttggatccaagtttgtccatctacaaagcctataagcctgctaagggagaaacccaaaaatgaaacaacaatgaatgccactggcagtctttttattggatatctactatatgatgctaagttatgtgcccaattaattcgaatataaacacacattttctgccaccttgatgtttaaatatatgagcatgagcaaactaacatttggatccaccatagaatattgatgtagaaaattcaaatcactcatgtatttttttaattttagaagacaatttacctgatgttgcaaagttatcatgcaaaaattaatgctaaaaacataaaaaataccctataaactctttcagtgccagggaacatcatgcactgctcctacaaaaacctggcacagtgaattccctgttaactgccagtagatagggttttatccttaaaaatatttaaaggtgagcacatagtctgcttcatttttactccagggttggcattctcactgcctctacttaccttgttttctgtaaagtgtggaaaggaaaacaagtgaatttttctctcatatatgaaggcctagatgtggggaaaggttgtttaaatgaaaacatggagtttctcctcgtgctaagctggggcatttggagagtcccctcctccctgtgcccctccatccacacaaacatacaccccagttcacgttctagtttcacgcgggataggaaaagaaaacgaaaaacagaaaaagcaggaaaaagtacagaagaagaaggaggaaggataggaagagggtctaaggaagtagtgtagtcttccagagtgctccagaaagtgaaacgatgaaaagggtgagcctcaagagcaaggcacctcccagctctccatggatgaagagtctctatcagctccagaactaaaaccctcagtaggcaggatggtgctaaaagaagaaaaactctggaagggggtcagagacggatattgcagagctttctagccccttctacattacgtataaaaacgattattcaagaaataatgtaattttccagagcatgttcaaatgcaagaaaaaggtgcattctaagattaaatgtactacgacagctaatgattcattatgttaaagttatttattatttacaattattttctatttatgacattgtagtctttcattgacacttgataatcaagagttgacaaaataccatttgaactgctttgctaaagaacaaaaaaagagggattaaggtagacaggaagtgcgtccaccaacaataaaaaggacacatgactcataccccaatattaatgacaaaaatatctacagtgagatcctaaagttctgggtatttgtctaatttttccacaatcagaaccaaaggtaaaaacagcattgacagctactgcagtttggtctgtttaacagaccaaatgctgggatttcaaagattcatggctgggattccaaagatttgtccatgttggaaacagcattcacagtagcttttcggtcaagtggcacaaaggagtgaaaaggtagaaaaggaaacattagcaccaaaaatctctagtcatcttttaccaccttaacatgggttagctgaaggccatggagaataacggatgtgcagttgtctctttcttatacagacagcagagagaggggggaaaaccacacacttatattttgctaatgtaaaagtcccagtggaaacattagcactcaaagacattaatgtggatttgggacactccctgaaggattttgattccattagaaaaaaaaaaaaagacagtgacagatataatcctgctttgatatgtttaatgccatttaaagagaaactgtacccatttacctcaggccaggacaccaagagttcaaaaagtgaaataccatttctcagtgcaaagaaaaagcttggaaaatattatgtgaaaattaatttggcatgcttctttgaaattttagatttctgggatgagcaaatgggtacagttttcttttaactgtttttgaacaccatgtgttgagaagaaaacaacagaatggcaattgctcatccaaaatgctaacttgtggcatggcacagtcaagatggcctgccacagccaaaaagcaggtgtgtgctatgcctctcacttcagtagcatgcacgccacatgtccctgcattcggcaacctcttgcatttgcttttggaacctttctgagggggacagtaaacatgactcaacagaatgtctagctgaggagggactggctctctgagcctgctgtgagacagactttttgaggaagaaccaaaggaaaactggaataatgtatttattttggaattctttggtatcacttcctgtgacctaacaccaagacgactggttccagatcattttgtgtggatgaaatttagcatctaatcaggtcggagagtaatggtgaagcttttgtgtgactggagaggacacattaaatcagctacctcatttggactgaggtcaaggttaatgtagctggtacagatcatacgaacctaacctaaaagcttagagtaataaactcctcacccctcaggtccatggataagcttgaaacagggtgtacaaaaccatttggtgtgctgggatgccaaagcttcttcaatctgacattatgaatctgttattatgttactctaggaattaaaatagttttacgtagatataggtccttttcaactatacaacagtcctatgagggagacgaggaaacagaaaaaaaagattttccttctgccctgtaagaagcctgataaagaggccaagttaaaagtcatgaccacgtctaagctcaagtcaggaaccacttggaatgaaatcccaggatatctgtgctgtaggaatagacaaggtctgaagataaagaagtagatgaaaatcaaaattactattttagaagacaggagtgggacacctctactttattctatacttttaataaatacatcaataataatttattaaaaacctactatgtgcaaatgtcaagagtggggaagaatgaaacctataagtaataaactggaaagaaaaaacatccttaagcttttctgatgtaactgagtgatgttctctgcttctgagtagaaatttatggattcagaaaaggtaatttctttccaaacactcacatgccattgttaatttcactcattcaaatcacaacatttactactataccttttatttctgatggcacattctaggtgttgagggggatacaactgtgtgtaagtacagtctctgtatttattaagcttactgtgcagtggcaggaggaatgagacatataaacatgctctagtataagacagtatgtaatcagtgccacaggagacatacaaataagtgctttagcagttcggaagaagcaagtcctcctggctatagaaccacccctccatagacatactgaaatgactcaatgcacagaaaggaaggatctgtacaactttaagtcaacttacaattgatgtgcattaggggattggagggttagctaggctgtgaggggagggatgtgctcactgtgtccacagctcctctcacactgggtcaccccataattaatgtttatcaaaaacatgcatggataaaagtggaagtcaattgaatgatagaccaggtcaatgggtctgtgttagttctagatattttagatgattattaacaccctgctagaagttggcattataagaacatcattttcttcccacactagtgtaaaaagttcagttttttacccattccagagtgatgggaagtaaaattcagggcttcagtcttccaaatgagggaaatacttggcctgtgcaaaatgctctcggtaggggtatcaaaatgtctttcaaaacagcaaaaaatacatttcctgatagcccctaaggagtatgagttggaatccatgttctctagatgtgacgatggagttcgggagaggcaggtatgctaggatccatataagatcgtatttcccatggtagtgggaaatagaatttgaatgtcctggcttctaggtctgggttcttcctacagaaacatctttttcattttgtattcctcttggacactctagtcctttacctcatgaagagtagccttctgcaattggggtgtgtgtgtgtgtgtttgtgtgtgtgtgtgtgtgtatctttctaagagagaggatagccttactgatgtgcttttgtaaaggattcaaggttgtctggatcctcaaataatgcaattgaaaaaatacggtttctttgattcaatggtgcttacatttgagcagcgttttctttttccattctcaaacacagtatttgagactatctgccaacaataaaaaggtttagagcatcaaaagtgtaggcgaaccaaatcagaattaatctctgtgaaaaccgagattcaggcgcatggaaaaagtttaggaaaaaatccaggtgggaggcaatcccatagaaaggtgtctggcatctttcctgattcaaagtgaggtgtagtaggacacatgtggaagagagatgagcggttctagctattcatatgatccattgtctcaccaatgctcacacaacttgggactgtgttatcagggggccatttgatttatcatgtagtccatgtatcctattgtatgtatgatccggagagaggttaataaagggaagtctaagcttaactgggactaaaatgaggtggcaaacagccattcactcaaacaagactcaccagattaatctgtggagtatccagcagcatttccttttattatcatatgaaaagctgtgcattttattggaaaataattaactctttaaaaaaaaaaacttgcacaccatagcagcaaaagggaggaagataacagtgatcacttctgaacacctggtacacgtttggcactgtttttctttatgcatggatttctttacatatgttatctcatttgatcttcataccaactacgaatgattgatattttgcccattttttttgtataagaatcctaaggttcagagaagttacgtaaatatcctttggtcacacagctagtagggactaagctggaattcaaattggagcagtaggacacaaagcctgtgctcctcaccatgccttgccaggccagacttcatgtgcttttcatggcatgaaatcagtgttgggggaattctgcccagcatctctggttagcagagtgaattgcttttatcatttgccaacatgtcacagaaaaaaacaaaacaacaaaaaaattaaaactcctggctctagatttcctatcaacctgaagtttggcttggttacatattatttgaatatctgacaatcttataaaaagtctaacgagaataaaaaaattcttcatttatgctagctcctatgttagctaaaaatctcctattcctacataacaatgtgcctggggaactctctcactgccagaaactcatctgaaaatgctgaaaagtcagaatttggggcctatatactgactaatgttaccagctgtgagtcagcttgaacatcagtaatatgatatttcccgctacaatttgatttggttaaaatgtgtttgaagttcacccttttattaactggaattaccacctcctgtaactggagggcctctgagaacaggctgctggtgcaatccaccttcccacccgccaacggtgcatttcctggcaacaaatactattaaattgataactacagaaataggtcaaaatgtcttttcaatagttgctaatatttctctaatgctccatagcctccctttgattcttgtgctgacatttttttttgatgagtgcaggagcaacaactgttaaagagaaatgaccagaagaaaggaaagctggctggggtggatggaggtgctcttaggagttcccgtatcagacagaaaagctagatctccctagaggcccaagggccccaaactcagctctgctgttgagtttggtgacccagaagaaaacctgtgtcccatctgagcctcaatactctcatctgtaaaaagaggagactcgagatgactgattattcaaatttgcaaaatgcccagagttcacaggaggtagaagccctgacttatcacaaaacatttgggttttaaatttgtttatagtactcttataatgttacctgttaaggccttggctatccaagatagaaacttattttcatacaaaaaaagtaatattgtgttatattttcgtaagagagaccctttgctatcatactgggttttattcactatgtaaacctatattccctccctctctttcctccaggaacaaagtttgcttttctgagttcacatcacatgtgtgattacagcaaagacagaagtttgaggctgcagtgagccatgattgtggcactatactccagcctgggtgattgagccagacttcaacccttaaaaaacaaaaaagaaaggggtggggtgggtatagtcacattgggaacatagctgattgtgagcctgcaagaagaaaagtccccttgctaaaaaaggttttccagcacttcttctgagatgcaaacataccacggaggggtcaagccattcatgccttcatgctataaccacttcaactccaagagagttatctcagtgtaaagcagttttgaactggagctggagggagggatagggataattctggaacaggggaaggtgaaggaagcaatcagattaactaacacaaggaccctaggctctgctggcagaggagaagatgaagtgggtgacaaggactgaaaagaacccagtctctattgcagtttttgcccagggccttgtctggagctggtgaaccactaaaaaaatcccttgagagatgtcatggtttatcaaaaatgcctttggctcttctgttgctccatggttgtgctgttgctcaacaggcggtcagcaaactacagcctacttggttgaggtgagagtagcttaatctcatataatttaaactcacaaagactatctctccatcagatcccttctgttttccttcctttcctagagcagggaggaaaaaatgtgtgaaagtaagggcaaagaaggaggaggaagaggtagaagaaattaacctttcctcagcttccaagtgagttaggctttgtgttaggtaagcatctctctagatccttccaacagccctgaagatattattagtaataggaagtattttatagggttgaagcagctaactagagctcaaggtggccagtcaggctccttgttacacagcactcttttctcagctcctacaaaatatttatttatatgtatatatttctttttcttctcctcctcctttcactcatgggtgcttgaaaacaggtttaggagccagtcatgtggaatttatctttcaggaatgtcgaacaccccttgagttatccaaagcatacctgactaggagtcaggaggcctacattttctggattaaggcttggtcctaacaaactgtcagtgtggacaggcccatccatctctggggtctgctccaggccttacaattctgtaattcacactcatcaatgtggtggcaggcattagtgtgtttgtacaaaactcagcaagaagtagtctccttagatgctacatgtagactgaagcgaggaactgcctcctgctaatgccagttgtgttttgagtaagaagaataaaaggattgatctgagctgaaagcagaagggaagatgaggggaaggccacagaacacatagctagcagtggcattggtgggggtctgagagaggcagaagcccagggccagagctgagagatcagcttgtttttagcatacacggatgtgtttgatcacatgatggttgggaggtacctaggctaagataatcttaatgttaggtgctcattttaaaacatcaatttaatgactgaagcctattttaatgatccaataaaggccaaagccctcactactatgatacaactatttctccctagtattcactccttgccaaaaaaaaacaaaaaaaaccaaaaaaaaacaaaacaaaacttggctgagacagctatagagtttctgattacaaaacaagatcaccttgatcataatcatctcaaggtgcttggaggaaagaaggagagatgagttcttctgaaccacattatgtggacagaaatcttcaaagagtttaatggaggaattaacttttgaggaattgaaaaaggtatcattttcagtaagagaaaaaatgactgatactttcaattggtatgctagggaaagataaattctaggcaagaccagctctataatttgtggggctcaaggaaaaataaaaaaagtagggctccttattaaaaaattattaagaatttcaggacagcaacagaagcacatcaagccaggcatagggcccgtccaaacatgggaccttgtgcaactgcacaggttgtatacccatgaagctggccctagttttagttattgtttttaccaaggtattccagtcccagagctacccagacccaaatggaaaagcacataccacaactctcaaaactctcagttaaccctgtcttcctacggtaaggacacaactgaattctgcaacaaggatcagaaaatcctggggtctgccaacatatttgatagattgcaactgcactggcttctgcgacatttgtcacagtcactaatccgtgtttctgtcacaacctaaggatgcccaggatatcaatgtctgggaattcaaacatattttctaaaaacacaaatttatttaaaaacaacaacaaaacaagcagaagtcactaaaaagaagctgagtcccctggatgaaagtctgctcttaatctctttctggctttaccttgagtaggtcttgggtgtatgcacacaggttcagaagtgcaggtgaattaccacaataactcttttcagttagagaaaaaatagcagaaacagaagaatctggtcatagcctagcagaaactccctcatttcaccaacagtatgctttctccctttcttattatgctaagttgaagcgatgacttcactctccatggaagctaagtttctctttcctggatgcttggaatgggcctggtgaaaagctattggagggtaacatcatgtctaaaaaatgtatgtatgtatgaagaaagtagagatttaaagagctcagaccaacatcaaaagaataacagcagtccaaagtgaaatgaatgtggcctcttttccaatgaccttagggactttatatatacttagcctacttcttgagtggatagaccagtagcttggcagatgcctaggatgtctgtacaggttgaaacttaattccgtcctttctatacatctttgtcccattaaagaaaaatatctaatatagagaaccagttcactcctacagccagaattatactttgacactagaccaattgctacatccttgatttaggattttttaaaagatatctattggcaaagctaatcttttatttggcttaataggtttgtactgctgctctgcataaggccattagggtccataagtagatggaaatgtgtttgaatctctataatcatgcttagatttcaaaagtcttccatttcacagaggtgatgtaggctcagccatcattttcaagtgttttaacaaatggtaatcagcagagaaggtcttacttttttttttttaaaaagtgactgaccttcacaatggatgcacacataaaactctgattcatttattttaaaaccattctcccctgctgtaaatagatagctacgatatatacattaatatatgtgtgcacaatcagccttagcaatactgctgtgaagtagatgaggatagatggttttctatttatttgacaaatacactattacacagataggttaagcgatttgtcctgtaaggaagggtggagctgggggaaaaaaaaatcctcccacatctgctcttacatgataccactatggaattgggtatcctttattgtttttgagtgacttgatctaaataatgggtaatgtaattttcctgaaaaaaatttcactatttctctcattccctcttactttcttcttctctctgcttctcctctgagattattataaactattgataaatgtggttgctctaaatttacacttgctcttcatgggctttgatgggtttcagcttctaaagagagcataggggagaaaaaagcttatttctaaaaggttttaaaaggatagataacgctgggacagtttatttgaattaatgtcactataaagtggatactggtacgagtactgtcttggacccttctctcgcaagagctagtccaaaggctctgaagtgataccatgggaaggaagagctttttggaggcagaacctgctcatcaacactctgctattctcctgggatatcagacaaaagccagagctttctgtgcaccttcctgttgaactgctttaacttggaactattctctacattagggctgtcctctctgagtccctgaccttagatggtctttctctattttggcacatatttgcatatcagttacggtgacatatttgataaataatgggcctcactgttttttggccagtgaaaaactattttgctattattttaactctttattatctcttttgtcgattatttgtgtgactaaaaagatttcttgtctcttatcatgcttctggttactgtttctcaatgtcatctggtaaatgcttagaaaatacaattttattttgataaattctaaacaaaacataattatgaagaaaaaccaacagagacaagtatataatgaattttgaagctaaatataataaatagttctgaattttctgccactccggctcatttagaatgtaacattgctgacaaattagttattcatgctgttttttaaaaatcaggggcaaaattataagtttcaattctcctaataggagttataacccctgcagcatgaaagcacttgagtaatgtttgctatgtgaaactggcttcggtgatttctcctgaaggaaactgcactatcaaaaccttcatcaaggctgcttctgtttaagacccactgcactacgaatgtccctgtacccgtcagaaccttggctggctgtcatcccatcaagcacctcatctgcagttgccactcagacatgtaaagcgtgtgtttggggacgacgcgcggtggaatgagaagggatacagagctctgttgtaccactacatttattgtaagcaaccacttacacggcaactgctttgctcttttatattctaggcaacacaccggtgaatataattcataatgaacatattcaacattttttccatcagttcaatacattattcataaatattagagatggaaagacctggaagattacagagtccaaacctcctttttgtaactccctttcccctaactgttgatggtagctcaaaaaatccaaaccaaaaccaaaacaaaaaaaaccaccaacaaaacaaaataaaccaaacaaacaaataaaatacaaacacacaaggaaagcaacaaatttacaaattttataagtaaagtgaaaagctccaaagctcgtgtttggtgggggttgttgggggcaggatttacactgatggagctcgctgaagactaggagtatggatgactctttgctttgaagacaggccaagggagggaaatgtcagtttcccccttttagataacaattcaaggtaaagcccaagaggcaataccaagttcttggccaagtgttaactatccatctctacagcctgttgtggactcaggactcaggcactcttctcttcatttagaacttgagatattaatgctaatgataaaaagaaaatgtataaatgaatagagagtgaaaactactagagaatgctccctgggattatctgtactatcaagataggaaaactttgcagatgctactgtctctctagaggaataaatgcttgcattttaatattctcagcagctggttcctgttgaatgccatcaggatgattcagccacccaccaggaacaccagtaacagcaagtgcacacacagaaatctgcaaaactttcttctcttgatgccaacaccattactctggcaaagtcaaaatcctttattgaattatcagttctactaaatgtgaccttgttcccctcacaaataccagcttattctcaaataaatggaacttctggctgattaaaatgtaacattccttctgacttgagcacaccctgctgtcagtctctcttctgccatgttcatgtgatctacctctttttcgttttcttgctatccactgaaaccttgaaggactggcaagatccatacatactcagagtccactttgtatgttgctctgcttgctaaacccatacatttaatgttatatctctacccttacatgtctcaagttatttcatcatttccattttttagacattttctatttccacagaatgtgtttgtatgtctggaaaaacagaaatgtgtagctgaactgcatttaccattgacctcattaatacagaattaccatgccatattcaagctagataaaaatgctatacttgccctcttcttcaaatttagaccagattacacactaaagggaagaaaatgccaaagatgacagctagctatcaaaaagatctcactgtctcattttcaggtctccaaagtaaaatctaaggacattcaacacagattcaggtgctctcaacagccatgaaaatatatggctgaagagggaatctataaatgtaatgaatacacaattggcttataacagatgcaaccaaaattaaattcgatatcttgacctgctctccaaagtgaaagtttctagtttaggctacagacagaggtgtaacaagctcattaatcacatgaaccagaaatataagctgacacttctggggatgctgcaaagagcagtcttaagctgttgggggtctgtggggaacctgaaaaatcatgtggctctgacagtccacagcaagcaacaccactgcattttacaatgtatgtgggtcaggcactggccataaccaccactattttaaacttccaggacaggatttaaggatctttgtagggaaataataggtccaatatggacttttataaaaagattcaatatatttttattaggttcctgttacacaaaaatcattgtgttcattgcatgagaagacaatgaattaggtcaatctatgacctcgagaagtatataaatgggaaagaatcagaggcaggggaatattaataagtaatagtagcaataacaataacaacaatgatgagtgataaccttgagctagtcattctgctaagcactttatatactacatttcatggaattcttatagtatcctaggaaggcagatatcgtttttctctttacagacgtggaacgtgaggcccagtaaaattaagtacattgcctaaaattatgtagacctgttctttacattacaaataaatacataaatagcttgcatataaaatgaaatatggcaaggctcattaaaagatacaaagtgttgtagaaataaaggaggcagaatgtgtttctatttgggaatactaggagaaaaggaacatggatgggaaaatgtggtgtgtgcttaggaaacaaggattgttccagtttgtaatgttataaacctgttgaatcatcaatgtctcattagaactcatactttgataagatagtaaaatataccaatctgtacaggaatatttctacaaagaaatacttctttccaaaagatcttctgactacaatttctcaaaacttttcttgttatttattttttggtggcgatagagggagaaaaaatgtgagatacaaggctatggaggtctgggcagcagtgttaactccagagtctctagggagtacaatgcatttgggtgcattttccttcattcctcagaatgccttatcctcatcacacatatttgtccctgccacatccgaggtgaggttactggcatagaaatagaaaccctgagggtctggtttcttccacttcttcaaagtgggatatcacttactttttatttttataaattagttttagtggtcagccttttggcataggagtacatcaagaaaacgtgagttagaaaacttgagttctggtcccagttttgccttgctcatcttgaaagcattttatctcttctctgtgtttaagttttcttattggcaaaatgagtagtttaagcctgaatatcatttcttaatctgttggacaaccccctcatcaaattttttttgataaaaataaaaccttgttttaatgtagatccttctattcttctctatttaaaattcctggttcacagaatgcaatatatagtaccattagtccagataattttgtagagctttactttctctattttgttaagtttttctcgtaaattttgttttccaaatataaaacattgtaatatatatgtattttcaaattctacatggtcctcgaccagatattccaatattccattctgaagagttggttaacccactcacccatattgagatatctaaagccccttcaagctccaagatacagtgattatgatgctctgatgctgacatttgctttgtcaacgcttaaagcagagcttttaaacttcaaacaatagcataacaagttgctataacaattacacttacataaatctttaagcagatgtgcataacagctctttacatctactatcacactggacaaccaaagcttatgatgttgttataaatccttgcaatagtaaattctacagttaattataacctataggaaaaagtactgtccatatttagaattgattgactcttattttccacatctgttaattttgcacccagctatagggctttaaatagctcccataactttaatcattagcccccactcagtcatgacttctatgtctcacccttctgaccttgcccactgagttcactcttactgatgtaatcaaacatgtttcattgtagttgcattcgtcacagtgctcattagaattatcatcattcctacagcacctcagtgcaatgaaattgtgtgcctatgcaatttgttgttattttaagttcttcagctggaattttaaaaatctagatggacaattttattttatctgatcgataaatatatatccagttaagtgcctctgaaaaattggtaagaaaattatttattagagcaaaatcttaagtctagagagatttttgtaaacttggacagcagcattcactgaccttgaatccacaggttcaaaatttattagtgtcaagttagtcttttaaagcaatccattaaagcaataagtataaaatatatatggtttacatttatgtatgtgttgaatttaataaattagtcaggagtcaaggtatttttaaagaaatattaaatctgttctatattgatcaattaactgactttctaacttaaaatattcttttgctgtagttaaaacctttttttctttttaaaacaaacagagtacataaactgtaaggtggcaatgtagttcactgcgacaatctatatattccttaacgtttgttctttttatggtcatggtatgtagaaacaaataaatgtataatagtttaagtccaggagtttttgcctgactaaattctaaacacatagcttaaataaagggttgaaagcctggcatctcatcattactgtttatatgttataaggtttgcagggccaccttataaaatatatagttgtttattttcatgttcaataaataagtagtgtggggtttcagactgagaatggattacagattgttctctcctggttatttttggctttaagtatattgatcattttatcattttcttgttttaaactactttaaacacagcacaaatgttattctcatcatgccagaaatgggtttggaattgattctgagtttccatcaattttactctttgctctttgtgagaagttttgcactgcttaaattcgaaaggatagttttgtttaaaagatgtcacagtacaacatttagagaaccttagctgcccagaaaaactcagattttctgctttacaaaagaataaaaatcatcgaatttattaccctggactttattgaaatcagtgaagaatattcatacaaatacagtttcacgaacttcctctctctctttcttcatgtaagtgtttgacaaaagcatgtatcttctgagaagccggcctgattggtccaggttggcactgtttcagtgtttggcctacggcggctgcttaggaataatttcatctcatcctctctattttcctggactgtatcaaactcagacacgtggtatgcaaaggaaatccaagtcttttaaaaatgctatttcttttggtactaaagccaagaccagttctactttggccaaatgatcttatcaagatttaacaagagatattcagtaatatctccaatctgtgagaagacattccactaaggaagataatttattacatacagtgtacatatatttctccacttggtaccaggaagagacatgatcaaacttattctattggtactgaaaacaatgtaacactgacaaaaattctgtggcaattattcatttcaattaatttaaaaagaaataaacaagtagctcttcccccattaaaacagatactggaaatctattttcagttattgctgaaaatattttggcttccacaaaggcaccttactaacacactactttgccctccactgtgctgtcacaattcagaacttgtaacattttattcaggtactctagactaattagatgaaacaactgcattacagtattaagatgcttttgtagaattaaatgaaaggagatctgcacagttcagatagcttggaagatttgcaatgaatatcaccaaaatcctgcatgtgcaatatatttttctacatttacaaattagctaatgaataagtgtattccacaataactgctaggatttaatttcacacttaagaatatcaacaaacacagagagaaatttagataggtaaactccatttcccttcccaccccaccctagtgctcccctgcactgtttgcatttcagaacaaatgcttcatgtctcttgaaaagcgccaggaaatctcttctctagctatgcaggcctcaattttatgtgtgtagtatgacacaccttaaaagagagagccccacaaactagagtgggacgttaatttaaatacagacttaaggagaagagctccatctactgaatcagttagatcatagtgtgtaccctatagttatcccattcactactttcaaccacttagaggctctggagggaacaggaaagttatagacctgagcaaccatgaaaaacagctttgagcctaatgccatttgggatatttctcggataccctgagcccctttcctttgcccctccaatttcaaagctttccatgttgcaatataaaataaaaatggatgttttgctatatgaaccatcccttggaagtagaaagtcattggttgttgaaggaaatgtctcagacagttgaagagaaagctacagaaagaaaatctctagctggcaggttgggcagcctaggtaagaagggaaaagaagagtagcctacttactcctcctgccttgcaccattgctggggaagcctgcagccacccaggatcagctcttctggcctctccccggctgcacagtattgttgtggcattgggaatttgctgtggcttcgtaagattatggggatgtgcttcagcaagccaaaaaagtcacaaacaaaattcaagaggaaaaaaaaaaagtataaaaacagctgatcttactggagaagctcttggcattttcctacatatgccacaattttctctggtatttcctggttctgtgatcagaaaaattatcgtatcatatttattactgttgtttttttcagggttgctggtggtgacgggtggtacagtgagggcaaacagatggatcaaggagaagcaaagtaaagattacttctcccacttgtttgaaagctttccaagagattgcaggttaaaaaatctcttcttcagaatactgaagatgtatagatatcacatataggaaaagatggccatactctttctagattgggaaagaaaaaaacttctaacacagtaacagattcggaacaaagcaaattgtatcagaaaaaacttaaacgttcatatagctgcataaaattcagcagcatataagacttataaaaatacttcataaattaagataaaatatttgaatataaatgggtgttaagtatatatataattggatgaaagcaatagttcagtgaattttttattacagaaaaataaaatataatgaattaacaaaagttttacagtaatgctaaccttttctcttgtaggttaaaatagaattaatgtaactgtaaagtggattcatgtttccctgtgggtgtgaatgtatatatatacctgcccaggtattactgactgacactgaaaggtgatatgttgcaaagaaattcaaactttgagcattattttaaattgggtatttaaaatatcagtattaacctggcaggtttctttctttttctttctttctttttaatacatttaattttcagggtctgttttaaagcacgaaaagaaaaacagattagaaaagcattgcacatcaataagtattttgtaaaataatccatttgcatttattagaatattcagttctcaaaaaacggctaattggattttcttcaagccttttcaagacaagttcagttctgtgtcaaggataactatgagaaatttcacctcaaaaggtaatttgtttggttagttataaaagcctgaaaaacaagattatctccaccataactataacaaaacagctaatgagtaagtacattctggtaagaatcgataagaatggcaaagcctgagagggtcatcgcagacttgagaaaggtaaccaagtgaggaaacatcaaacagagttaaagcattctgaaaaacggaaagtgttaataatcactgacaggaaagaatattcttcgatagcgatgacaacaacaaaacaaaacaaaacaaaacaactaaaacaactggaaatacatatctccagaggcaaactatgactacttattaagcaagaggagaacctgcttctttgtcattccctttggaagcctagctttaaaaaaaaaaaaaaaaaaaggttgcacaaaagatacatgtgttccttttctggtattattacaggcccacctagatttagctttcgattccagatgagatcaggcatgttcagactagcacatctttgctctgtaagcacagagctgctatcatttcactggcaaattctcgtatccccaaatttatgcacaatagataccctttaaaatctgcaaattttctatttcagtgaaataactgattgagttaattttttttcttaatttacgctgctcgtattaagctgaaaagttaaggcaggcaactcctataaaaaaggaaagttgaacagtacttaccctaagtgtaatgtgcaagccttaatggggcaatttacttttgctctatgatatttagaaaggtgtccaggtctaaactcagctctcgcctttttcccttctggaaaactgagtagactcacagaaggtgcctctgcgaaagatcatacaaatcaacagccttacctgtggccattcagaagactgcactttggtgtgtgtttaaaactatgaataaagtcagatacagcgcatgctcagcaggcaatttaaaaatatttataacattgttgtttcaaaaacaaatttcctcaaacaaagcaaaactcaaatttttttatccatgccaagtttaacgttctgagacaaagctgttttggagttttccgctgaaggaaaaaaggcttttaaaattttttgttgaacgaaaaatagttctctcttcccttttgggtacgcttaaaggggtggaataaatttttctccaagtttcaacaaaattcacctctggctatgataaggcattacaaatttaaggtctgtaaaaaataattttagagaaactaacaagaaactaaaaactatgggtttaaagaatgtaatggtcatctgaactttcaaggcagtcttgcatgtaactatacaaaaattatatcctgatacaaacaggatatattatatgtagataagaataatgtgtatacaaccatatgcatacctagagaagttttatttttcttttgctaactaaaatcagaactctctaaagccgaaaaagaaatacaacaaaaatttaggagaaacccagtaataacatcggcacaattcatctgtttttcatagcaagcgtggaaaagaaggcaatcataccaattgattaaattttgagatatataaaataaaaatttgataaaagaaggtttttaaagtatgaattgcagtagaaatgcctgtttcgttcctggttgaaaatttctttctcttccttgaatatccctaagcattccattttaccatctatcaccaaaccctgaacagctcacagatctcacagatcttatttaaatctcttacttaattcttaagtctctgaatgaatttcagctcctgctctactttccaagggtgctcagctggcctcacaaaagctccacagacacatcgttcactatctctgatgctttcaagcttaacagaggatgccaaaaaaaaaaaaaaaatcaacgattaaaaaaagtttattaaagtgaaactaggagtgcaaatttgaagaagttgcttctacttttatttctctctcaactcagcacaggtgtttcctaacttatactgctgtgcatgctgatgaaggggagggttaaattaaggtgagggagtgggccaagggcagaccaacaagcatataggatctccagcctcatgtgttaatggatgtgtttaaaaatggaccccccaaaaagcctagaatgaggtttctttttggcaaataattaaaccagtatactgaaataattaaagctttgtctttaaataaagcatcagatcaacagaacaaaaacaaagataaaaattgcacacacatatgcatgtgcgcacacacgctatgacacacacagatacgcaaaactagtgggtgaggggagaaggaaattaaataaaagaaaacaaacagagtcctaacaggccattctccgaaaaggaatctaaataaaaagtcatatgatatctgatagtgcaggacacgtcgccaagaactggagcggattgcctacaggaagaaagggccagtgtattccagctcaaagagcttttctttcctcctcctctattttttttcccttttctcctcgactgtgaatgtgtcactctcaggtcagatccacgaagaatcccagaatgacagctatcacctgtcactgtactcttggcggcacaactagctgataggagctgcctgagttgggatcaagaagagctagtgcagctttcagtaacagcctgttatcccagtccctctgcccctttcaaagatccccttggtcacatcaaaaacagaccaaaaagaaaaagaaaaaagaaaaaaaagggggggtaccaaatgaaaaattaaaaatgcagggacaacagcccacagcaacaaaagaattcagggagaaaaaatagaacacaagcaaaaaggaaaaaagcaaaaccaaaacaactcttgtcttcaatataaaactttttaaagactgagtttctcttatttggatgacattctttttaaaagtatttttctccttaagcactattaaaagcattaaaaaattctacaaaaatacagaaaagtctgaaagcaattcaagaatattcctaaagaaaacatgtaagtgtaagaagtgagttaccctggaaaattctggatttgccaaaagttcccctacttctaatatctttcagtgagttcaagtgctaacactggccacctagtacttgttttttatctgaggatcattactgaggcaacacatacatagtaaggtttcccgaaaagactccttgttatcaagttacttcaaacataaggcactcacacctcccagccaggagggttttttgatgagcatcacactctgccctgatatgtattacacccttaagaagcagttacataaatgcattctataattatggaaaatgtatatatctatattttcccctacattttccctccccagggatatgaatagattttattttcagttaatagaaaaaaaaagaaaagagtttctgattcttgaaacaactgttgtagctgttttctacttagcaaaacagttatctgtagttaggaatggtacataatatatatttaaggatttttgtagagcttgagaattgttccccttgtttagtttcgtgtctataatgtaccttaaaaagatttctaagtgacaatcaacatataaatgcattaagaggagaactttaagaaagaaaacattatcttgggtttacaaatccaggatattagcataaagatataaatgtacagcatatataaaagataaaattgtttactacattttacacatacagctcacatctgatttctttttgcttttgttggagcattaatttgaaaatgataagcattctgaaatgtttgctacaacacaaattcatggtaaaaatatacatgcataggcaaaaattgaaatggagaacacaaagctacgtggcaatcagaatcgttgacaaaatctccatctagactatattttgcatgaactagtgtatcatagaaggggcaagaaatctctctgggggttttgtcatttacataattagaaacaaaaataaaatacaaatatctgctcccttactaccttttcttaataactgacaagtgacacaagtggtaccttttaaacagatggatgcaaaaacttgtgagatcgaatgaactgatgtaccccattggtattttgggaacccaaattccataattaactttttacccaagtggcaaaagtagaagatgttctagtcaccaaattgattatttgatggacttttgttctttcttccacaagattttggcgacccagaaagggtaaagacatgataagagaagatgcatcctgaacaacttttattgtgagtagaaaaaaaatagcataaagtgagcataagaacagttggatttggaaagattaaaagaggagaaaagagcaacatatgcaacttaactagtctttttctttttaattttttcatgtacatatatgtatatattgggatgatggggagaaaagataactggatttcttttgaatgtctttgtgtctttatagagtgaatgttctgttcctgtctctttctttttaggcgaaaaactaataaaaatagaaaaacatatatcagacattaagctcactccccccccccccacccttccctttgtaaagaactctttgttctctagtgaaaatgctgaaaaatccccgggcagctactccctgaaacaagtgcaaaacacttagaggcttttgggctggctgggagccagaaaccctcccgctgtctggttagaagaggaaaaaaagaagagagagggagagggagagaggggaagagggatggggggcagagagagaggaagagagagaggaagagagaggaaaagagaagggagagagagagagagagagagagagagagagagagaaattggagcttcctttaatagacataggaagcagcgtttttttctttcttttttttcaaaactggcggtcaagcgttaagtaactcccgtctaaatccacctgctagaaatgaacttgggtaaccccccaggggtgcacaaagacagggaagacagtaacatactccatactctttcccaccccccgttgtactgcttccattctttctgctctcatacacaaatgcccacagcttctcacgccgcccctcttaccccccaacaacaaacacagcaaaatacatgctccctcggtctcctaaaaaaaaaaaaaggcttttccatctcggttgcgacacagtgataaggggtagcgaacatctcatacctggtgtgaatgctaatcagtcaggagttctccttttcccaagacagggaactgtttccttccaaatttattagaacctcctccactgcctctttgaaaaaccttctttgtcaccctctcccaagtcccgatacttctttaaaaaaaaaatggcttcggagctccttctattcttgatattgattctctctctctccccccacccctcctcctctctcctgtctgtgtctcttctgagtggtctattgataagtccctggaggcactgggtcagcctgcccgtaggaaaccagacacaatgcacaaatctccgagtgccattctgccatcagcaagcagaccacgtttaggagagagagagaggaaaaaaaaacagtagagcaagagacagagagagagagagagagagagagacaccaaccgagggagggagagagagactgagagagaggaagagagagggggaagagagagaggggggggagagagagagagagagggagagagaggagagacggagagagagagtgtgtgagaaaaagactgattggaacaggagggagagagagagaaaaggagaaggagagagagcgcgagagggagagcggcactgccagtcaggttaatcatccctactttaattagctgttcggcttagacataaaacaattgaatttgaatgatctgtcagcaggctcggctgaaccaaaggggaaaagcgaatattacaaaaagactgttggtgtgttctgataagcaatactgctcgtactgacaaatcctcaaagggggaactattaaaacttacaactaaacaaaaagtgcaaatacaaatggcactagatagaggtctttaaaaaatggagttttctcctctagttttatgaaccatagatatttatgtgcaggtgccaacatattaggggttttcgtgtaatgtgtgaaagtttattaacgatggtctaggagtgtagcagacagatgctgcagagaacaagacaggtacagtcagatgccgaatctagatcttggagggagaaggatgctggaagaagaggcaccgtggcaagagatcagcacagacaaagtcagtgggcagataggcagacagattttaggcacggcacgatctcatctaaaaaggcaaaagttctgatgcaatattaggtacaaaacaatccatccatcctcctctcccgggtgcactccaaggtacagttaaaatggattaatctttgtgacaaacagagctggcaaggcagacactgaaggcgatttgcagacccagagaatacagagctagaaaaagccccagagatcaatctctccccctcccaatttagtagagaggaaactgaggcccagagtcgacactagacactaggactccaggagcccaccaggccagtgctctttccaccacaccagctaacctagagtattctttgaagatctggcccaacaggtatgaaaatcacccttacctcccaaataagaagattactccacctatatagttagtgcacaaacctccaatttctcaaaatgtttaaatagccaaatggaaatataattacatatataaatacatttccactttatatatatgtgtgtttatgtatatatatatatatggagagagagagagagagaccattttgaatgctaggaacaagggatttaagtctttaattcattctaggagaaaagcagaaaaatataatattgtagaggcctcgtctcagcaagatataacttgtgtcacattttcaagctaatgaaggctagtggtttgatctacaaagacctcaccctgaatttacaattcgctctatgaacatcatctgctatatatcaccaagtgagaagatgtggtttttctcatacacctcgtttctaaaatataggcacattgtgggtgaaagagattgagtctttcagcatactatgtagttttaaagcactgatgagattttccacctggagaattaggtatgtacaacctttccaatatatttcaattgaaaatgagctactaaaaaggggaaactatattttccgcccatgaaagtgatggtatctttttcgggacacatatgatcatgttcactaaggattcccttttgacaatgggtaattgaaggtccagtttttaaatggtgaaagaggtgcttatgaagagaacagtgccatcagatgttactggagagattaagtttcttgccctaaaacaagactcaggatgtgtatgaaaccgaaaactatctctcagtcatgcttcagcaacaacattgctacttagggagaaagaagaaaaccgaaagaaatgtcaggcacgtgggagcccactcaaagacaagtaatctgagagaagtcatagccagagtaatttagtttatttgcacaccaacctctttaacaatggctgctatgccatgcctaaaacacacggcctacagttgactgatttggaaagggggaaggaatcagtgattttgataatggcagatcctttggcaagccccaaaatacctgataggccagagcccagaagaaagcagtggagtgcttagtaaatgtctgttggtgaactgagaaaaaagaacaagagctttggagcaaacacatatttatatataacactgcaaaagtcacagctactctgaaagcctcagttttcctttctgtaaaaggtgatgatattggtcccatagagttgtcttaaggatgacatgaggaaacatataaagtacacagctagtcattacacggtagttattatggaggaaggtgtgtaaacaaaagtgtatattatggatgtgctgagtgtgttatattcaaagcatgtaggttcaagacatgaaagcatatagcaaagcaaggatctaatatacagatctctactagaaaggattggcagtagagattataaagtttagaactaaattcctaaaatctaaacttcaaggatgttaggtcatctggggttgtattatttctttgttcccagattttactatatttcctggctcataataataatgatggccaacatattactaattggcttgccctaagcagtctgctaaggactttacattttaaaatcatactttagcatcacaagaatcctatgaatgaggtactaccaatatccgcatttcatagaaaagaaaactgaggtatagaaagattgtgtaacttgctcaagatcacacgcctagcaagtgaggagctgggaattaaatccagccaatctgattttaaagcccgcattctcagccatggtactaaactggcacacagtaggtattcagtcaatgtgtgttgaatgaataagcaaataaaaaaaacactagaatttttatttcattggagatcagtaataatctgtgcaaaaccacttgagagaatcttgttttcgaattatagaatctgtccttcttctgtagctcacttcaggtgtagtcctttgtcagaaaccagggtgagccatgtccctgcatggtgctgaaaatggatgaagggaagagtgctgaccatgaccacccagggcatttaaatatctgacggcattttcagcactttgaggacagtgttagcacaagggttattaattggcttaattccagttcggataattacatcgtgtctctttaattttcccccgactatgccattcttcacttcctgtcacaaatgtgctctttaaaaaagcatacgaatacacacaaacatatagttatatttaaggtttgcataatcatttagggtgcttttttttctaaatgatcagtgtatagtagctatgtaataaatgaatgggcaaaagaattaaagtcattgtaaaataaagataactagttgaagctttttgtttggcaatgaaacagatttttaaaacatttccttggtgacagaattccaatcacatttttttctcatgggcagatatttccagagctgatgacctgctcatgataagctgattttcttacactatgtagtttccagtataaaaaaataccaatgaaaacttcgatattttagagtagaaaatgagactaagtcctgagtggtagagcatactgaacgtacgggttttcagtgaattattaacccatttattagctctgacttacttgacaggttttttttttttatctccaaacatatcactagaataatcttcaaattatgaaagaaaaggacaacatatcctaatttaataagcttaggaaagtttgacagtcataaacagacacaactccttttcctttttccaaagaattcttggcctttgaaatactgtgcctgcattatactaaagaaacactcccagaaaaatatgcttaaaacatgtacacaaataggtaaatgcacccatggtagaccatagtttattaggcctttttagtgtacatttgtatgaataagtcatcaaatatagggagtgtggaaaataagagaataaagggttaatttatttattatgcaggaaggtttctagatctttgctccttcagcttttagttcaaaattccatgcatattctgcacataataataaatgccataattcaacgtatctcataatttgatttactttcaagcacctttttttctggttcagctcttgaagccttccttcttataaacttcctccaagttattttttgtagcgctctgtaaaatatcatttaaagttggtgttcataagataaccctcatgctatagagagatttgtatcaaactagtccatatttccttttgagaaccagtggtcaagtcccatgctcttatctgagaacaagccacaataaatatataaaacagccctttcccacctgtttgacccctgtaataatgatagcagtctctcagtgactgccctctggttagttactcattccttaagactgagctcttccaggacaaggtctttccattctaccttgtatatttaatgtattgtccagcatcacacctgccatggtggtagatgatctcccagaaaagctggaagcaacaaattttaattccctttgttcttcatgagtaaatacaaatttttctctctgtgtgtcaagttttcaacatgtaaaaggggcatactttatcctaagattagtgatttgatgttcagaaaataatattggagggtatagtatttaagaattagctagtgaaaagcacttgttttggttattttcatagtatcgccactatttttatagcaagaagtacttagaaaacatgttttaaattcaaaatttaggtgaattttgaattcaaaagaaaagtggacaagatttatcctgaatattagagatagtaagcacttggtttttaaatgccatttaggaacagcctgacagattttatacaagcagaaggtatttaggaaattctctggttctctcagtttacagagaagagctgagtggcagagatattttatctgacaagcttaaggtaaaaaaacttggtagaagtgaactagtgctggaacccagtctgtctgtccctggttccacactcttctcactcatactttgaaagatggcttttatactcttgactccagatcccctcttttttggacatattttactgacggaactcttaaattctggtgctgataaaggggtacaatattcctaatgtagtctgataaacacactacaaaggaactatagtaggctgaggaatggccccccccaaaagatatccatgtcctaatccccagaacctttgaatgttaccttacgtggcaaaggggtcttgcaaatatgattaaattaaggctattaaaatgaggagattatcctggattttctaggtggactctaactgtaatcacaaaggttcttataagagagaggcaggaggatcagagttagcagatgtgatgacagaaacaagaggttggggttatttgaagaaggggtcatgcaccaaggagtgcagggtcctccaaaagatagaaaaggcaaataaatggatcctcctttatagccgctaaaaggaaccagccctcccaacacctttactttagtacagtgaaactgatttgagacttctggtttcagaactgtaagagaatacatttgcattgttttaaaccaccaagcttgtggtaatttgttataacagccataggaaattaacacagggaccatcagctaccttgatctggacataatctttcaacacagttgaaatatttcttagctctttaaaaaattattttagcagatatattaccttactggttcaaactgagcttgtgatacaagaacccttaccagtcttcagaaaaatattgactaggataagtcaaggagggtcttttctcctgacactaagagcttccttctaagttgacataaagcaatcaatctaatgattattggttaattgatcagttggctgcagatccatctaatcacatttgcccacctcctgtcttatagtaactcttcactggtggtttggcaattgtatctccaagttaatctacaacagtagttctagttagaagcaaagagaagggtttcagtgtccatttcttgagtgccagagacctgaactcattcagaagtgagtgctctcttgctagacccccaccccacatttttttctgagctttcttaacagaggtcagaaaaaagaagcatgaggcagcttaggcaaaaaacaaacaaaacaatctcctcccccccccctctttttttttgagacagggtcttgctctgtcaccgaggctggagtgcactggtggtgtgatcacagctcactgcaacctcaaccacctgagctcaaggaatcctccagcctcagcatccagagtagctgggtgtgaccacaggtgtgtgccaccatgccaggctaatttttaaatttttgtagtgatgaggttttgctatgttgctcaggctggtctcaaactcctggcctcaaatggtcctcccacttgggcctcctaaagtgctggattacaggtgtgagccactgcgcccagcccctatccaaactttaataagactcttttgccatagtgtatcattgccattcagttaccgcttacattctataggatagtgctcctaaaagagtagtccttgggccagcagcatcagcattgcctagaaacttgttagacacgtaacttattgtgtcttattctagacctactgaatcagatgctcagaggtggatgtctgagtgtgtatattttaacaagccctttaggtaattctaaagcctagctgagaacaattgtcataggacaaatctgtgaggctcatcaaggctaatgaaaaaacacgttggactcagagtgagatcacctgctaatctaggtgtcatggtgactctgtcatttgccagctatgtgactttagattatgttcttagtctatttgtctcatctgtaagatggaaataataataattaataataataataaattgctttatgtgaaaagttaatgtagaagttaacaagatcatgcatatgaaaacactttacaacctcagggttattattgtagaagaaacatcaatttggattgcaagtatcctaggaccacattgttggtgatattgccttgatatttcatattaactagggctcccaggtagtaatactgaaaaaaagttcaagaagctccagatgtccaattctccaggccaaaataaaggctggaagtctgtagatgtttaaagggtgtgatgctgaatggaggatctgctggcattattagtctctagaaccaagtgctaaatttcttgatttgaaagtctacctttctatttatcaggtagcagaatttagtgacagctttgaattctgtatgccagtgaaagtctatggcttgtgggattcagaaccacaattttttatcaatttccaatgacactcagttttagtaaagtggcccatgatctcttgcatttccataccatattctcaaataagtaagaagctccagggagctcgctcaacaattgattatggtcacatattttttcaatagaaaatatgtatatcctggtaggtgggaaggatggtcctgatcaggactgagatctttttagaggttcaagtccaaactcttagtaggttgaagggaactcagatgcaaccagattagacacaactatgattttcatggaaaatcatcagaattttatccaatctctgagtaatgaaaatttgcagtatttctcaacagctctatatatgtggagaaaaccacctcataagaaagctaaccatgtcttttccttctttcatgaaataatagtgacgtatgcctcttggcctgaggactcgtccttcctctgaagactaatgtctgcacgtcaccttttggcaacccctctgtgccttgcaggacagttgtgtagcaaagattctgtttgggttgctgtttcctctgagccagtcacactggtgcatcaggagatgcagctgcaccttttaagagctctgtgtccttaagcaagtcatctgtccttttacatttcatagatttttcatttgtaaaatatgaataatatgtgccttaccaatcttacaaattgttctgaagatcaaaatggatgatgtatccaaaatgctttgtaaactaagaatctcattcggttggtgttactgatgttgttattatttactctttagcaggagagtaaagatatatacagacatattgggtacggtagcttgaatatttttagacatctacgttgtatatgcctccaaggtttccccctgaacttacattaatccctttttcaggttacagctaaggtggtaactaaggatgttaatttcctttaggtccctataggatctctattttgatcatgattagtttatacatgaaatagacactgctgcagaatttacaatgtttccattctggccaactcaactttgaacatattccctaagtaagaacaaattcagtactataacactgaagaaaacatagcatccgaagctggtattgagggagtgaaaatatcttcaaaggctttttcttgattgcttaatataaaaaatctgcttagaaatgtccactagttcaacaagcattcctgaaggaaatctgtaacaaagctactgtgcattaacatttaaaagaacaggaacatgtagtctacctcaaaacaaattattattgcttgaattgcccaaactttgttaaccaaaattgaatttcgcctaagttgaattcatgtgaagagctcataatgcattgttgctatttagatagttgtcatagtatgtggtactcagtaagtcctctaaaatggaagggaaattaactacatggtataatttcaacataagtcattaatataattgtgcgaagaatatctctgaatatattgaactgctatttgaatctttaattgtgcatacaattctaccttttctgctatgcatccttaactagactatatgctccctgaggacaattcctgatttacacatctccaaatttcccgctgccttcagtacagtggtttacaagtagcatttgctttcaaactatctgctgtttaattatattcactttttattggcttttcttggggggcaatttatgcacataaagtgtccatagataaatgcatcattatcactgaggtgaaagttgtgattcttaatttttttaaaaaaacatatacattgggccacttatttttcctgtgtgacactcaatctaattatagaagtgaatagaaaaacatgatctcttttaaaaggcgcactttacgtgaaacaattttaggaattcagcttatgtgtcaagtacagtcattctgcacagtgatggtgatggggaggctctatgtactatggttttgacagaaaatattttaacttaaagccagctacccataaaattacgtaaacataaatatgcactctcccacaaacacatttgcacatctttaaacttagattaatgcaaagaaaagatatattcttttgttctagtggaatacaaatgataaagactaataaatgaataaataaagctctaggtaaccaaatcaatgtctgctcaattctggtcaaggaggtgaagggaggtttccctttgagtcagagaatgtagtggataaaaaggacatgaatagctggggggatttcctgaggccattgtagaccagctcacacactgttaagaggctcattttcatgagacttttggttgcatttgtaacacttgctctaggtcccctagagcattgagtgccacatcacagcactacaataacaggactaaatgcaagaaggtacattacaaggttctttttctttcagctctgaatatccaggagtttgtagatgttctcaagactttttttccccttcgtttttccttctcccccaacccccacacactcccttcaaatagaactaagtggaaaggactgttttgtttttaggtaaaaacctaaattcttgtacttaaaaaaaaaaaagccagttgtaaaatctgtaatataattaattatttccataggtaagagatattttattttttataaaacctggtctgactggtaagtttgttctagattaaggatttagctacagtttggtgagtgtttgttctctgttaggcttggtgcatattaattcgtacatattttaacatttcactactgtattaaattattaataatttgaaatcattagcttgtactgacaccatttttctgaaacagtaccacctgtttcttctaagtttggtccagaacaaaagtctgaaatctaatttgtcaagaaaacaaatgtgtagttcagaaaaaggataggggccaggtgcggtggctcatgcctgtaatcccagcactttgggaggccgaggcgggtggatcacctgaggtcaggaattcaagaccagcctggccaatatgatgaaaccccgtttctactaaaaatacaaaaattagccaggcatggtggcacacgcctgtaatcccagctactcaggagtctgaggcaggagaatcgcttgaacccaggagccggaggttgcagtgagccgagatcgcaccattgcactccagcctgagtgacagagtgagattctgtcttaaaaaaaaaaaagaaagaaagaaaagaaagggataggaatcaccaaaagaaggaggtccaaagtccaatgttaggatgattatgctcatgacacggccatttaatctttaaaacaaatataaaagacaggtattccctgtggcagagctgagctttacctcaggtctgtgtgacagagtctcatctcttctcttatacatcctcaatcttcagacatttaaggtctctgagtatccaggatttcctttgcgacaataattaacaaatacatgtatgtacatttgtgtgtgtgcattatgttttaagcatatatatatatatgcaggaaactcacatctggagtaccagagtctacaggccaggactagatacttagatctctagggaagtgatccaaatatctagttgcagctatgtagatttcaagaatgcagtgaggggagaaagagtatacttaatatatgagtacatatacactatatatatcccatatatgtatgacatatgtaactaataatagtcaaccctcactaacacaatgtgcctaatattattgtaagcacttcacaccccgttactttgttctcataacatctaaggtaggcatcattattattatcatctagttttacagatgagacaagcaaggcacacaactaataagtggcacagtccaagttcctatctgtgatcctgtctttttcatggaccttttcctatctgttgcctccatgagaacatatctgaactttggcctattcttttttaagactttgctccctcttaggagataacaagtagcagaactcacatgttacccagccaatagtgtacttagcttgggaacaaaagactaaatttgtggaaattcctcacatttgtacaagagaacgtcccaaagcaagatactatggcctggaaaatggaagagatagtttgggcaggtggatgttttgggtctcccaaatcacaacacatgtgcaatgcgcaaccatcaatacataaatccaatttaattcagtatatatttaataagcacctgctgtgagcaagggactctgctaggacctaagctctagaaagtagctacaaagattagaagcaataatcctaatatttagaacatgggagaaaagaaataccacataactaaaacacgatgcaaataagttaataccgtaaagcgttgctaaaaaaaatctgtaggtttcagtgacttgaggaatatcatttgctattcagcggtggacactgacaaagttacctgaagcaggcagtgtttgagatggactttggaatgtgggaaaattccaacaattagaaattggagagataggttttaggcaagggaaacagaaagagtcaaagcaagggataggaaagcacaaactgtgtctggggtcaatttgactagcttctagactactcaaaggatagcagtaggagtttgagatgttgtgggtgaaacatgtggaaatgtccattgagcagcaggaaacccacatgtgcagtaccagagtctacaggccaggactagatacttagatctctagggaagtgctccaaacatctagttgaagctatgtggatttcatgaaactgtccacagatttcaagaatgcagtgaggagagaaagacagacaaacttacattttgtgggcagataaagggaggatggatgaaagatcattcagatgaacaggagaaccataaaaacagacgctatagagtgtaaaggtgaagaatgcttcaaatgcttcaagaattagagatagatagtcaaaacaatcaaatcataaacaggatacctaggattgctgtgaggaagaggtatatttaagagctagagtcttcatcactgtactcatctttgaaaggaccacctcttattgctttctaccctttccctaaactcaagcatgcatacaatcacacacataaacaaacattattttttcctaggaaaaatgttggcattattaactctgaagcaaaactatatctggaagtttttagagtagttagcaagatccaaactttatggtttgattttaattcaaaagataactgaatttttatatgcaggttaattattccttggtgggaatgtgaatttatttgtattttattcaggaagtatttttgagcatttcctaactccaaggtattgtgctaaacgctgggatcagaaaaatttccataaatgcttggatggcttttacctgggagcactccttcctatggttggcaaaaagctgacgcctttgtgatgatgagtttcagtcctagcctctaagagtttttgtggtcatgttattaagtgcaatgtttatgtgtattttttctgttccaagattttttttaaagttttgaatatttttttatgtcaccaaaaggtgctttagaagaacaaactaactcaaagccaacacagaaactggttctcttgctttgccaaagtggcagtgtagcatgtgggcaagtaagaatacttttctcaagtatttaaaacaactacagaaatcttattcttcattgtattctctaaagaataaaggtaagaaggaaaatcaggttttgatagagaattaaaaaatagctttagcatatgttcaaaccattaggtcaaaagggactaacaaagccctgtagaaggggacccacaaaagctgcccttgggacttacttattcacttatttgtttatattttttgtatatgtacatatttttctgatactgctttgacacatcactttagctctttttctatatgtatgaatattcttctcctacaacataggaatcttgatgtatacatagtttagtaatctgcattcattctttcaagataaacatttttaatcctacatggtattctattctaaggatataccagcataaaatacaatttaaacaatcacctatttttggacattttggttgcattctgacttttattcttttcaataattctttgtccagtatcattgggcatagtctttgcaatgctattatttaatgaaaagaaaattttggaaactttaacaggtaataccacaagcgaggaaacttaatacaacgaccacaagcaatgaaagaaaagtcaaatgcctcaaggagccagggtggaagagcaaatgagtgaagtaggtgtggcataaaatatggggtgatagggactttgtcaaactggagagaacatggtttgtctgaagtgagcagctgctactcagttccagatattggtgccacatgtggatgcagatctaatgttgtcagatctccaatttttcaagagaagcaaaaaaaaaaaaaaaaaaaaaaaaatctagtttttttttggtgtgaaatctctttaaccttaaaggttggctcaaattattttaaatattctgtggaccaaacatacattttaaaaaattctatctgctagctagatgcagctcataggccactgatttgtaactttctaattaaagaaagggcaagacggtgtttggaaatatatttctaggtagagagttaagcaaataaagttttacttcaagttttcctagtcacaaggaatgtaatgtggagagactgaacctcaatgtgcaaatcttgaaagatgggtaaatactgctccccacttaacacccatgaagaatttaatagaagaggggtctaaaatgcttttaatttcacaaagaaacatgctttaatgatataaaactctaacccagtgcactgtatgatgatatctaatgataatttcccttcatttcccatctgaacaaacatttcccattaacatccacctgcactacttcctttcataaagaggaggtggtatttggctatgttctggttctgattcatgagaaatcagcccaagcccaacatttctgttcttaacagattttggtttttaaatctgtagaacacaatgtttccctgggctgagttctagcatgccaagttttggctggccacagactttgacatctgagtgaaaaatctttcaacaatggcatttaaactgaagaatcaacagacctttaattataacactgcttgtaattccctccctctcttatcatgatgttcaaattgcctcaaatcactaactgcatggacagcatgttatttcatttgccattggaaatatcataattttaaaacttgggggcttgagattgtgcattaatttttgaaaaatcagtattacttattcaccataaattaaagaggcatatggaacgaaggtcaaaattactgattcattagaaataaaaaacaaaaaccactcaccacacaatttctcaacttatctaaaatgctcaagatttagattaaaaacaatatttccacttggaaattaagcattaaagatatagaaaaagggagtctctttttagtgagatttcactaaatacctctggtatctctccataaaatgttaggtgatcatttcttaacagctttttaaaaatgacacagtctcagattaccctatgtttcccttatataataacaaaagacacttttatactactaaagtacattaggaatcctttgaaagtttctgttttagaaactgatgttgaaaaagtacttaatttatatttaacctgcctatctgaatatacttagtggaaaaattagggttaaaaatgtaaatgtggaaaatgtttatttccatgttttatagtagttagttttttatttgcttttaaatatagatcttggttatatgtggaagacaggcataatttcagctcctttttcatcttgaagagaaacctggctctcaatttccaggaaatatatttatttagacctaacaatataccagaattttatgcattatttctaatcttcataataagtctacaagttgggtgtcattaatctgttactgataaggaaattgaaactcaaataaatttaatgcttttaccaaggtgatttagttagtgtctttttgtccatggattttaagtggtagaatttgcatgcaaacccagatatgactccaacggctctgctttctcctttagaagaaaaaaactccttcctgaaatactaacatcttttctttgtgtaattgaccatcctttcttaatacaattggttatcagagctatcatattcttaattatcagtattaccttacgactctaaaattcatctttgtccagtgtatagaattcacatcctaaggttagatataggagattaagtctctgatctcctggagcagacctggtttcaaatcttgtcttttattatccccataaatatgcatgtatttataaaattatgtcctaagtctttgttcagaaaatatgtagtgtctgacattattttgtgtataaaatgctgaaaaggtcacatccaggaaactagtcctgaccagcatacaacactcaagaaaggttctccaaggtagaatcaggggagaatcccaattgaagttgttgaggggagtaaagataataaataatattaacaataataactccatgcattgaactcttaatattcttcatcctatctatatatcatatttaatttttacactactcccattttgcgtgtgagaaaacagaggcttagagatggtaaataactagttcaaggtcacatgactagtggcattttactccagagctttgctttttgtactttgctaaactctctcccagaatatgggaacaaaatctaaagaggtaaattcaaagatcaatattaagatgataaatacaagatgcagccaggaatcaggaattggagtgggaacagatgaggaaacaaggtggtgggtccagcagggttgcatggttgaagtcagcaaatgtctgatatatgggggtgtcatgtcacattgaaagtacagctacatcagggaggtggagcgactgagagaatatgtagagggtgacagatataggactgcttggctgatttcatgtttttcctttacaaatgtaaataaaacattgtgtgttggaggtcagagggcaaaggagatataactgaggactctactcaaaaaaacatctcgcttcatgtgtcattaactgaacaggggaaagaaactcagttgtctaacaagatatttttaaaatatttatttctccaagagggttaaacctcatttacaccttggagtaaattactttaataaggttaccagatcacctaactgaatgtaactaaagtcaagaagctgcagtttgaatggggaaaggaaatggataactgtggaactgaagggtgggagaaggggatgatagtgacacaagcaaggataaaaaggatttccttaggcgaataggagggcaccaaagataattttatgaaaagacagttcagggctaaataaatgtaaagtactaacatcatcattatcactagttctactctgcacttatgtctagaatttttgtagtagccagtgtacagacaaaatcactaaaattggttgctaatttctgatttacaagctgagcagaattccctacttagagtaactcctcaaaacatacttgttgagcaaaatgggacgtcaaaattttgcctggaagttggaaactttcagattttccaaattccaacctgtttttacagtctaggttaatccagtctaacctatcaagttcatctaactgggtcctccctgggaaaaaggaagaaagaggacataggaagtgaataaagaattgatacctcagctgggcgcgcagtggctcatgcctttaatctcagcactttgggaggccaaggcgggcacatcacctgaggtcaggtgttcaagatcagcctgaccaacttggtgaaaccccgtctttactaaatataaaacttagccgggcgtggtggtgcaggcctgtaatcctagctgcttcggaggctgaggcaggagaattgcttgaacctgggaggtggaggttgcagtgagccgagattgtgccattgcactccagcctggacaacaagagcgaaactccatctcagaagaaaaaaaaaaaagatacctcactgctctccttcccttctgtgtggcccaatacagcatgctgttgaccctggggaagcttcagaatgtatgatctaggaaagctgaggcaatgctgtaataacaagagctatgtgaaaggtaaagtatgaaatgtatgatggaaaccaaaccaaagagggtatgttaaagataagcccattaaggaaatagctcacctgttggactggaatctcaactggctcttttatttcacgctaaacctgtgctgagtctgcacagaaggacttctgaaatgcttatatatacaacctgacaggtacaatcagaaacagtacaaggactgcgtgcctcaacaagaatagccagagcactgaaatcaattgcagagcacagacatacttcaactgtggctatgcagacagtccccaggtatggctggtgaacagcacgctttatgtgtgctatgtcccagacttcctggctttcttcccttccgtcctaccccttcggcacacactacatatctttcacattttataaaatcacaggagatttccaaattattgtgtctttcaaatactttaaaaatatattgtcctcctaatataaaggagagaggtggagtatttagctgatgaactgaatttgaaagtaagtttgcatttttgatatatttccttccttatgagtgagtcatgaaaaatgcatattttgtctaaatattgataaagctttagaatataagagctggagtgaacctaagaggttttgtagcccggcaatttccaacccaggatgtgtctcagaatcacatagagaggtttcagattcccagccaggcacagtggaatgtggctgtagtcctggtgactgggaaggctgaggcaggaggatcactggacccccagagtttgaggccagcctggggcaacatggtgagacccctgtctctaaaaaataaaaagtaagtagaaaatacaaatcacagattcctgggccttttccttcccctgccttccccaagtgattctaattctatgtcagttttggctgcttgcaaccagttatggagaccagggatcttgatcaatctcttcatctatctgatgaggaatctgagacccagagaagtaagaggtacagtgatttctctaaggttacacagtgtatgagtccatttgcacactgctgataaatacatacccaagattgggaagaaaaagaggtttaatggactcacagttccatgtggctggagaggcctcacaatcatggcagaaggcaaggaggagcaagtcacatcttacatggtggcagagaagagagagcttatgcagggaaactccccttttcaaaaccatcagatctcttgagacttattcactatcatgagaatagcacaggaaagacaagccccctgattcaattacctccctctgggtctctcccacatgtgggaattgtgggagatacaattcaagaggaggtttgggtgggggtacagccaaaccatatcccacaggaatatgttacaagtgaagatagtctatggacactgtaaaattgaccccattagctatatcccaaactagttcattattttagaatctattttgtgtgtttgcatgcatacagcaatgcttcacatatctgcacaccacttatgtggcattccaaatatggttaagaacaaacaaagtgaaaaagacctgcaagcagccaaaattggtactaaataaaccacacataatcctccaagtctttttaaaagcctcttctcttgcttctctatctagtgaggcataggtgactcaaaatctttatctccaagcccggcccttctgctgcactatagtgtcgtgtctccaaaagcctagtggaccactcacagatacccagtcggcaccttcactcagtgtgttcaaaattaaacgtgtgctttcccctcccaacccttctcctgctttgctgctctgtttatgactctactaaggttcaaaatcatagagatgtgtttggtgtcttcctctcccttgctccccaaatataatggattaattctcccgccacatttcataaatcagtttgccatctctgttcattccctctgcccctgccctagttagtgccttcattgcctttcacctggactattgtaatagtctcctgcctgatcttgtgtcctctggtctctccctactccaatccattttactcactgttgccagattaatcttcctgaggcacagctctgattatgttactctcctactaaaaactttcaatagctccccactgtctcctgaataaagtccaaattccttgccctaataatcaagtcctttcactttctggtcccaatatacttttaccgctttatttcccactacttatcttcacacattccatgctcaagttaaactcaattacttctttgcagaatctttaccctttgattcttccatgcttttctcatgatagagtaatgttctttccttctatctctgtatgctcaaatcctgcttgtttttcaaagcccaaatccagtgtcatcttttctgatgaagccctcagttagccctcctctgagctccaagaataccttatctgtactacttttatagagcatttcacttttcactattaattctagcaaagtagacacatgtctcagctccgttgctagattaaaacttctagggcaagacatgtcttatctgtgtatcctctccagtgccaagtatacaagtgcacgactcacaatatttgtcaagtgaatgagttcatgtatgtactttacacacaatcaaaacatgtttttttgttttattgtctaaagaagattagaaataatgcatcagagaaggaatgaggatcttagagacttgcacaacagaaagtaacttaatagctaaagaagaaaaataaaaactacgaaaagaaggcatgagaactaaagatatagcagtcagagggtaaagaaacacagaagcaaataatcttatagaataaggaccaaatggttaattgagaagcttggaaaccataaaataacattcaaatatgtagcattatttttatacttccacaccctcatcaatagaaacaaatttgaattgtagttcaagataacaaccctgaatcatttagaaaagtttgaattatggtaagtatattcttttttttgagatggagtcttactctgtgaggctaggtaaataagctgcctttattaatgaagaaattcatatttttctgaatattagagaaatattaatttttcccaattaagatatgttcatgatatacaatttagaaaatataggagagtaataaaaaatcttaaaaatcctaaaaaaggtgggattataccatatgtattactatgtatgctgccttttaacttaatatatagtataaatagttcatactattataggttcttcataaacatttactggctcaaaattctatctaatagatatgtcgtactatacttaacacagcactctagagttgaacatctagcttatttccagttttataatacaaatatgtctaacaagatttaccatgggctgacaactgttgaagcagagtgaggaactcatgagagttcactatgatattcttcctacttttgtatatgtttgaaatatctagaacaaaaaggtaaaaaagcatatttatgtcttaattcatttgtgttgctgtaacagaatattataaactggctaatttaaaaagaaaaaatatatttctcacagttctggaggttgggatgtctagtatgaaggtactggcatctggtgagggccttcttgctagatcatcccatggtggaaggcagagggcaagagagcacaaaagccagagagcaagaaggagccaaactcacttctataatgaacccactctcatgataactaatgcacacactcctgcagtggtggcattcattcattcatgaaggcagagccctcatgactgaatcacctcttattaggccccaccttccaacactgttgcatcagagattaagtgtccaacacaagaacttttggagacacagtcaagccacagccatatgataaatatcttgtgcataatggcttttgtttacttgtaattattttcttaggttgcagtttagggctagactgcctggatcaaagtcttaccccatcattacctagttatctaaccttgggcaagctgctgatgctttctcagcttcagttttctcatttgaaaaatgggtataatggtaacttataggggctgttctaaggatcataagagaagatgtgcttctaatcccttccacagtacctagaacactgttagtgtgcaataaatgtcacctttgaaaaagcaaaatactggttgcataattatgcgttgtgcttataaagaaacatcacatataaactgaaaaacatacctgaaataacatgcttaagtgtgcaccatttctatctccaggctaaatgcttatttcaaagatacgaccactgctaaaataatttagatccataattaccattacgaagcattttctatgtggttgatattggccttactgggctacatgtttgatgtgtactatctcatttaatcatcataagagttttctgattactttatagataaagaaactgatgcttaaaggtgaattaatgtgcccaaaaggacacagggtctgttttcaaacacaggattgaacctctggaattcatctctaagctactgaaaatgacctttgttccctgcactttttttttttttttttttttttgagatggagtttcgctcttgttgcccaggctggagttcaatggcacgatctcagctcaccgcaacctctgcctcctcggttcaagcgattctcctgcctcagcctcccgagtatctgggattacaggcgcccaacaccacgcctggctaattttgtatttttagtagagacggggtttttccatgttggtcatgctgggcttgaactcctgacctcaggtgatccgcctgcctcagccttccaaagtgctggcattacaggcatgagccaccgcgcccggtccgtaccctgcactcttttgcatagacttcagtctttctttctttcttttcttttttcttttctctctctcttcttccttccttccttttttctttctttctttctttcttctttccttctttctttctttctctgtctctctctctctctctctccctcccaccctccctctctctctctctctctctttctttcttttttttgaggcagagtttcattcttgttgcccaggctgcagtgcaatggcgcgatcttggctcaccgcaacccctgcctcctgggttcatgagttctcctgagtagctgggattacaggcatgcgccaccacggctggctaattttgtattcttagtagagacagagtttctccatgttggtcaggctggtctcgaactcctgacctcaggtgatccgcctgcctcggcctcccaaagtgctgggattacaggcgtgagccaccacacccagcctagacttcagtgtttctaatctttattcctcagaggcagatatgaattttggacaaagttttggtccaattttggatgtttaactggacctttgggtaaagtacctttctccttcccattcactttaatcagaattatttatttaacaaattttattctagcaaacaattttagagaagaaaaagtagtactccataacaagctgctcttaaaaatgcatatctcattctggaaaaactaatagctatcatggttttaaacaataattttccattggtttgattatcttatgtccactgtgaaacaacagttcattattaaacaattcattatcaaacacacaaacacatatacacatttaataactttaaaacagtccatatttacatattttactttaaatatgtaatctgaaatgtgtatgcatatgtgtatgtgtgagagtaagacatagaccccggaagtctgaatttggaaaaaccctgtgaaagtctgaaaaaggtggttttctacaaaccttatgaaaaattaagtcatagaaggtcacaattttaaaaaatagataccaaattaagtattttattctgggtttagggaggcttctcctgtgcaacatactttagaccaaggcagtcaagaaatactaaaggggatgctgcaattcctctgcctcagacagtacatttatgcatctgtattataaaaaatgtgccagctctagcaagctcacagtactgagcaaagtgctatagttacagctggctctgtttactctttttttttctggtctgttcctctattgggggggggccacagtagggtgttttttcaggatggggggaagaaggaaggagtttttgtgagttctattttggattttggtgaataagaaagcagagaatttgctagcctgttactcagttacactgaaacatgatgcaaactgactcaatttggagcacagaaggtgctgaaaaatttttctaaggaggtcttgaaatatctaagtctgccttcaaggaaggacttataaaaaaaaatcaccatgtaaataatagaagtatgttgctacttctcttaaacctgacctcttaagtcactactcacactaatatactctaaaagtagccagcatgatatttcaaaaattactttgtgtcctttatcctcagtagagtattaagaggaagatgcttgagtgtagacacacatgtgggtcttctttacaaagtcacgtctacatatgtacaccgttagaagtatgggctctaaatgattgaacaagctgtatttccatatttgtattgtccaacctattttcttttttcttattttcctgaatatgtctgaatatatgtgttcagtataaacatacaattgtgtggacgtgtctatgtgtgtttctaattctatactatcttgaaaatggctcagcgttctagaaatacagccacataatttgttttgttttgaaaaactgctcagcaaatgcatacaggtcataatggcaggtaacagaccatttattgaagtgctgaaacaaatagaaaacaaagtccaggacaccatcacagagcagtacttcccttgtgagatactctcagctaagtaagaattgagtgagacaacaataaaacaaatacccataggcttttcaaacagtaacaacccgctcagggttagcagcatttctagaccttgatggtacaatgatgttctcaacctttgctttcagacactggatcactgcttaagtagcctttatcttttccccctaatttttgttgaagatgcccttgaaattagattatatttgttcctaacaaagcatatgtatattgtggcatcactcttaaaaccaacaattgggcttagttttatgaagaaaaaaaatccaccaacctttcatgctgagatttctcatgctagttctcagcacagaagtgattttttttttttaagttgcataaagcctagcaaggtttaagttttcccagcaaggagaaagtgtttttcagctgttaaatttttcagatgctttttttgaatttggataaaactcaaaaacatgtttgttttaaaatgtaaaccttttcatgtacagaggtttgcatatagagaaatgctattactatgtttaaagatacttgcttttgaaataaggaggtcacatgcatttaaaaataacaaactgcatgttgctttatgaatgtcctattaagccctaacgtaaatatgatgttctggaggagcactgatgcacacgtttgctgataggatcacttacaacactgcttgtggatgtatttccatgtgagagcaaagggtggtcaggtttgaactgaagaacatccatatagtcagctaatatgctttttaaagaccttttacctcagttgcaacacacttctttgtcctaaacctgctggattactcaacttgttggctggactaaagctgacacaatacatatttcaagcacaaaaatgatgaggaacacatagggatgtcagcaaagaggcaaagaggatggtaagtcatcggaaggctggtcatttttttttttttaaacagttcaatgtctttactgttttctgtaatattatcattttccatttttcaaacaatggaaagaacaacaattagtttcatttttaaaattattagatcataaaggacaagtttaggaatattgtttctagcatactaatagatgaagttagttgtaaatcaatagtcttatttctctgttttaaaaaaatagcaaaatacagtattctgaggaaagttctgacagattggagtgttacaggatagtctgaaatctgtttcattatagaagtttggccaatatagagataatatattttaaatggcttaagtatatattttttgtggattgcacattctgtaagacggtttgagtgccttgagatccaagtctttaggtcaagactgaactctagaaatggccccatcgaatctacaaaaggatacattaaaaaaaaaaaaaacctcatttcctgtaagctgctgatgctactcaacagagttgaaactcaggtcacacgcatcctactactctagtgctgccccatttactaatccaaacgaggataaaccctgagagatccgttatgtttctacataaggagtgtacaagcttctcttgaaaatcattgcattgggagagacacagagaaataacagaggtgagaatccctccccgatttgcttgctaaatccgtattcattcctgaagatccagatcaaataccacctgactgttaggccttctctgagaaactctattttgcaggcaagtattggaacgactctatgcgcatctccagtcccaatgcatcctttaaataatctgtttcctctctgtttcttgctgcattacagacatctgtgttacacatccatccttccctaatagtcagtggactcttttaggtgaaggactgtgtctctatgtccctatgctgaaaggacaatgggaagagatggtgctattgatgcccagaggcctgggtcaccagggaagctggagtcacagcaggtttgttcagagggagtaaaccacaaaggaaatgtggctggtgatgatgatgatgcaaagaacggtgggggaaatctctggcctatgccttctactgaccctcttgccactcacaagtgtctcacaagcaccaaatccaacttggaatctagctgacatgggtcagccactgttgtagagcaagggtagggtgagggttgggtctgagggtaaacacatccacaatgtgggagcaggaagatgtctttgcaggggggtgtctaggactatggacttaagataacctcacagggtcaccatgccccagcatgacccagaagggcccagagcaaggaagacatgacaaaggagcctgaagacttgaggaggccttggagctgggacaaggaagacacatcagggatctacatggacaggaaactaaagatgaggtgggctctcagacatctcagggaatttgagctcagaagacaacactgagaagaccagacaccatagtgagtagactgtatctaactgctctccaccctcactttcatattgcatttggatggcactccaaggaaggggagaggagaccacctagcagaatggaggccaaatctgagttacctcatagataaggaaagaaggcctgtgatttttaatgggtcagtcactcttaaattttaagcaaactgtagattttctgaataggagaagatattatcttaatctacacaaattttttgttgtttttttggcagggtttaaaatatttttattcatgacttatagtagaaactacattttatattgtgacccagtaactgtttacacacatacatggatgtatgtgtgtgttctggaggtagaaagtaaccaatctgctcaaattttaaatattaagattattcataattctttaagtagtttattgtttggaaagttatagaccaaggtctagaaattcagcagacctctaacctctaatcaaggacttttaaaaattaagaacagtacctgattttctgatttagtctttgaaatgccagtgctattcattctttgccttattcactcataattatttattcattctccaaacatttattgagagcttactgtatgctttatactatagacctgcagcacaaatataggcctattacttcacagctgctttaggatttatagcagtactggtcagatagttcttaaaaaggaaaagttttcagagtgcaacaacctgttcacaataattcctatgtagcagtgaagagccttgacagcatctcttttactttctcattgtggttctagtttaataacataagtctatttttacttttcatatttaactttaattaaacatgctatgagtgcaatcatgagattttaataaattagactatttgaaaataattttcccataatgatgtcttcctcatatctttcatgatacacaaaaagaatatttgtacaaatattttgttgcttcaaatatgcagaaaactgaccattatttacagtgattttgaaaataaatgagtgaaagcatgcgaacttataaggagagtaaataagcagcacaccattaccatctgagacagcatggctgctcccctcttggtgagggcagtataggtacagcaagcagaagacagatcataagtatttactatcagaccttctttaagtgaatatgtcctattccagtagaaagtatcatataagcatacggcctgaatccaattcaattatttacatggctctaccagtaaatggttaacactgtagaccagaaatttagaaaatgcagaagactgaacgatatgtaagtgactgagaacatgagtctctctcctcatcatgtaggacatgggtcgaggtcatagacttaattggtaggagttgctactttcgaagagtgaaatgctttgaggcttttaagagaattttaagttgattaactttttatttgggggaattatgatgtgagctttattaaaatatcacaattcggcattgtttcataaacataattataggccaccttttcaaaaattgcaagagtagtactaagaaggtcctttgaactaaggttcaaaggaccttcttagtaactcttgtaatttttatgggtacagttagttgtctgcataaagtcattccattttccaaagctgcttactctttgcacaaatgacaaattggcacatgcacaatggcacaggaaaagaagtaactgctaaggtcacatatgtgaggacgttgcagcctttaagtactggaggccaaagttaccagaaacatgggcagacagattaaaattttcccttcttatgtttgtgcattgtttctatatggaaaattacatttttctgagagtatatgtgtaaatatgcatctgctagtgttttggcaactctaagttacctaaattagttttgatcaacactgtcggatttttaaacccaccaacgtaataaaagcaagtttaaaaaaacacaaacaaaccctacagtacattgtgtgctctgctgttccaagcctcagcttcaagacaaaaggagagcgagactttgtcattcgctagctgttaataatcaagagaagatctgccagacaagctcttcgagggctctgtctgtctggaccaggtatatactgcaatacacaaagggctttgcagggggagaaaaatgagtgttcatggacaatgatgcagctttcttaattaagattttcattactgatacatacattaagttctgcaactgcaagagccaaagcactgtcatgtgcaggtagatgtccctgattccatcttcaggcagtaaagctaaaacatattaaatgtgcacccagcaaatgttgtgggagccaggagagctccagaaatatttttgttggaatgcagagaggccccattataggcagatttgtaatgcatctaataggcaggagaaaagctcatatcaatagagtgtgtgtgtgtgtgtgtgtgcgcgtgcatgtgtgtgtgtgcgtgagtgcacgcacgcacgtgtatggaagtgctttgaggccctggaccacagacaaaggtaacagtagctgatctagaagtaatccccatataataatataatagctcaggtcttaaaaggaactttgatcttttaaatttgccaatgccgattgttgagacaggaaataaaggattgatttggtagcttttggaagatggtaaggactcctgcatacagccagtcctgactctgcccctcctgggtcactcagtctattttccctggatccgcatgctggtctgaaagtcaatgcagtctgccaaagtggtatactgttcccatgaaataatccaactgtggtatggagaaatctttttttcttagaccaagttatttttacaaaaatacttttgcgaagaaatgagaggaaactaaaaccctacacaatcctagaagtggattactgtctagagtgcatgttttttattccatcttataaagcctaactcattttagggtggctagtgcagttaaggtgcagacatctcttggttgtttttctggtgcttttacttgcatgctttcctgtttccaaatctgcatccatattgggggttacccacagagagctgttgtctcctctctgaagaacatctccatcttttggtcactacttgagtagagatgagtgatgcttaatgaaatatcattttattacaacggtcaaaaattatggattcatttcttattagattatatgctctgaatgttcaccaccccccaattcacatgttgaaacttaattgcccatgtgatagtattaagaggtggagtctttaggaagtgattaaatcatgaaggcagagccctcatgaatggatttgtgcccttatataaaaggtgtgaaggagctgtctctctcccttttcctcttccaccctttgccatatgaagatacagcaagaggtgcgatcttggaagcagagaggacttcaccagataccaaatttgcaggtgcctcaatcttgaatttcctagtctctgtaactatgaaaaataagtttctgttgtttataaattacccagtctcaggtattttgttatagcagcaaaaatggactaacacattaggtacaagcatttatttgacatttaaatgtaatccctcattttctaagaaggaataagccagaatccaacatcaaaatgtttcaaaaggaatacttcaaagtgttttagctgtagttctttgtcgattaaataaaaaaaaattccaaataatggtggtcagtaagagtgtgtgtgtgtgtgtgtggggggggggggcggtgtatgaattcctgtgctaagattcagatctttgaaactgttttctagaatgttatcctacatgtctaaaactttttttctaagtgtatcagagatttgggatggagtggtaaacacataggttactaggaggtggcttgcctctgtacccattctagatgagtaatgttaatgactgatgataatgtaatgatgaaaaaattggttctttttaagtaaatagatagtctacagacaccctgtcaacagatagtgcatgcttactgaggaagttaacagtgttaggattcttcctaacctttactgaaaggtactgttataaaactggtagaggagtatgtgaaagctactggtgaagaaccaatgcagtgaagattattcaagcatggtggtgatggataaaagcatagaaaaaaaactcagaaaattattttgactgaagacttttcattacttttcttatgtgtccttgagtagcttataaggactaggctgaaggctactattaaaagatttaggtgtacctttcactcatgttctttcatgagacacacggttctctcattcaaagtacaaggttaattttaaattagaggtgagaattattcttcatgtatcaaaaagcctagaaatttaccagggattaaaggtagaacccattttagcctatcgaagtgtgagaggtaaggtgacctgtttagatgaatatcttgaaatgattctctggagcatgcctgatctgttctcaatacccacacattagaagaaatgaagaataatatagagactacacaaagagaccatgtaaaagaagaaccctgataaaagaaaaaaaactcttaattttatcactgcaaagacttcttgtacaagatgcctctgcaagtgtcctagtagcatgactccttaaacaagtaggatgcgtgtatgtggaagatatatatatgtatatataacatttaaaatctccctcgaaccccagcttctgagtataaactatgttacagaagcatgtggataatatgtgaagctttctaggagcatcattaagaaaatgagacatttgacactctgagccctaggtacactgagtcagtggcatggtctccaagggcactgctggcagcactaaagcctggctcataaccatatgtgcacacctcaagaggtgtttgactgttcaggtagaggataagccatttcctaggcctggttccttccattctccttagcttgtagttggcctgaagggacttcctagactctaacatgtttgcctctcttttgcttcctttctggacactgtctaaggatttaaaacacacatgactttcatgtccacaattttctgccaaagagggggaaaaatgccccagagcatgtcatcccttaccatctgcaaatgaacttctgtggtcaaggaatgctccaattaccacccagaacagctttgtacaactcctgaccctcgggaagactcgaggaactcactcccagaacccagatgctccctgtcccagaacacagggaagacgccctgtcatcacagtttgcacggcagaggcggaggtgatgctgttagtgtggtatttccaattctctagcgtctttcactttccctgaagttgctgaagaatattccatttcattaagtatgtagtaatacacatgggaatcagagagcggggaaagatggaggacgttgatgacatggcctctagcactttatttatgagaacatccagaaatctctatctacatctgggagaagaataatgtcaatcctgccctggagacatggatcaggcaatgttgccagtgtgtatttttcccttcccaataatttactgattctggagtctaaggcagagcgctgatgataatttttacattcatgtgagtgagcctggccctttgagggctggtgatgccaaataaacataaatgtatgtaaccaggtgaatacttaccacctcccaacccagaaatgtcataggtctctggtggtgctttgcttcccacaacactcccctgaagggcggtgagggtaggtgttgccatcagagcataagaagcagagcttgaggtggccttggaggacttcagggagcactgcctttgcagtaaagaatgagactaagcaaacaaacctgttagacggctcatttgtcttttccaatttttttattgtgttattcatcctttcatcattgatttatagctattcttaaaatattagggatatatcacaaatatttttcctagtttaaaaaatgattttctaccatagtaatttttattttcatgtaataaaatttaaaatacatgtattttttaaaaagttttcaggctttggttttatgcctggaaaatgcatctcatacctccagtatgaaaatattcatgtatatggcaaaaattatcactgaaaattacagaattagtgaggatgcagagaaatgggcagtctctttttttgttggtgaagatattaaccaatgctagaggacagtttagtaatgcattttacttttgcagttccactataattaattgatcctaaggaaataatcatgtaagtgtacaaacatgtgtacatatgcatgtgcatataaagacagttattgtggcattgtttagtaagaagaaagttccaaattcccaactgtccatcaataagtgattgagtcaataaattatgcatatactgaagtgcaacgttgttgtcaaaagataatgtagatctatatttattaacatggtaaatgactattacaatgttaagtgaaaagaatagaatacaaaacagcaagtaacttctcctttcagtctggaaagagaaagacaaagagaaagaaaaagagaaagataaacaggactgtatggaaatataatatttcctaagttattaatagtgattatctctgggctgtgagatttcaaaggaatttaaccttgctctttataaatactatcaatgaaacaaattcaagcaaaactaaatgtatacttttttagaattaaaaattagaacttttattttgggggaaaaagaacttacctaaaacctgcaataaatacttaaaaattccaatatgatcttcagtcattagcaattactaactagctctcttagtagggtgacatcaatgtctgcctcaagtttcccccaagtttgacactttgagatgtacatcatagttcttcccttaaagaattttaaaatataaaatttcaagtagtgaatataacccaaatatttttatctagggcatggttaggtaaattctgggggctttatgtgatattattcagatgttatagtgctatttataaagagtttttaattataccaggaagtatttattatataatattgaattaaaatgggatacaactgtatacatgcaatgtatgctcaggcatgttaaaatctagagaagacactagaaggtgatctaaaaaattattaataatagttggttctgtgtagtggaattatggatgtttcccctttactctatactttctaaatatttcacaataagtgtgaattatagaatcataaaaaaagtaaatattaaaaaaaagctgttttgctcgacagctgccaaattttaccccagatgtatcagcaatttagcttttagtcaaatgaccctaacatcatttcctaaagggaatatcacagaatggaatgtgcccaaataaagataagccatcacggccaccacctctttctaagctatcattttataatgcttaaaataaatctgagtaagggatctttcttctgttggaagttataaacttccacctccttcagaccctctccatatcttctcttgcattaccagcacctggaatttataattaacctatagtaccctggtacgtttctaggtctggaagctgtttttggaggctgatggtgtagatcaccattagggatggaggattatttattcattttaaatgggagttcccttgaataacaaacagggatgagctgctatataagatcttgtgtagttaatatgctttcttacccttcttatatatatatttattgattgattgattttttgagatggagtctcacactgtcgcctgagctggtgtgcagtggtgcgatctcggcttgctgcaatccctgcctcctgggttcaagagattctcctgcctcatcctcccgagtagctaggattacaagcacccgccactatgcccggctaattttttgtatttttagtagagatggagtttcactgtgttggccaggctggtctcgaactcttgacctcgtgatctgcctgcctcggcctcccaaagtgttgggattacaggcgtgagatcccgtgcccggcccgcttccttcctcttctttccatccctcccttctttcttcccttgttccctctctcacctgtctacactcctgtctccagccctcttaaataaatagcttttctgtagtgttagatgccagctcttaacatttagagacaattcacactataccaataccatacttcaagtagatgatctaattgtttctaaatcatcatattttagcaaaaagataatgggagaaatcaaagttgtctctcacatatgtatgatgcatactagaggcttggcaataaggcagagagtagatattttttgagaaagtaaataacaaaacaaaacaaaaagccaaaacacaaaaacaaactgggtattgtgaggacagggcagagggaaggagcaggcataagaaagaaaaggaatgacatcggtctcctggtccttgcaaaggttattcaagtccctgttcctggtgttttggaccagatatcagcctacaaaccaccctggactgtgagctatttgaaggcatagatggtgtcttactcacctctgtattttctgtaccaaacacagtgcctgatacaatatactcaacagatgcctggagaatttaactaagccctttcactgccctttcttactggcctcagctagaaccaaaacaagaagctaaaactcctaatgccacaaatgctaggtgaaaccctatcctaattcaaactcatttcttctgattttgcaccttggtccccaaactgctggagaaaatcccatgacagagcagataggtatcaacatcaacccaccagactcacctgcaccttccacactgccaaggagagtcctactgtatttctctggtcaacttgctgtcccatttgtctcaagaacgatttcaaatctctactttccttaaatctcttccccgcttattcttagcaggaccttgcccctcagtgcccatcacttgggaaacctcttaacctttcagtaccaaatctacacgtgggcttgcatctgctcctttcctttactcctcctttcttacaaaaatagaagatgtgtccctccttccatctctccacttgtactcaggattccatctctctggccttatcagtaatcttatactgccagtcatcctatgctcttctctcttctgcacattggatctctcctctctacggtattcttcccatgaaaatacaaaaaatactagtgtttccatgcttttccaaccttcttttgacctcacttcccccctcaagatattgcagtagctcattttcctttccttcatagcaaaacttctgagtggcccacatttgctgtttcttcacttctcattctctcctcatcccattacaaacacgttattgttttgaccacttcaacaaaacagcttttgctgaggtcaacaataagctcaaaattaatataagcaatatatatttgttagtctttaacctacttgattgctcagtaacatgtcacatcactgaccactacctttgaggcactctcttggcttctgtgcctatgttttctgattttcctgccaccttcttggtggctccttctgagggtattttatggcctcatttttttctaccagcggattaaatattaagagctcttcaagtctcagtttaggtcttcttctcaatctaaccctgtccctaggcaatgttattcatgccaacagattcatttaccactatatgtcgattaccctgaattcatgtctccagccttcatgttacttctgaattccagttttatgtatataaatacctgtgcaatatgctcactatgtatctatccaaagtacctcacactcaacatctcaaaaacagaacttacaaacttctctccactccagtcctcctttggtgtttcatgtaactgtgaatggtattatccttcatatagtttgataagccccaaaccaggagtcattgttgccacttctctcttttatttcacataaccaaccatgaaaaagtccaggaatattttacttctgaattatctctcagttccatcaatttcctcccatttccactgtcaatactctagtctgcctcttatgtggtctactggaatagctccctcactggtttcctcatatccatttttgatccttccaaattatttaccaaagttaagctaccttgatatatatttttaaatttttaatttcaagataattttagattaacgtgcagttgtaagagataatacagagagatttgttattctttttacccagttttgcccaaatggtaacattttatataactgtagtacaatatcacaatcaggaaattaacattggtgcaatccatctgccttactcaggtttcatcagttttatatgcacatgagtatgtgagtgtatatttagttctgagcaattttattacatccatacactcatgaatactaccacagtcaagctacaggacagttccatcacaaaagatcccttgcgttatcctttatagcaacactcacctccatttctatcccaactccctaactttgtcatccacaagtatgttctcaatccttacatatttttttcatttcaagagtgctatatagataagaatcgtaacagtacatcatcttgagattagctttttcacccaatgtaatacccttgtgattaaaaccagttattgtatgcatcaataatttattctgcttagtgctgagaggtattccatggtatagatataacagtttgcttaaccactgacccactgaagaaaatgtgggttgtttccagttttgggctattacaaataaagctgctatgtacattggtgtaacataatgtacaggtgttgtacagttatgtttccatctctctgggataaatgccccaaagtttacccttttaaaaaacaacaatgatcatgccacagtccttcttaagtttgctcctctactgtccttaggataaacacaaaaatccttaacatggcctaccaaggacctgttatcatcaggccttacgtatctcttcaacctcaacctgggctgctagtcacctttttctctctgtgcagctctcttcagggacttcatgctgttccctctgcctggaatcctcttccaccatccatccttactttttgtttttaaccttcaggtgtcatctcaaatgttactatttcagagaagcttctcctgaatttccagactcagttaaatcttcttcttttatttgcccttagagcacatggtacttttattatatagtggtaagcacaatttgtaattacaagttatattgtgagaccatttgcttagtatctgtcttacattccccagattataagctccagaaggagagagactatgttaatattcctttattatatatacctttagtatttagtagacactcaactttgtgtccagtaaaatttggctgaggcttttaagacatagtcctggaatcaagttctatctctaccatttattagatgttcttataaaataaatcaaacatgttaaatctcagttttctgatctgcacaattaggattatagtagcatctacttaatagggtagttttgaaggttaaatcagatagccatgaaaagtatttagtccagtatctaaagcaaggcaagcactcaataggtatttcttattgttattattagttgaacaagaaactagagtttttgtattttttttcctaactaggcttttgtccattatcttcatttcttgcctgttcccccaggttctgattcttgtaacttttgagactctgaaaaggggcccttagtttagatcttggataaccagtaggactactggttcttaccccaggtatatgctctcagaccagatgtggctctggttcccattttcatctcactcagtacttcctcctcttgttttccagtctatggatgtcagtgtgggtaagaatgcctcttccctactcctagtttccagatgttttctaaacactgctttcctcttgtctcattccttataattccccatggaggcaaagtatcccattggtgggaaagcccttggtctatatttctcaggtaggtagaactgatctatccaaatttgtaagcacaggagtttaacctctttgtccttccttttctactgagactatcgggaggtgatgacctggaaagtgttgctcatatgcagatccacattttcctgtaagagagcttttgaaaggtttgactgaagggaagagagtcagcaaacccatttcctctttacactaagctatgctcttcaaccaacctttataaaaattttggttccctagctatcagttcttttgtcttatttttcaataggtttagaattcaagtggggaaaagtgatgctatttatgggccccctcgaagattccaacactttggtatatgattttgcttggaatatgattctgtttctcttcatcttttttacattttagccagttttcaagactcagctgaatcagttttacatgaaactttctagcctgcaaggctctttcatgaatgaaaccctatggtacttcctggactgtatcattccttttggaacttagtcatttattatcttatgtgcatacacaacgctcaacaatataactgtttttcctaactcaattttaaattccttaagagcaagaaagggtcatgtacttatggtatatttatgctttaactatccaataaaaattattctttgtacatagcatgtttttaataatatcttaaagcgtgaatgtgggggagagtggcctactgaccaggctttgatttgaaggcccaaggtacaacggaaatggcttagtagctggatggttcctgaagaggttgtcgcagtgcagtggtgaaagaaagaaaaggttactatgggcatgtccctgaggtgtgtatcagtgcaagtctgtgtatacacacacacacacacacacacacagtctctctctctcttacatatatatgtaaatagaacttaaatctgtcttgtgctgtgttttcgccttagtaatactttatttctcttattaaaaatacatggaactcaccatctgataggtagaaaggctaagagaaatgcaaccagagggaggtaatattcctggctatagtcgattggtgttcagagtgttttgattctctgaatgagtcaaaagattgaaaaaaaaatagccactcttatcactaggaaaagaaatgaggaggaagggtcctgaaaatggtgtctgagcaatgaaagacagtgaatattttaaagatcacaaaatttaatttattcaacctaaatgcataaaagtacaggtggggacattatttatgcaggtatatgcaaatcactttataaaataggcaaagcccttctgctttttataagttgccaaggtggttcctgatattttaaaagctatgcacctttaatgtaatttcctaagagttggaatccctctgtcgaaatcatagtcattgtcagagcaagttgatttttttttttcctatcctctgggacatttacaaggatcttataaccatcacaaaaagagtggtttccacagagatgtgactggaaaaatcccttggaaattgctgaggagcaagtcacagtgttcaaagcaaagaacataggctttgaaaacatgaacccatctgacctcttgaatttagtacagtgaattcctgagctctgaaacatggggcccggctgtgcatgccatattggtgctataagactggcagtaggttggctgtggcatggtctatttcaaactccttcacagtgcccagtgttgcatgttcccagatgacatttggttggcagaagctgggcttccaaagctggcagcctggaatgcagcccactgtgttttgacaaacacataattgaccatctgatcaccagcctacgttctgcactcaggtcactgggggacctgggctttcaataggtccctactcctcgtcttgttcatcttcccaaacctttctccagaaagcaatatagagaaggcttaaacacacccacgcatatcctcccatttgcaaaagagaacatagtacatgaaacataagctgttgaaaatttcctttaaattgtcctggcagcccaaagtgaacaagagaaaagcacacttatggtgaactctaattcagagagaaggaatgaatacactgaattgtttcaacacccggctgtgcataagttgcaattcagttcaatggtttggaaattttgcttagaaaaagggagcaatgagaaaatgataggaaattggggcattgattgactttaggggggcattatttagaaactgtttcattttcaggtgaaagaagagacaagcaggacactgggaatgtcttctccttatctgcctgctcctccctcacacccactatgggcagtaggaggcacgcgagcctggtgaccagggggcagtagctcaaagtgaggtcatattcaaattgaggtctttgctgaagatcccataaggatgtattttggtctgaaatttgactccacacaatgtttcagcctttctcctagaaggcaaagattatgcaataggccaagatatgctggaattacacaaaggttaatgtctatttcaacactaccaaatagcctctccctccatcctacccctactgcacagttcaggcctttggcttttacctttgacctggtctccctattctgagtcagcctctccactttcaccaagtgctctttctaaaacatacatctgcttacaattcttcaaagcctccttgagcctgcaggatcaagtccaaactcctctgcacggcatacaaggtcctccgtatggcaggcaaggtcccctgcctgctttccagcccaatctcatactactctttcaaccaccatgtttcaatcacactgaactattcactcctctgaatctcgctgctacttaacgcctcctgattttgtaaatgctcttacatttttcttgattatgatccccttttctttctgctctttcatatctacctggtaaactgcaatttactcttctgactttaagacccagcctggtcaccttaccacatccaagtgggcactcctccttcattcctcttactacgtcttgtatatacctgcatttcagtgcctatcatatgctatagtctttattcacttatgtatctcccctatcagactgagatttctaacaaaagaaagcatttcttatttatcccggagtttccagaaccaagcacagtgactagctttccataaatgtttgttgaatgaaaactaaataaagagctgtacatgataattaatcaaaacgaagccaagtagtagtgttagcttttataagcatagtaggagcccattagcaatctaatgaaggcagaagatcccagcagtaaggcactttctgatgggtatggcaggggctggtgactggctggggtgacagtaagagtgagggataaattctgtgatggaggaaggtctttttaacagagactgccactaaggctgtaaattaacacccttttcaagacttaatattcaatactgaaagatattgtcctgagaataaatctgaatctgaattgtatagagacctaacttataagaaccaagtttcccaaataaggtaagtctgtgctacctgcttcaaggtagcatggcagattatggagggttcctctttgtttctgctaaacagtaatggaatgggaaattcttgggggaacatctgagagctcttcagttcctattgaaatccaggtcaaatacagattgtgatactggactaaatgcactgctaagagaagatcgaacaagcagaattctgtacctgtttagaggaggccattgaagaggcacttggagtcaaagcactggggagataatgttctgatctgttctcaagggacattggacatttcttttccttttgtcgagcctctggggcaccactctggagccatcaaccatcaactgtgtctatgggatacttgaggacagtaggactgtcataagcccggtcaccctgctgatatgagggcagcttcaagatttggaacaagccaagcaaacatgaagcctggcccagggatggcacaaggtcatgggtatatgaacggattatctgctcattataggtcactcccccagccttatgtgtggttaaaaaataggatatctctagaagctatgcaactgatggctgatgtagcatagaatcagatttgcattttcctatgagccagagacagcctttcaactacactttttatctcaaaagtctcccccttgattcctaattggtgacacaggtcccctgtactgcttgtgtctgaggctcgccctatagcactgacgtcacaatagctgagccgtgcgggcaggagtgcactgtgctgactcatcccggtgatgtgaggattaatgccttgtctaacacagagctattatgtgaactgtttttacacaaaagaactgtaacaaaaatgatttgccagtcagaggactagaaatatgcagtgctaggtaactgaggggagggctgtgcagatataaagtggtaaccataagcatgcatattgacatcctccaaagcatttacagacccactctatcaacactgaaatagagaataacaagacttgtcagggacaggtaggacccacccctgttgtataaatgcattacacacagctccagtctttggggagtttaatcaatctcctttctctgtcaaataaactgtcacgttacactttagccttagcatcctttggaggattctgcctccctaaatatatttgccactatcttctaggaatgttagtggaaggcacgcataaacaaaatagccatgggaacctccattctgtgcaaatgattataatacaagaaataccttggagtgaagagtcagtgaagcaagatataatgttgtgaataaggaacagagctcaccagagagtgagaagcagccagaggataccgataattatttatcacattaggtgactatcactacctgtaggatcttttgggtggtgtctcttataagtgactttgattatttgggttcattggcctagaatctttttcaagcagttcaaaataaaatttatttaaacccattcagtgcagcctggtttgaattttaaataatgaacgttctcttttttttcatataaaatcgtgtttttttttccccccgaatacctttccatcttttctaaaaaagagtggtacctttataaaccttctggcacacgtgaatctgggatttctttttttcccctgtagacttcataattttgcacaaaagtttagtctatttattttacagtcttgtacttcttagtaaagggatattagaaattttgtcaataaatgaaagctctgatctagaagttaaaattaaaaactattggacctagggatgggtacataactgaagaatacataattgcccaatgattgacaggggagcaaaagcccaactgttgctggtatttggctgaataatgtaagctatactttaaaagagcagtgacttttgcaaacagcagctgcagccaagtaaagggcagcctttatagaagtacagtatctgggccactggtattttctgcaccctcatggatagcaacttagtattaccaccaacagcatacactccaaacgcaaaagaaactaatacacactacagaagcactagaaaccacaacaaagtcaactaggaaatatgccagtgaaaaccacaatttcctaaatctgacacttttttttttaaaggtaaagaaatcacttttacttacgtaaagagaaggggcaggtcacagactgatggtcaaagatctgaaaatcaaagaaaaaataaggaattaaaagcaaaccgatatatgatgcaaaaccaatatataaaagcaaaatgatacagtgggaagaaagaaagcaaatctaggcatagatgggactggttgttcctaaaggagcctattttgtcacttctagcctcaaaataaaggagacccagcttcataaaaactttctaaaggtatgaccccctgctatgatgaccaagacagtacttcccagcacaaggagtgcaaagacctttctttgttcatttcattctaatctgtatcatataggatttggtagagctatgttaccatttaacaaaatagccactagccacatttgtctatttaaatttaaattatttaacatttaataaaaagctaaacatttagttcctcagtcttgccagcttcatttcaagtgctcaatacccacatgtggctggtgactgccttactggatagcacagatagaaaatgtttctattattgtagaaacttctattgggcagcactgactagaataggtaaaagctttactatacagtacatgaccaattttagctaattttgacaaagatgagtcaaaccctgataaactttgtctcttttaaggtatatttagtatgtttaatgtccagaagttcctctgaacaaattcaatacattcgtgtgtagctaagaactcagtcctaagtttgccccggacttgccttctaaaactgcctctaccccttctcaccagcctagaatgtcccctctatggtggaaaataatctgataaagtgattttaaacaaagcttctctcccaccaaacacaactctgtttggtgatgaaaatttcagatgaaatgatgaaaattttagattttggagaagctgaccctaacagtgttcttgttctatgtttaaaatctgatatttcactctttaaattacaagccaggctaggcgcggtggctcacgcctgtaaatcccagcactttgggaggccaaggtgggtggatcacttgaggtcaggagttcgagaccagcctggccaaaatggtggaaccctgtttctactaaaactacaaaaattagccaggcatggtggcgggcgcctgtaatcccagctacttgggaggccgaggcaggagaattgcttgaacctgggaggcggaggttgcagtgagcccacatcacgccactgcactccagcctgggtgacaagagcaaaactccgtcaaaaaaaaaaaaatcacaggccaaaaaaaaaaaaaactattataggactggtctgcccatcattgtgctttgtttttttttctttcttttttttttttttttgagatgaactctccctctgtcacccaggctggagtgcagtggcacgatcttggctcactgcaacctctgcctcctgagtttaagcgattctcctgcttcagcctcctgagtagctgggactacaggcacgcaccaccacacccagctaatttttgtagttttagtagaaatggggtttgccatattggccaggctggtctcaaactcctgaactcaggtgatccacccaccttggcctcccaaagtgctggaattacaagtgtgagccaccgtgcccagacccatcagtgttttgatagcttctcttagaaggataaaactgaagtaggaggagagccatgacaaattaataaaccaaaaaaagatactgagaaaacaaagcaggtccccctacctctagcccacttaaatatatcaagaatttaatacagggtgattcaatcttgcctctctgacaccatgattttaacaacttcacataaggcctccagaaatatgcaaaacaaacttcactaaaggagatcaagtagaaggacctgattaagtatctttgcattgaaaaggctaaagcagaaaaccagcaattaaagacatcacccttcctggaaagtttctgggacaactgcactattgtagagatttcttcaaagaaatgatttccctttgtggtcaatgtgaaaccttgctcaagtacatgcaggtgtacttgatgcaggatggtgacaagacgagttaagatgaaaatctccagcctggattattataatgctaatacaagagaggctggagatctccaatgctttcaaattgtttcacaaaattcatgagtttaatgaaaattttaggcaagagaattagattatgtatgattcattgaaagcacatacaaatttgaaatatatatataacactgactagtcttcaaagattttaaagctctaagttttgctatattctagtcttctctgcaagccaggatattagactatggcacaggggcatattttcttaccattttcctccctccctctctcctttcttccttccctccctccctccctcctttcttacattcctctctctctatttctctttctttctttccctctccttttttgaacttgctgtcttctctaaccttggggagaagaagaaaatattattagcaattttctatgaaatatgttcaatgatcatttttctgttgcatgttataaacccaataactctcaacaatattatgctcttctaaaattatacctagtgtttatgttcttatatctaaacacataactttcttttctaaatttcaaggtgcatttattcataaaattagttaaaattaaatttttgatgtgatcaaaagagatcaatgtaagttgtacccaaattgactaacacatccaatgtctggaatgaaaaactatctttcctggatgtcaaatgacacacaggatggctgtcaatgataggaatccaaaatggagagaaaaattacagtgtgtatgtcacagtctaaaacaaattaaagccaagttagatggaagttttattggatataattgttgtacttatatgttaatataaaatgataatatgatcccaaacttaatagtatggctaaaaatttaatctcagagttcttacacaattcataaatgttcataggcatcaaaagacacctacttcttgactgaattataatctgctatgtaattctgagaatatgtattaatctacatagatttatatttgctcaattcaaattgttatttcattgatacatgctctttccacctaagtgatattcaccttatatgtctataagttgtttttatctgaaatgcaaagaattatctataaaagtttcacagaggattaaaaacatttgcattaagcacactttgttcaaagcataaatatatctagcaaagagtataaaactgtaaagcccaagtaattcaggacgttaaaatatcagggtggaaggtgggggatgagcagagagagggggatgacgaggggtgaagtttaatcttcgtattataatgtctgagtggaaattattatatagtgtcaatctccaagaatcaaaaatattattaattataactttaaagtcaattctagtgtagtttatgtaaagttctacagcagtggttttcaacattttgaagtgataccgatccctatgagaatctctttctccagaaaactcctcaaaaacaccaagtttcaaggaactcctagactccatgaaggccattcatgaatcccaggttaggaacccctggcctaggcagacaggggagaaaaaccctctttcaatcccatagctactcacctctacagagttttcatgaaatgctataaactaaagccagcagcaaagaaaatgtataaaaaagagttctaagtgggtaagggtatgtggttagagccacacaggcttctttgaaggcctgccagactcctaccttcctagtcctttataatttcttttttaaaaaaatctacaaagccttagcaacaatggagtagaggagtaccgagcagagagatgataatgatataagaatcactatctactgagtccttcaggtaccttgagaaataaatccttcccaaatttggatatgagtatacccaggaatgtgagcagtgtaacgggagtagaaaaagccacaaaataaatagtaaatacatggctgtcttcctggagggtcagtattccttgtgggcaagtaatttaaagtcttatttgcacacgtgttcatttatccaataactacttcttcaatgttataccaaaaagaaaacagatactgttcttgtcctcatggaacttccggttgagtgaaacaaacaagaatatattgaggagctgaaaggaaaatctgtgtatatattttttgggtgaaacctgagacttcactgaaaagtcttgtttgtggcagactacttcaagcaatgtcctggcaggcacccttagtattggatcactcactctaacttgaggatcacccaagtggaagagtttgagaagcatggttagcagtgtatcatttaatccccactacaagagaaaatactgttacttccaatttactagagaaaaaagagaaatttgagaaattaggaaacagctcagatcataccgctgctggcgtctgaataagtgtgtgccattccaaaatctacatatttttaaccactaaattacactacctttaggagtttcccactttatgtttccccttgaatctgggctcattcaggattacgcaggctagtttaagcttctctttggaagcagacaggtttggcttgatttgcattctaaatatttcacagtggtaagcgaaagctattattatacccattttatggtgaggaagctgaaccacttgccagctgaggtatctggctgggttaaaaacagaatctgggtcgtcagactctcattcctcttgactaactccaagcctaggcactattactgtccatgggcttttctgaacatgagattcacactgggtgataaagagtgagacaaattctgctaagagaaaacaataatagtgcaattgaaaaaaagggaaaataagtaatcataactcacaccaaaattggttactttcagcattgtgaatagaaaagggagagattattcatcacaaatgagtcagaaaattagaatgtgtcactgcactgatgacagagctgaggaatttggatgaactgaagtttgacacttatccttctagctgaagagggtaaatggtgtgacaacaggacagaaatgacctcttatttccaatcttaattaatatttccaatcttttttccttaactactctgtctaaaagttagatgggtttatatgtttgttttctatcggtagagataatgttttaacatccctttaacgttctagaagtattgcgttaattaattcttatgtgggagtcattccaaatagtaggatgatgatttttaccttattgattttcctaatacctttctggtttccagtgttttcaaaggatgaggcactattagatttttagatttatatgtctctcaaaattaagtgcctgtcaactgatattccatctttactctggatacatgatttcctttatctgacagattcaaaaaaatttgtactagatttaatgacatttcatgcatcttgaatttgggagtttttaattctctattttctatttggcaaaaggtttacaggagaaagccagatgcaagggtatttatatgtgcatacagaacctgtgccatcactctctaggtactttggggtttcctgcaggacagattcttgatgtattttcattccttttggtcaggaagaagaagactataaatgccacaaatggtcatacatatcttggggtctgctttccaaaacgcatattattttggatccgtctcaagaagaacaataagagaatgatactgagatctttttttcttaagatgctatgataacaatcctaaaaaatggcctgccttcaaaattttgatgatgaaataaggttataatcaataaagagagaagattttaaagttcagcaattaggtctgggactgcttctgcgcctgagacattgccaagatacaatgtaacactccatcccaccccatatgaatctccctgttccttcttgattcttacggggatagggtctgacagactagaatgaaatgaaagcagtagtgctgggaggggtggcaaggaccgaatttgtttaatacatttaggatggttttttattgctgctaaactagacacaattccttagcatgatgacattcaggaatcctttacaatctgattccaaagaactttctcttctatatcttaaactactgaaattgtagctctataaattccaaagggattgatgtaccaggacctttgacttatagtaaactgatcttaagggatgctgaaaaggtttggcactgctatcatgtggtctaatcatttagacttgtcactaccaactatttgcttaagagcctccaagacctttcacaatctggccccggcccacctctctacttttaataaaaaattttcccactgctgcttctttatatacggtgacagcctatttgctcttccctgaacatggcctgggacatctatgtctctgagtcagctaacggttcacacttgaatctcccaagcctagcatagtgtgtgaaacacagcacgacactccaatgtttgttgaataaatgctgtccgtctattttaggagacagagatgacagaagaaagttgttaaatcagtaaataaatagcaccagagagaggtcaaggaaaagttaattttagtgcattttaggagtgggggcaagatgagcttgaagattaggaaaactgatgctctttattcttgggtctagccaatgctatgagtcagttactttttcgggaacaagtttaaacctcaaggttaaatgaacacaaatgccctgtccatcagcatataatgaaaaagttgtggctatttccacatcagcacagtgaaattaaaatatgcagtgcctctctaagaggcatcacatatgacagagcttttaaaaatagtcccctttgccactcaggtatagaaagagctatagaaacaaaagcaaatgtttgaaaaactgagataatttagcttagggaagaaagagctgaggtgtgtctttatggttttttgactataagaaaagttgttacaaagaggataatgatcagcatttttgtcctagggcaaaatgacattaaaccgtccagtgcagaatttaagacttaaagatgaacattctaaatatgcaagtggtaaataatcaaatagattgctaagagcagttctgaaatttctttcttcctgactctcttaaaataggaaaaatcttcatctattttggataaaataaatgcagctctgcctccagtcaggagaatgaattcaataacttttctagtcttgtttaactctgtatgattctataaaattctataaaatgttcaccctaaaaattatacagaatcacaatacagttgagtaaaatacattctacagtttaaaaagaaataagcaatacagatagttgataagttattacattcaaaatagtaatatatggtgctcacgttttttattcaatttgccaagtgcatataacacaaataaaattgggaaaaatgtacttgaatctactaaggctttaacatagcgattatctagagtaaaacagtctaacaattaattctttcatgtctaagaaatttgctgaatatttcataaacctcatattgaatatgtatataaactcaatttccaattaaagaaaaagttttttgaaggtccagaaagtaatatatgaactcactattattatttcctggaccatcttcaaagacaacaggagaaccactaaacaattcctttaaatgaccaaaatgtgccccatatgattaagaatgtaaatctaataacagactcacagataaggtctaacaggggtggcaagttactggctttctttgtctatttaccttttagctttggagctcagcagaagtgtccattacatacagcacagggttagatgaacagctccaatgaccttgtctgaaccaaattcatttaaagcagtttgccacttttcttaaatagaagatgagtccattctatctatggcccagatttggactggatcactgaactattgcccaactcttataagcaaagcactaacatgtaccaatcaacaggcgaaggcatcaggaaggtaaaaatacacatacataagaaactggcagtagattaaagaagaaagctatatctaaagatggactttggcttttaaagcctttgagtgttattcgaatcttgttaacaaaaacaaaaacaaaatctgcattccaatgtaacttgtagagaagatccagtaaaaaaatgaattcaagagagagagagaaagaaatgtagttttattttgcaacccattatttccataagaacatgaatcaaagagtcagctatgccaatttcttcatagctgactagttataggatattgttctagtcttcactaatgacttcttgaggttggttattactgtgatcaggagttgggaggatagaggtctaagacctttcaaaagaaacgttttgtttagtatcactacagaaaataaagtcagcattaagctaactttgacaacctaactaggataatggttggtgcatgtagccattgcttatgctgcttcataatgaatggaacagtaaaggtgtcaagttaaccagcaacttgaattttgaaaagctgtggcacaataagctgataacataggttgttagaattagcaaaacttactttctgcttcccccaccttctagtcctacttatttccacatccacattcctatcaccaggcagttaaagaaacagaaacaaatgcggctgagactgcttctttggggatactcttagtgagctctccatctccccaaccacaacttgctctcagtttgctaaaaatatattcatttaattgttttaatgcctctacttaggggaatttgcattttcttaactgttgatacaagatctacattcagtttttttcacaggtaataagcaaagtatttggggagtgtgtgtgtgtgtggtggtggtggtggtggtggtggtggtggcaaattccgtcctagatgcttcgagttttccaagtatactgctaaaaggggtcatttgcttccccacctcaagaagccaattgtgcttatagttttacttcaaataaagatatatacctataaatgcacacatcatacgtgcacacacacatattcttcttctcaaaagtcataaacatttggtgactctctgtatactccatgaagtgctgttactactaaagtcagagtaatttaggcagaaacataagaaaccccaaatggtttgcactgaaattttattaacatatttgtcagtgttttcctcatggataatctccattggttcctggctccttgtcagcatatgctccaggagcctctcacaatatctttctgccctagaaatcctggcctgtgagatttccttgtaaatatctgaattcttgtattcacctattaatgatccagggatcgaggatgttttctatctgctccttaacctcccacttcaaggattagattgtaaacaacctagtgggaacccttcaggccaaaccacagctgaacgaatctcagcaggcagggaacccgcagcagtctgtgaaataccgtgaaacacaattacgaaaatataaagtattcacccatactttggggaagaaattatgttgtttccaagatgagacctcaaaaataaggctagtatcctaattgagaaagacatgattttaaaaagtgtcagcagaggtaaatttttaaaagtaccagatttgccaggtccttctcaaaccatagattcattttcagtatatgacagtggcctgagccgacacttcaagggaagtccattcatctctgaccaatgaagcccaaagtactcactgcatgaaagggttcctttcttgtttccaaaggcaatcaatttttgtcctagagtctgaaggttcatgggctttcttttaattttgtcagtctgcacatgcatggttcctcctgcatgatttggtctggaggaagtgacccacccacaacgccacagagctaattaaccccacactgagcttttttttttttctcatttcacacatccactcaatgctttaaatgacccagcagcagcatgatcatatgatttcttccccctcagtgaggaaagcatggtgatgggaggagcagggatatatctgccctaatcaaaacagcagtgtgatcctaaaatattatctaattgcattgcatccgagggtgcaaaatactaagaaatccctgaacgaatctctttcatgtcattcatttaacttcttgcagtgtccatttgaagtagcaaataatacataagaaacactgaggtagagaagtttgatctatactcagaatgtttaaaaaacatccgatcttacagggggtaaaagaccgagagctccttccctatcccgaatagcttcaagagaagggccttttttccatttgaaggaacagactcatgtttttccagatttattttttccaaagggaatgccttgaaaactctaagatgatcactgttttctaacttttcaaaaaagaaaaaaaaaagtgaacatgatggtggtgggtgatttaatggaatcagcttgtcaacatgatgaaactgaaaaaagcttttatagactctgtccacatgctaaaaaaaaaaaaaaaaggcaacctttaaagttatgtgtatagtatagagtggtttttgtcatggcaaagaaaagaaatataattatcttatgcagtaaatgtaaggctctgctaagaatctcattggataaatcatagaaatacatcctggccagataaatggagccagacaagttctaggtcttgtaagaagctttcaaaagaatcatcatattgtaagtctgtcatctctgtaagtgacaagaaaaattctaggctatttccctcggttctactagtaacatggcttcagagttttaaagatttagacttaaatggacaagaaaatgacttctgaatatcccatcttaggcaaactatcggatttctctcattcttacaagtaagtgtagcaaattggttcaccttggaaggacttggttagagatcatatatgtcttatgtgaacttttaacctctctttcctttgcaaagtgatttatgcatacactattaaatacacaggaattctataattcttagttcagtgaacagttagtacaagggaaaatctatctaatattttaaatttttgtttagtgtcttaaatcctacactttagaactggagaccttatagataagttctataaggtcttcagtgtgctgaaaaacacatttgctactgctccctaagcttctcttaggtaaggctgccaactggggtaaattgatggataaaactagctcaataggcaaaaaacaaaggtccagtgaagcacagtttatttttatttatactggtcagaaatatcacagttaacaaatagcctaaatcaagctcttatatctagggctccagcctttggctgaagtgtctcatctggtaattctgaaaaaaatagggttgttgtgatttcaaagactctcctgcccagtagactttttcaggctcactgatgcttaggattctaaagcctttactatggtctgttagaccaatacagtatgtcccttactatttctctgacttcatctcctaacattttcatgcaaaattggtccaacagacaataaaatagacagggataggaatatgaatggggactaaaaggaactaattaataaaaattagttgctttatgtccttgttaaatatcaactctttcatgacagcctaataaagtttctgaacttatcttgagagttggttaagataggggagaatatacaaagtatttccaacaccatgcattcattcattaattcaacaaatagttttcccgagtctattattgattactctgccaactggattctacttctgccctcaaggaccttccactctaatgtatgttttggagagtttctgtctctattatcactgacaggttattagcccactttagacaagttataaatataaccacctgccatgatgattcctcttcttgttctttatttgtttttattcatttgccctgtaacatccattaacctttcatgaatgacctgatcctttgtgagctatactatcaacacagctaatttttatataaatgagaaaccccttctccactcccaactaacttttctttctcaaacagccatgaaaatataaaagtctacccagaattatttaagtttttgaaatgagtccttacaatctgatctgaagcaccatttttttcctttcttttttgaaagagggaatggagcctcagcccctaagatacatatctcaagttacaggcaaattacacacaagttactggtctcccagacgtagtactcactactctctggggtagaacaatttctgcattgaacagaggaccataatctagctcaagtaatctcaatctcagagaacagttaaccaagtgcatatttctggtccctatattctcttataaggagttaccctctccactatattttggtattttctgaacctggctaccttaggtaaatgacagtggacatggtaaaaagaacactaactcttcctcaatttgttaaacttgtttttcctcctcatatgctttataaacaaaaatgggagaatttaatgtatgtatagagcagcaaatgttctctctgttgctttcagacatttttatcttatataaacagtggtgatgaaattataaataccattattccacctctatgttaatactcttattatcttgcatcaacagacgtgaacaaatacgtacatgacaccaatcaatcccttttctaaaaatgcagtttttgtatttctaaacagtggaggaagaattttatgaattcaacatgtagtttacctatttatattttgaattttaataaagtaaaaccaaattatcgcttatgttctttcacacttacatcagccattaacactctccatgctggcatggggtagggggtgtgtagaactaatggcaatgggtccaagtcccctgggtcaggtggttaggggcttggcaggctggagaggatgtttagatgctggggcaggatatttcaacctgcttgacaggtaagagatattttctggcagtaagaggaatattttttatggaacaaattgctagggagaggtcattttggggcactaggtgagagaaatatcaaaaccaaacctaaaagcagtctaagggaactcgggaaaagaaaatcactactttttcaatctcctcactggtttcccttattccatagtgtgccttctccttccatcttctagcacttcatactcttttctcctccatttcttcaggttttctttctcctacctctttattataacaaaaaaaagcatttaggaagaattctaggagacagggagacaaaaaaaaaaaagaatttagagaagacataataacatactgcataaatatgtatgtatgtatgtatgtgtttatgtatgtgtatatgtatgtatatataacagatattcgatttaccaagaaggataaactgggacttttgagatttaaaaaattcatggtatgtctggtcatattaatctccaaaccagcttgtttttagcattgctagagctataacagaatcaggagtagaaaacaaaaggaaaaaaataaaatttaacaaaggatttatatttgcaaaggaaagaggacttatttagagttgtttattgaaattcccccaaagctattttttgaacttatatattgacaacatcaagagaaggagcttaggaattctcatagggtttaggaactactaaaccttgtatattatgttcatctcagtccactcaagcaagtaaaggataactagaggatggtatctcacagtgcataacatggttggttactttgctaggctgacatatggagacagggcccataggagcagagcttttcttacgaataccagagagagacacccaggttcatctaaatgtatagggcatgagggattagtggtacagtgttatctgcaaagtacctaaaagtgttttctaaacaagcactaacttcttagcccagtcttcttggggattaaacaaaatccaatagtaagtaatggggaatactttatttggtcactgggttggggagggttgctgagacatatgacaacattcaatccattaagataggaggaaatgaggagaaagagaaaacaaagaaagggagagcgagggccagaaaagaagagtgtcacctctgtagactctctaacagaataaatcgataatcttaagaaaagtaaaagagcatgcctagagggaaacctcagcacacttttggaatccaaggcaaaaaataaaacaatttgcttcttgtcaagtttattgccattgacccatgggaggttcctatttattctgctcttacatgcacaggtatttcttctactcttacattcttttcctaaggattagcattctgtgataatggtggtaatgacagctgccttaaattagtggcaagttaggaatgaaacactgaccaccaggctatgttcttgaatccagtctatgccctgtaatgtgttcattctactttctgcattttctctgagacctgtcgcataagacttgttttgtaaggccgggctccttacggggacacatatggctccagaaaacaagtactctactttctcaccctgactttttggttttcttgttttttcctcttttctcccagactattattttccagtttcttctctaccagtctggacgcccatggttgttaactttagagatacccaccagctccatcaattccctcatctacagttctcaactgtatttacctagttctggagctcagatgaacccacatgtatgttctcctcagcttccaggctgctgatccttgctggagaaaaagcacaaaactgtacagcttgatgctcctgcagaattacggtttccagcataagttcgaatttcagaattagtttgcaattttaaaatttgctcctagtcagtttcctttttcactccacagtttcattcattactctatttaactggttataacccatcccctacccttcactctcagctagtaaccttgcctccttttgcatagagaaaacagaggccatcaaatggcacttcctatcactccacctttgccaccaatgaatccgcctgtaacatttcagagatctttctgcctagcactgataacctcatccaggatcttattatatcagttacttttcctttcttttgtattttcaattttcctactgcctgccaacatgctttagctgtcttcatttaaggtaacaacaataacaatgataataaactaacaaacaacaaaccatcttttgcagactttatctttccctcttttgtgccaccttcaagcttcctaagctcccgtttattcctcaaaccattacaatctggtttctctagctgtgtttctaattaaacaatttttttttttttttttgccaaagtcaccaaacacttctgaattgttagcttccaaaatccattcttcaacctcattgttttctttcttttaaaggtcaggttcactgaggtataatttacatacaataaaattcatccttgctatactcatttaccattcaataagttttgccttatatgttggaggcctgtaaaatgaagcccaacccccaagccgctttgcttcatatacaaatccctttggcacctctcagcagtcttccccacataacccattgtctggtgacaccacactactcagcattcaaggatatatgccatgtacattcatgccccttgtactttctttatgtttcctctctataaacatatatgtcttggtataacacagtaaatgctatttaatattaccacatcaatttccatatagaatcataaatctatacgttattttgagaagctgaggttttccaaatagaagtcatccatcaaaatgctactacctgaagatctctattattttagtattatgggttgattatgttcccttaaaattcatatgttgacattctggcccccaattctttagaatatgaatagatgtgtgaatagggtcattgaagatgtgattaagatgaggtcatgctgtagagtgggcctgcaatccaatatgactagtgtacttataaaaaagagaaacttaaacacagacatgcacacagggagaacatcatgtgacgatgacggcagagattggggctgatgcttctataagccaaggaacaccaaagattgccaggaaaccaccagaagctgggtgggagtcacggaactcacagccttagaaggagccgaccctgttgatactttaatcttgaacatctagcttctataactgtgagacaaaaaatttctgttgtttaagccactcagtttgtggtagttcgttacaaagccccagaaaactgatatactcagtaaaagaaaaaatcttcagtatattggaatcagttctttcactcatcaggtacttactgagtgcctactatgtgctaggaactgctctaggatattgaatgaatgactaagaacttcatcacgttactgcattttttgttcactaataagtaatcaatctatcaatcaatatattaatagatgaaatgcctatcatttattttatcagcaaacatttgttgagtatctcctatgtgtcagacatcgttctaggcacagaggataacattattggcagatcaagttctccaccttgtatagtttaaattccagtagagggaacatatattaaacaagaaaataagtaaataagatatgtaattttactctgtttctgacactgagagtcataggcatttatcctctaaatcactgaacaaagcttggaactagatagcgaacatgttacttcacagtttacaaagtaataaggaagacaatgaggtctcatactagaggcacgttaaaccacaggcagtgtgcaggcttaaagtgtttgggaaggacatcccaaaagctaggtttcttagtcagttcgtcagtcaatcaacacatatttcttttttttttttttgaccaaatttctctctgttgcccaggctgaagtgctgtgacacgatctcggctcactgcaccctctgcctcccgggttcaagcaattctctgcctcagcctccctagtagctgggattacaggcacctgctaccatgcccggctaatttttgtatttttagtagagatgggatttcaccatcttggccaggttggtcttgaattcctgacctcatgatccacccgcctcggcctcccaaagtgctaggattacaggtgtgagccactgcacccagccatttgacatgtattttttaagcgcttactgtataccaggccctatgctgaagatagtagaactgtggacagagccaacatggtactattacccactgagctcacattctaaggggaaaaatttgaacaacaaatctcacagtccgttctttatcatatatcctcataagaatacataaagggggttaggagatcacctgggtcagaggactggcccatgaggggtttccaaggggccttccttgaagatgtggtgcccggacactgctttagggctggggtatgggtattggtttgagcagggtcatgaagttttcggtttcttcttcctcatcccctttcaaccatgtacacacatttcaaatacttaaaagcattcttcaaatatactaagaacaccaagaactaaacacaagagaaggactctccagaggaaaggggccaaaaatagaagagaaaaaaaacccctaatctcaccatttgttttgaaaacacccaaaatgattaaaacatattataaactaaaacatatgaactaatcacttgccaagtttcatttttaaatcaaagccgttttgaggttcataaactgaaaaaagaatcttcaaatatgaacttgtgtttttcttttcttggccctcagttggcttgaagcatttgctgttatgctgtgtggagggaaggggaacctgctagttaggaacatgtggcatgcatgtactagaaggtaagctccacaagatcatgactcttcacagtggtatccctggtaagtagaagagtgcctgaaagataacaggggctcaataaatacctgctgaatgatcaactagtgaatattctgggccctttaagggattctccaactctcttttcttacccaagctgcatcttgctttaggccagtggttctcaacctggggctaatttttgcccccagtcaggggatatctgtattttttgttgtcacagttagagaagttcctactggcatttagagggtagatgccagggacgctgctaaacatcttacagtgcacaggacagccctgttccacagagatttatctggccccaaaggttaatagggccaaagttatgaaactctgatttatgccctttgtttctattgggctgtacctgggagtcagatcctctgcatatttggaatgaagttcagtcctaaaggaagcaccccagaaaagcctcattgcttcatcctcattcccttcaagacctaatagaactgcccccactctaaggcaggctcagagagagccaattttgccttttgtcctccctgggtcaacaatgcaattgctagggaaatcatctgaaaaagtctgtctctacaatgcaagtaaataatttttacagtacattggtaatttccctgagcttacctaagcatatatactaatttagtaaaattctcttgtttacaaactagtcatgtatctgcaggaaaaaaaaatctcctcaagttcaaccagtttatccatgtctgctcaggatcagtacatgactctagctttattcatgataaataagatcaacttcaagaattccatcaaaccccagtaatgtgcctttagagagactgggcttatagcatttcctctgccaccctccttgccctgcatattaaaatacaggtatctgattccagtttcaatggggaaacttctgtcgtgccagaggagggcatgcgctgatttccccactctgatggttgctctagtaatcttggtgttgtggcatgtttcccagttaccatagagactgcatacactaagactgcagcattgtgattggtgggaaagatacattttgcagaagcttttctggagagataaaggtaagacacgagaaagaaagtgagactgccaataaaggggcagagcacagagaagtcccaaacaaccatacattctagaaaactgggacagcagagattacaactactgctataaaactacataaactgttcactcaatggctgcctgtcaggaaaatttcaagtattgtcagacagaacagacacaagatattctagaataaaaaggtaaacaagtaaacctactgaggttataggggtgacaaaagggaaatggcaagaaaacatttaaaaatgattcaatgctagaaaaaaaaaagaatctcagagagcaataaaatttaaagttacatttaactttaaatgtaggctgacctttggggaattatttaaattctgagtacctctgcttccttccctatgaaaaagaaaaagaaaaaaagaataaagatggaaatagaaagaataaagatgacttctctctcactgtttaacaggagtctctttaaatatctcaataatttgacattatatcagttgaatatgatgtaccccccacacaaaaatcagacaaaaacacttaaagggggtgataaatagggggacgtcattaacaatgcaaattgactcattccatagtttcttagagtaatgagtcaactgactacgtgatctcatgtacataattttgttcggcatgagattttgaggtatacaattactacagaaatcaaggtatacctgcaatgtaaagggtaaatcgtaggcattttaaatgaaagctggggataggatgtgtgttggtttgagggatgagtgggagtggatttaagagaaaatcagtctaggaaaatatcacataagtgtttgtaagttccttgatattcaggtctgtatcttgtaatgctttattaaacatatttcagactaatatgtccattgcctactggacattcatatctccctgtttttaaatacctttcaaatctgtatcttgagccattacttatctcttgacctctaaccctttatatcaaatgaattactagacaattacaattagatattccaaaagcatcctaaattcaacatgtcaaagctgaactcatcttttccttcaaactttctcttcctcctatgttccctatgtgagtaaatattaatagtattaccattcacccatctgccaaagttccatacctaggaagaatcatggttgcttttatctcaccttcaaataatcacccgtgcatatagatgtgcaatcctaataaccaaaggaggccttttttgaatagaaagcaatatttacagttaattgggttttgaactaatattaatttattaaacttacaaattttaaaagcctagttttctttacacctttacctgttaaaaacacacatatatttttctatgtcttaatatagcaatttttgcataaaataagaaaaattactttcaggaagggtgagattactagacaaaaaaatttgggacctcaaactatttcaactgtcagtcagaatgttaaaagaatgagagttagggtctgatctgggaacacctttcaaatgattttgccaaggtcaccagtagacacactgaatgtttttatagtcactctgaaaatgagaaattttacgtctataccctacaaaggaaaatttacaatccaggtcctctatgtttaagtttcattcttatctaactcttttataatcactttccactttatagcctgataaaggtagacaatattttgtgtctccactaaccaggtttcttgaatctagtgccctttcacttcataacgtttttcacatttctacctctctcatccccattgcaccacattagctcagagcatcattatctgtcacttgtaatattgcgacagtacattgtactatattttcttaagtttctgagtctttgcacatgtcaccacctgtgtctagaacacccatattccctgataaacatttactgaatgaaaaaaaagttaataaatgctttggatgttgctgctttgggtgctgaacagaaatagtggcctatctaagattctggataagcctgcataaagcactcttactttcaaaattaattttgaagaataagaaaattttgccatggagaatcatggagcctatgccacaatattatgttttgcatttaataaaacacctccaaacccagggaaagaatcagttattacttccttcaattcatacaacgaatatttactgaacactctctatgtgccaggctctgtactaggcactgaggatttcttagagcatagaacaggcaaaaaacaaacaaacaaaaccgaaaaaaacctcacaatcatggggcttatattccatggcaagaggaaataaatgtgtaaataaaatatatattttgtctgaaggcagtaggtgctatgaaccaaaaggggtggaaagctaaatgttaaatacagtggttatgaaaggccttacttagaagtgaaaattgagcaaagacctgaagatgataagcaaacaagccttatctggggaaaacatttaaggcggtcagaaaagcaagtgcaaatgtgaaatcatgcatggtaggctggaggttaggaagggggtcaatgaaggttgaggggagtgagctagggtggagcgctaaatgaagacagagaggtaatggggaaattgaatatggagggtcttgtgaactactgcaaaggcttttcttccaagtgagatgttgagccattagagagttctgagcagagaagtgatgtggtctgactgaaattacattacatatattgcaaagcatcactctggctatcattttgagaatagactgtaagtggtaaggccagaagcagggaagacaattaggaggctactgcaataatccgggtaagaaatgatagttgcttggattagggtagtagtggtgatgaggatgaggagtggtaagattctggacttattctgaaggtagagctgcaggatttgttcaatggttgggtttgtgagagaaatacaggtctgggagagaaataaatttttgatttgagtaaccctaaaggtggagcgttatttaccaatattggggaggctatgtatttgcttggtaaaataaggaattccatttctggtatgtcaagtttgagatgctcattagacagacgtggagatgttgaataggcagctgaatatgtgagcctagaattctgtgtaaaggcctggactagagatacaagcttgcaccataagcttgggtgcaaatattaagagagtgaatggagctgaagagaagagcttcaaagattgagctctagggccctctaatgtttacctgcttgggaaatgagaatatgctagcaaaagagactgaggaggagtagactgtgaggcaggaaaaaaatcaggagagtgtggtggactgaacgccaagcgaagaaagtgttttaatggagaatgaataatgggccatgtaaaacaattctgagacatcaggaaagacaaagactgccgaatggttaatggatttagcaacatggaagtcattggtgaccttagcatcaacagttttactagactggtaggtgcaaaagctaactagaggggcaaaagagaaccagagcataggattggagagtgtttatagtgactatacgcatttcttgagaagttttgctgtaatggaaatcaaagaaatgggacaggagctgctagggagtatggtttataagggtatttttaggatgagataaattatgtgtttgtatactgataggaaagttttgatagaaagagaaaatttgataaaacagaagaaagatgtgagctttttcaggagcactgtttatgcatgtgcaagaggagagagattctaaggcacaatgagggatgggctgagccaagggtacacagagtttatccatagttgcaggagagaaggcaaaatacatgggtacagataaatatgggagggtaggtgtgctggacagcaagtatttgtgaagttgtcttttgatggtttctattttttcagtgaagtaaaaagaaaggttctaagttgagcgtaaggatgggggaggaggtgttagaaatttgagagagggaaaaatatgaaatattcttgtacagatatggaagagtaaatgacaaggaaacatattatatttgctgggcagcattaacggcctccttgagggatcatgaatttaaactgagagtcatacatttgcttgtgtgtttttctccagccacattcagctggcacacaggcatgaaatagatggcgagttgcatatgatcagtatagttgagatttgtcaagagagcacagttaagtcagagaaggtcaatggtgttaaaggcgcatacaaggaaatgattaaaatcattgtccatggaatctacgctatataatgaagtgagcatatgagaagctatgggtaaaatcaatgaattaggggtcctagtgggtttaaggaattggtgtattaggggtaacaaagggattgaactaccaagacattaggctgtggttggaaaatggaatgcttgaaattgagattgtggaatattgtaattattagtaattaaaacatcagaaatgtagccatgggaatgagtagctatggcagagtggagaatcaatcatgagaagttcaagaaattgagaggaggtattagagggagcgtgtatttacacagtgaataaccaataattgtaatggggtagaaatggaaagagtgttagtgagctaggggctaacgttttcaaggaattgggaaacttgcctggtagacaactgcatcaagggggagttatgggaacacttagcttttctactacctcctcaatgtttcctctctctcactttccatctttccagcttatatactggcattacaaactttaatttcctagactagatagctacatatcacctgtgtctaccctttctcctccctatccaaattatctccaagtcttgagaatttccaatttttttttctgagatggagtctcactctgttgcccaggctggagtgcacagtcatgccatctcagctcactacaacttccgcctctcaggttcaagcgattcccctgccgcggtctcttgagtagctgagattacaggcacgcaccaccacacccggctaatttttgtattttagtagagacgaggtttcactatgttggccaggctggtctcgaactcctgacctcaaacaatccacctgccttggcctcccaaaatgttgggattacaggcatgagccactgtgcctggcctccaattttgaatactctctactctccccctttgggaccatcactactctagcctgtcactctctattttatcactcagattaatgttcttcatggcactaatcgctctctaaacttaacttgttcatttatttgtttgctttttttgttggggggggtgtctattttccttcattaaatataaatttcataaggggaaaagttttgtttaatttgtgcctggaacataatatgccctcaataaatactttcaggatgaattaataaatgccccctataacatgctgatgaatccttatattcttgggttcacacaacagctttgctttactatcctaccagcttctccctcctttcctgctcaaaccatccatttcaccgagtaaagtcatttcactactcccccaaaacaccatgttcatttctattcagatgatttcatcatatttctcccttgtttatgtctattccccacataccaattctttgagtcccagcttaggtcttacttctcggatggtttttctatgattaccatgaggcctgctgatttctccctcctctaaaatcctgctatccctaacaacaccagctgctttatattttctaattgtttcatatgggttattcttaccttttcactttaaaataggtttatttttggcctaaggatcctgacttacaactacagtatactcagtaaaaactaacacagtgtagggcagataacgggtattcaaaaaatactatggcctccttagatagcttcatagacttccatcttcctcaacaaacattttctaccttttaccctgctgttagctaaatctaactattcttcctgctctatgatactgtctttgagaccagaaccaacccctatgtccactacacagaattctacactcttgcactgcaattcccacagctaaatcattgtcattgccattattgttcctggattctcttggcaattttagtatattcaaggcatagctgccaagatcatcatcctccttgattgtttggaatctttatttttttaaatccctgcattttttccatcaaactttaagtgttcctgtgggatttgtttttccttggctccatccttggcctggttcttctccactttcttatgttcagtcactcgatttgccctttgtctcatttgaaggaatcagctttcacaccttcttttaaactaccttgcatatttagaatattttctcaaataatataaaatttataatatttatgaataaatgacacaatgccaagatattctgtctcttctttcaaataacatctgaagatgcacctgcactagtgagttctatatttaagatattgaataagtatcattcacccatctgctttcattctgtcctgcattttttaggacctgcttcagagttgtattttgaggtcttttggacggggaactgtctggcatagttcacaaactggcctttgctctgtatattcatgttcctttgataaataataaataataataatagcccactgtgcatttttacattccactcataaatccctggaaaaagaaaaactaacaaccagggattataatagaaacacagaaacaaaactaaccttttaccaggttttgctacagtaatatatacttccatagacctatattctaacaaataattacctgcttaagtcatttgtaaattgttcctttgccaacattatgtataatagcaaatgtctacgtggtttataggacagggaaaacaactagaacattacagctatgtgggggatcagtgcaaaagcagcaaaataagaggtttactctgttgggtgcacagtttggaagaattagtctcacaagtagaactacttgacagaatatatgcctgctctccagctcccccttctcccctcctccagatcttttttcaataatggaagaagacttactttcttttttcaaatccaggtgggaagtgtatcattttgcgtgaaaaatctgtttttctttgaacataacaaatggtctgattgaagctgctctatgaaaacggcagcatatctaaccagggaggtgggaactatagtttaatgggtggagcacctccatatttagctgcagatgagccacatttaactttaaaaaaaataaaaatttaaaaaataaaagaaggccaaaatgtaatgattgtcttgttactgcagtggccactagatggcaggtccaaaaatctgatgggagtctcacaggagggcaaatcttagggagcagaatgtttctggcactcaatccagtgttggttcatcaataagccttggcagtttgctaaaatatcaggtgggtaagacaatatccatgttatttcacagggctgaagggggcaggaagccctttggtatctaggtttgtagagtattgtcatcacatactcacacatccagatactgctacccctttggacttctgtccacagacattcttggagctggtttttatatatgttcagctgtattccattatctaatggtctgtgcaatactgagccataatctcaggagtgtaaaaggtagttgtctaatctgcctccatggaaacaaatgaaggaggctgtcaggctagggtaagggaacatacagctgtactgtatttaacaacatatatttaccagtaattgcaacttcatgttaaatatgtgtatttcctatactggaggctgaccatatattcatgttaattgttttgaaaaagagaatgttgatatataagagacttattatttaataggataaaataactaaggcctatgattaaaaatgaaatgagtaaatttagaacaaattatttgttgtacacagtagagttttcattttcttttactaggatgggagacttctagatgtgggtcttatgagactataaaaaagtcattcttggaccaattattctgaagatagattgtgtctttcccttcataatttttttttttttttggttactagattatcctgataaaagtgatttcactacatggacaatgcctacttttctttatcttttaattaaagaactgaccttatgatttttaaaagtagagaatcacaagctctgagataatttatcattctcactaaagaaaatgtgctctagagtcaaatttatctttgtacaagagctgtgacatgcattttgatatacatttaagcatctatgtcaattaaaatattataaaaataaaagcaacaaaaactcaattatagccatgcaactcagtcatcactcaccttttgttccctttttctttgaaaatttagatagaataatggtaaacatgttgatttcatctattcttgctctgtatatttggactgtgaaatgtctacatgagacacaggaagagggcacgggtcttcaggataaaaaacaaaaaaaaatttttcctaaagaagaaatatgggctatattgaattatgatagatgttttaaatcagtaccgttttcctttagtttggagtaaaatttaaaatgagatgactgaaataatttacgataaaatatcatggttatttctacatatttaaggtttaaaaatgctcaaacttatactttcctcatagaaagagcactggaatgggaaactgagaggtctgggttctattctggctttgacagtgactcactgtgtgacatccagagagcatgacctccccaggctcctcacttctgaaatgggagggttttgaggacaaagtctctctctgctttaacattcaatatccaagtaagtaaattgctacgtattgcagatttttttttcctcagaaatagactaatttcctccgatgaaagaataatactgttaagaagctgatgttgaaagctaacatgtccctaccaacactgtgggctctacccatgcaggtgaagctagagcttgttcttccttcaatcccccctttccctattctgcaccactcttccacacactcccccatcatctttaagtctaaattctacctgagaggtcctctgtgacccctaggtagttacttgctaattattactaattattcaataactgttttacttttcctcttgagcacatagctaagttccatttcccagccttctctgcagatagctatggccctgtgaccaaattctggtgagtgggatgttggtggaagtgacatacgctgtcccaggcctggtccattaaaagttcctgtgtaatcattgctctctcttcaccagatttctggctggatgtcacacccacagcaatcttggaagctatgtactgaagagcctctgtcaacctgggtccctgaccagtctttacatgagcaagagagaaactcatgttgaaatactgagatttgggagtgtgcgtattatagaagctaatgttaccttaactaagaacactcctaaagcagaaatttgttctctctccgagacattatgtctcttttaccacattttccacctttaataatttatttactgatatgtaagctccttgaggatagtacatttgtttcactagtgtacccacagaactctagttagttgaatgaattcagaatagaacatagctggtttggaaagtacagaagttacagaaggtagtaaaagcagtttgatttttaaaaattctagctttgtgttttatcctataatatttaggtagaaggtagggatgatgggttggggttttgttggtgtggaaatgtattgtgacaaccacagccttttaatatattttgtgtactgcatccccaataaacatgttttccaaataaagtgtaaagtctttttctaaatgctgtatggcttgccttttttatatatttgtgtaaagaaattcgtagtagtaattctctgacactgagttaaaggaagtcctattttttttcacaattatgtgaaaacacaattatgtgctgtataatgacattttagtctacaatggaccacatatctgactgtggtcctgcaagattataagataactgaaaaattcctaatgcctagtgatgtcatagtgatcataacatcacagcacaattactttttaaaacataaatttagtgtagcctaaatgtacagtgcttataaagtctacaggagtatacagtaatgtcctaggtgttcacattcactcatcactcactcattcactcacccagagtaacttctagttctgcaagatccattcattgtaagtgccctataaaggcatacacttttgatcttttatgctgtgtttgtactgtaccttttcaatgtttagatatgtttagatacatgaaaacttaccattctgttataattacttacagtatccagtacagtaacatgctgtgcaggtttgaagcctaaaagcaataggctatatcatatagcctaggtgtgtagtaagctctatcatctaggtttgtgtaagtacactctatattgttcacacaacgatgaaattgcctaatgatgcatttctcagaatgtattccctttgttgagcaatgtgtgactacattttgaaaagttaaaataatactaaagggagggacaagtgaagagctaacttgagaaatctaagaactaggtaatttaaaagaagtgcttttagttacatagggtttttaacatcattaccacctatgaaattacaggtattaactactgtctcaaaatgatcatcgcccttttgatactttactctcagtgtcatggctgacctcttttgagtcaagtttattggacattttcagttttattttttaattctcatcactgcccctccctgaaatacttcatccctggtttccttaataatactggcctaatttccctattctctatctctagttttctctcctcttttgtttggctcctctttctcatctattctttaagtattagaatttcctagtgttctgctctgagtttttctttctctcataatttttccttgagtcatcttatctagtcttatggctttacctactacttcctcacaaataactcccgactcttgatctttagcccagacctttcttcggagcttcaaaacctgtattgcctatagtatcctgggcattttaagaaaatctaaatattttgtgccaccttaaattcaagtcccaaaccaaaagcactccttgccctttcaagtcaaaccttcttcctcctgtgttccagctcttggtagatgacatcaatttagaaacattaaactctccttttctttctttcttgtcccttatctaaattatctaattaagttctaaatcctgtagtgcttttatagtccatttgagattttagcctaagtttgaggactagataagtgaagacagattaaaaataagacttcttttaactcagtgtcagagaattactactatgaatttctttacacaaatatacaaaaaaggcaagacatacagcatttagaaaaagactttcatacccttccatcataccagagttccattatcagcctgaagagaaccaggagagctgtcctgagagggagctttctcacaatcaggactggattgaaacaaaatagaatcaatggaaagaaagatttttggggaggggagagaagttttgcttgctgctggtcctttggtaacctctgcaaaagaaaagtttaaaaaatgaccctggctggcaagatggccgaataggaacagctcccgtctgcagctcccagcaagatcaatccagaaggcaggtgatttctgcatttccaacagaggtacctggctcatctcattgggactggttagacagtgggtgcagcccacagagggcaagccaaagcagggtggggcatcgcttcacccaggaagcacacagggttggggaattccctccgttagccgagaaagccgcgagggactgtgccatgaggttcggtgtattccagcccagatactatgcttttctcaccgtcttcacaacctgcagaccaggagattcccttgggtgcctacaccacgagggccctgggtttcaagacaaaactgggcggccgtttgggcagacactgagctagctgcaggaattatttttcataccccagtggcacctgcaatgccagtgagacagaaccactcactaccctggaatgggggctgaagccagggagccaagtggtctagctcagtggatcccacccccatggagccaagcaagctaagatccactggcttgaaatccttgctgccagcacggcagtctgaagttgacctgggaccctcaagcttggtggggggaggggtgtccaccattactgaggcttaagtaggtggttttcccctcacagtgaaaacaaagccaccaggaagttcaaactgggtggagcccaccacagttcggcaaagccactgtagaaagactgcctctctagatttctcctctctgagcagggcatctctgaaagaaagttagcagccccagtcaggtgcttatagataaaactcccatctccctgggacagagcacctgggggaaggggcagctgtgggcgcagtttcagcagacttaaacgttcccacctgccagctctgaagagagcagcagatctcccatcacagagctcgagctctcctaagggacagattgcctcctcaagtgggtccctgacccccatgcctcctcactgggagacacctcccagcaggggtcaatagacagctcatacaggagagctctgggtggcatctggtgggtgcccctctgggatgaagcttccagaggaaggaaccggtagcattgtttgctgttctgtagcctctgctggtggtacccaggcaaacagggtctggagtggatgtccagcaaactccagcagacctgcagcagagatgccagactgttagaaggaaaactaacaaacagaaaggaatagcatcaacattaacaaaaaagatgtccacacaaaaaccccatccgaagatcaccagcgtcaaagaccaaaggtagataaatccacaaagatgaggaaaaaccagcttaaaaaggctgaaattccaaaaacccgaatgtcgtttctcctccaaaaaatcacaactcctcaccagcaagggaacaaaactggatggagaatgagtttgaggaattgacagaagtaggcttcagaaggtgggtaataacgaactcctctgagctaaaggagcatgttctaacccaatgcaagggagctaagaagcttgaaaaaaggttagaagaattgctaactagaataaccagtttagagaagaacataaattacctgctggaactgaaaaacatagcacgagaagttcatgaagcatacgcaagtaccaatagctgaatcaatcaagcagaagaaaggatatcagagatgaagatcaacttaatgaaataaagcatgaagacaaggttagagaaaaaagaatgaaaaggaatgaacaaacctccaagaaatatgggactatgtgaaaagaccaaacctacgtttcattggtgtacctgaaagtgatagggagaatggaaccaagttggaaaattcttcaggatattatccaggagagcttccccagcctagcaagacaggccaacattcaaattcaggaaatacagagaacaccacaaagatgttcctcaagaagagcaaccccaagacacataatcgtcagattcaccaagattgaaatgaaggaaaaaatgttaagggcagccagagagaaaggtcaggttacccacaaagggaagtccatcagactaacaacagatctctctgcagaaaccctacaggccagaagagagtgggggccaatattcaacattcttaaagaaaagaattttcaacccagaatttcatatccagccaaactaagcttcaaaagcaaaggagaattaaaatccttgatggacaagaaaatgctgagagattttgtcaccactaggcctgccttacaacagctcctgaagaaagcactaaatatggaaaggaaaaaccggtaccagccactgcaaaaacacaccaaactgtaaagaccatcgacactatgaagaaactgcatcaactaatgggcaacattaccagctagcatcataatgacaggatcagattcacacataacagtgttaatcttaaatgtaaatgggctaaatgccccaattaaaagacacagactggaaaattggatagagtcaagacccatcagtgtgctgcatttaggagacccatctcacgtacaaagacacacataggctcaaaataaaggaatggaggaatatttaccaagcaaatggaaagcaaaaaaaaatgcaggggttgcaatcctagtctctgataaaacagattttaaaccaataaagatcaaaaaagacaatgaagggcattacgtaatggtaaagggatcaatgcaacaagaagagctaactgtcctaaatatacatgcacctaatacaggagcacccagattcataaagcgagttcttagagacctacaaagagactttgactcccacacaataatagtgggagactctaacagcccactgtcaatattagacagatcaatgagacagaaaattaacaaggatattcaggacttgaactcagccctgggaacaagtggaccaaatagacatctacagaactctccaccccaaattaacagaatatactttcttctcagcaccatatcacacttactctaaaactgaccgcataattggaagcaaatcactcctcagcaaatgtaaaagaatggaaatcataacaaacagtctctcagaccacagtgcaatcaaattagaactcaagattaagaaactcactcaaaaccacacaaccacatggaaactgaacaacctgctcctgaatgactactgggtaaacaacaaaattaaggcagaaataaataagttctttgaaaccaatgagaacaaagacataatgtaccagaatctctgggacacagctaaactaatatttagagggaaatttatagcactaaatgcccacaggagaaaacaggaaagatctaaaattgacactctaacatcacaattaaaagagctagagaagcaagagcacacaaattcaaaagctagcagaagagaagaaataactaagatcagagcagaactgaaggagatagagacatgaaaaacccttcaaaaaattgatgaatctaggagctgattttttgaaaagattaacaaagcagatagaccgctagccagactaatcaagaagaaaagagagaagaatcaaatagacacaataaaaaatgataaaggggatatcaccactgatcccacagaaatacaaactaccatcagagaatactataaacacctctatgcaaataaactagaaaatctagaagaaatggataaattcctggtcacataaaccctcccaagactaaaccaggaagaagtcaaatccctgaatagaccaataacaagttctgaaattgaggcagtagttaatagcctaccaaccaaaaaaagcccaggaccagacgaattcacagctgaattctatcagagatacaaagaggagctggtaccattccttctgaaactattccagatcatagaaaaagagggactcctccctaactctttttatgaggccagaatcatcctgataccaaaacctggcagagtcacaacaaaaaaaggagaatttaaggccaatatccctgatgaacattgatgtgaaaatcctcgataaaatactggcaaaccgaatccagcagcacagcaaaaagcttatccaccacgatcaagttggcttcatccctgggactcaatgatggttcaacatacacaaatcaataaatgtaatccattatataagcagtttagagccaatgacaaaagccacatgattatctcaatagatgcagaaaaggcctttgataaaattcaacaccgctttatgctaaaatctctcaataaactaggtattgatggaacgtatctcaaaataataagggctatttatgacaaatccacagccaataccatactgaatgggcaaatgctggacgcattccctctgaaaactagcacaagacaaggatgccttctctcaccactcctatttaacacagtattggaagttttggccagggcaatcagacaagagaaataaataaagggtattcaaataggaagagaggaagtcaaattgtctgtttgcagatgacatgattgtgtattcagaaaactccatcatctcagctcaaaatctccttaagctgataagcaacttcagcaaagtctcaggatacaaaatccatgtgcaaaaatcacaagtattcctatacaccaataacagagagccaaatcatgagtgaacttccattcataattgccataaagagaataaaatacctaggaatacaacttacaggggatgtgaaggacctcttcaaagagaactacaaaccactgctcaaggaaataagagaggacacaaacaaatggaaaaacattccatgctcatggataggaagaatcaatatcgtgaaaatggccatactgcccaaagtaatttatagattcaatgctatccccatcaagctaccattgattttcttcacagaattagaaaaaaacaattttaaatttcatatggaatcaaaaaagaacccatatagccaagacaatcctaagcctaaagaacaaagctggaggcatcacgctacctgacttcaaactatgctagaaggctactgttaccaaaacggcatggtactggtaccaaaacagatatatagaccaatggaacagaaagaggcctccaaaataacaccacacatctacaaccatctgatctttgacaaacctgacaaaaacaagaaaaggggaaaagattccctatttaataaatggtgttgggaaaactggctagccctatgcagaaaaccgaaactggaccccttccttacaccttatacaaaaattaactcaagatggattaaagacctaaatgtaagacctcaaaccataaaaaccctagaagaaaacgtaggcgataccattcaggacatagtcatgggcaaagacttcatgactaaaacaccaaaagcaatggcaaaaaacccaaaactgacaaatgggatctaattaaactaaagagcttctgcacagcaaaagaaactatcatcagagtgaacaggcaacctacagaatgggagaacatttttgcaatctattcatctaacaaagggctaatatccagaatcaacaaggaatttaaacaaatttacaagaaaaaaacaaaccccatcaaaaagtgggtgaaggataagagcagacacttctcaaaagaagacatttatgtggtcaacgaacatatgaaaaaaagctcatgatcactggtcattagagaaatgcaaatcaaaatcacaatgagataccatctcacgccagttagaatggcgatcattaaaaagttaggaaacaacagatgctggagaggatgtggagaaataggaacgcttttacactgttggtgggagtgtaaattagttcaaccattctggaagacagcgtggcaattcatcaaggatctagaaccaaaaataccatttgacccagcgatcccattactgagtacatacccaaagtattagaaatcattctactataaagacacatgcacatgtatgtttattgcagcactattcacagtggtaaagacttggaaccaagccaaatgcccatcaatgatagactggataaagaaaatgtggcatatacacaacatggaatactatgcagccattaaaaaaggatgagttcatttcctttgcaggacatgaaactggaaaccatcgttctcagtaaactaacacagaaacaggaaaccaaacactgcatgttctcactcataagtgagagttgaacaataagaacacatggacatagggaggggaatgtcacacactggggcctgttggtggctggggggctaggggagggatagcattaggagaaatacctaatgtagatgacaggttgatacgtgcagcaaaccaccatggcatgtgtatacctatgtaacaaacctgcatgttctgcacatatatcccagaacttaaaagtataataataataaaaaaaagatctaatggctaaacctatagaaactctagctagacctgtggtttctattccttcctgggtataataataaaggctcacatttattttaagtgttacatttttcattgacattgaaatgagactcccttttcgactaatcggctgctttgatttcttcaccctaaaaatcactcttcaatgttttccacaattcttcaacattagtaataacttcctatatagtatctgtggtcctttttctttccccagtgtgatatatttatcatctattacacaaacttcctcttttgcttcctcccttttcaccaccagctctaacatcttaaattttcatttgacatactgcttacctaaattatttcatgtgtgttcccatccatggaaattcatttttgtgtgacataaatccctaccctactctatttcacagtaataaaactttatactgaattgccaaagagataggtaaccaaccacgcagtttaaattaagtgcaagatacacatgtttgaatattctgctctctgtctaagatgtgtagagacaggtcctgtttgtgtctgagcattctgtcatcttattcaaactgttggagttaaatcacctaagaactgttttctcactttgattcaaaagtaacttctgctatgcaaaaaaagcacagttatgaaataatatgtgtattaaaaaatctcaaaaataatgattagagtcacattcagtctgtgaaaggagtagctccatgacttgagcacatgccaatgagattagaactcatcgggggttggcattctcattgattgttgtccctctgtaccttcaatggtttccagtccttgtccaagttaacctttgctagttgttgtagccatggtaaatatcctgtttattggattttattagcgttttaaattttgacatttggaaaagcacaatcctccttctttttcatcctgtcatctttagtgtataagtgtccaggctccttccaattttaagtttctctttcctagctttagaagattataattttggaaagtcacaattattctgctagttggtggccagaacatatcaattgcatgtaacaaaattttattcagatgcatcattcatacattttaagtctcacggtttacttctttcataattatttgacatttttggtgaaataagtttagttctgaatcacccattttgttatgttgattctccactatttttggcgatacaatagtaataatgttagacatttgtatagcagtgtaaagttttcaaagtgcttccacatacacagctcttatttgcttctctaccttaggacataagcaatgtggtgttatacccattttacagataaagaaacacaggaacagagtattactttggatcacacatggtaagcctcgaggacagaatgagctcctgtgctagtgttctttccattgcatcgtatcattagtaatgtttacttacacctacatacttactgcttttcaaatatccagacgtcatctcctctactgtaccactctattatcactcgtgtcatattctgtttttatctctttgctaaggctatacccacccttccagttccccactgccctcattagactctgagctgctcgagaaaaatgattcatccatctttgtatctctagacccaagtaagatcacaccacatttttgccaagtctctcttgtgctataaatgttcatcttctcttagttgtaaattgctttcaacccaccttttttttttttttctaacttttattttaagttcaggggtgtaagtgcaggtttgttatataggtaaacttgtgtcatgggggttgtacagattattttatcaatgaagtactaagcttagtacctattagtaatttttcctgattctctccctcctcccatactccatgctccgaaaggccccagtttgtattgttcccctctatgtgtccacgtattctcatcatttagctcccacttataagtgagaacatgcggtatttggttttctgtggttttctttggttgctgtgttagtttgcaaaggataatattaccactgaccccagagaaatacaaacaaccatcagagaatattatcaacacctctgtgcacataaactagaaaatcaacccataatttttaagtttatgttataaatattagtattatctgagaggaaggcattacatccataagcagaaaggtggaaaaatcaggagagtgagtgatttatttgagagtatctggtttgttagtgaaagagatatgaaacaaacccagggctcctcatacctaggctacatctgtaacaccaaagtccaatgtactggtaccaaacagactggcacttgtgggatgctgtgtaagcagcatggacagtattcccttatccccagtgcaggctacagttgcttaaaagaactatggaaaaccggacattttgttcccttctaatttatctgtgttcctgtagccatgtctccacttctaaacgctaatcacttctctaggtgagcttaagtacctaattattaagagccctccaaatttctagtgtcatcttcaatatagttagtgccctttctgtcccatttgccccctgtgcttggcactgaatcagtatagcaaatatccctaatgaagaatcatggtacagggttaaatttacaaattaagcaattcctttagtttttatgtcaattccttttatccttgtatccccaccctgcatttgcttaaaattcatcccactgagaagctaaaaaaacaatgctactatgacgatttaaagagaaatactgaaccctaggactttttcctgagattcttgttacctgtaaactcttgaatataggatcagattacctaggcttccagggaatagtaagaccatacattagcagatttaatattaatctctagaatcccagatttacttcttgtccaggttaaatgcccttttgattattttagcaaaaaataatacaaaaaattgattacaaccattaatggaggcttaaaatgttaactcccatagctttaacccagtatctatgattaaatgcaaaaaatctaagttaatgcaatgttaaggttgagcttctaattgcacaaaagtcatgaaatttaaaattaaggtttctagtgctactctctgtcatttctacaacattcctccaatggttttctacaatatatgtttcatttaaatgtgtgtgttgtagagttcccaggaaagaacataaagcacaacagatcaggattcaacttgtggatacctagttttacataatcaatatggctggaaaagtgtgattcttttttaaactacaatgccctatttgagtgataaccatattcctgtttacaaatttgcccatttcctctaaaaatccttgaatcttcacttctgattacacactagccatcccctagagaaggaaagagcatttatgtaataaacaaaccaaacaacctgtggactgtgatagtacctacagaccttttcttcaacatatgacaaagcatattcatgtgggattaatgttgaaagagtaactcagaatatttaggtttatgggtgcatctagcagaacaagcaaaggtgaatagggactggaatcctgttaatactattaataggactagctgaggaaactgtcatcaaattattaaacctctctgaatgttattatcagagtaagaatacctgcttgtaggattattaggaagaacgagtgaagtaatatatgtaacacatgctctttaaaactctcttggagtttatagtaatagatcaactattactattaaagaatgagtaatcataatttaatgatcatctggatgtctacaggtattttggaaatatgaaacaatgataatttaaaattcattttattgaaagatacctagaattatttttttcacaatagtttcattaagttaggtatttgtttatagcctactatggaatgcccagataacatttaatacatgatgcactgagctgcatcagctaactctgaaggcaggtgagttaaatgaattcttggatattgggctgccatgcccaatattttcttcaaattttatgaaacatttgtgtctaaatagaaaatgtgcttgagaaattctagcccaacatgcaatttagagagaaagttataaatcataaatataagagcttagagctaaagtgccacctcaaccataactataataaaaactcctaagtgcattctggcaggaataaataaaaaatggcaaagcctgttgtggacggtgcagagcccaggaaggtaaccaagtgagtaaacagctaaggcaggattatcctcatttgggaggactccattccagacaggaattaaagaggaggggctggggaagggagaatggaggttgtgggagaaagtgtttttgcatttgaaagcagctaagttaccttgtgtaatgaaaaggaaatttgtttttttcctttcaacagtaatctcatttgaggtctagcagactgctacacaaaagatacatgtgttctacctacttggtttttctcctctggcagtgaggtacacaggaagggttcaggtgaatcagaaccattcagaataacatagtcaaattcctttccaaaggtttaaatacctattctttaatagctttcttcaaaagactggtaacttactgcactgttcctggcacattcacaaccaaaatttgttcctgggagtactataatacgatgcaacaaatgggtttaaacgaaagctggaaagatctatactgaaactatgaatcacaattactgaaagcaaaaaaatctcatacacatataatatccagaaaaacatacaactgtcccttggtatcctcgagggactgattccaggaccccactgcagatactaagacttgcagatgctcaagtccctcatatgaagtggcacagtatttacatataacttatgcacatccttcccttatacttctcaccatctttaggttacctataatatctaatacaataaacactaggtaagtggttgttatagggtatttttaatttgtcttttttttggtatattgttattttttattgttttttttccaaatatttttgatgtgtggttgattaaatctacaaatgtagaacccataaatactgagggctaactgtataaccaataatttctgagtccttttgtctctccctatgttaaagcaatggtgtagatgagatttctctgaatagaggggagcagctggaccaataagctgcattatcacttagagttatcaggactatatcaactgattcaagccttagcccccatctccgacttgctgtgatatgcaccaagttgcctttcttcttggtactttcctttcttaacaacaactagtaaattgactataaaacccttggctactataaactctattagaaaactggctgtttccagcatgagccaaggactctagctttccatactcaaagatttatatttctcaagtttcttaacaacattggcatatatttattacaatacagtttatacttttaaaatcaagcaaacagttaagattttaatggtcataaaaatgaagaacgcattggctattttctgagtagtgaaaaagttctcttttataatagcttaactcaagaacttttgaagtctttttcttcaaagatttttcatacaaaaattacctttgagagtaagcatgaaaaaatctcaggaagtaggtaagtattgttaatttaaatgcctcccttttcactccaggaaacataaaaccaaatgacaaagtacagatgatttattccacaactattcattgagcacctactattctctggcactgtggtaggcagtgaacaactctgctttaacagtgagaacaacattcttatctcctgtgacccttaaggaaagactagctgtagttagacttactggatttggtcataaagataaattaaatataaagcagtgaccatttaagtttaattatgttaaagaaattttgaaacaatagcttatttaaatcatttaagtatttgtttacaaatttttaccttctttctaaaatgccaagaattgccaaccatgaaattatgaaaacaaatcaataaaaatacaatgatttgaagaacaaatctatttaagataaaaaggcacataacctaacaccaataaaattacctgtagcactcttaaaaactagatttcttctttctttctttctttctttctttctttctttctttctttctttctttctttctttctttctttctttctttttctttcactttctttcttttctttctttctttttttttttttgacagggtctcactctgttgcccaggctggagtgcagtggcatcatcttgggtcactgcagcctctgcctcctgggcccaagtgatccttccacatcagcctgtcgagtaactggaactacaggcacatgccatcactcctgcctaatttttgtatttttttgtagagatggggttttgccatgttggccagggtggtctcaaactcctgagctcaagcaatccacatgccttggcctcccaaagtgctggaattacaggtgtgcaccacaacaaatggccccaaaactaggttttcaaatatgtgagagtatctctcagctatgtcaaaaatcctatgagtcattcattcagtgtttatttaataccaaaacatggaagatagtatgtctaggaactaattttactccaacaataaatctagaagaatgagtacctatttcatgtggttatcatgaagaaactctgtcagaaaactaaaatgaaatggctcatgaagttgacatatgtatgaaaatataagaattctgctcacacctcttctttcttcctgggggcattatccatgagcatcatctctgtatatgaaggacggaaaacccgctttggatatgtatgcttctgggtagtctagtcaaaaaggaatatgaactcttttatctctgaatgcttccaaataccagagaagaatgatttatggagttctgtatatgactaaaagagctgctagtacttttagagtattcattctttctttattccttcttcagggtgatctggaaattgcccttcccaggactttctgtctctcatataaactaccatttgtataccactttttaggttgcaaaatgctttcacatgtattgtgcaatttagttaaaaggcatcagggtgcgaggatcaagaacactggctttggtaccagagacatcagtgtttaccaaagctacttactagtggtacaccattgtgtgagccacttgatcactttaagcaacaattttctcatttgtaaattagggataacaatatccaccttgcaatataaggtagagattagcaatagggcagttaaaatgttattatgattaataacccatagtagggacaccaaggacttctcaatagtctgtttctcttcatcaggctggaggagggggtcttcacagttacttatgagtacatattacaagcttctagttaaagtaatggcctcttcaaatcttagatctgaaccatcttcataaaacagttctttaattcatggccaaaaacatcgtttccatatactctcagagacagagtccttttggagcaagatataaagtttaattctaagtctttttttaaccccgaaactattttccctgaagcaatccatgtgctgccatcagattttattaggtgggctaaaatagagtcagaaggagatttctttacataatagctgtccctacagaaacttgagacagtcagcttaaaaattatttttaatgaagaatttttgagatccataagtacaggaaaaattttgatggtctttctcccttactgattcattgataattctcaaacattgggctggcacaactagagtaaatcggtacatcttacacagtggaaagcggtgggtgtagatgtttttggagccagtcagtctctggcagcggatagagtcacacttgtgctttgttgcccatttacatcttcagaaagcagcctgggtgggcatgcttatcaaatgtgctcatttaaggataaacccatttgaatattataacaacatttggcaaacttcctctaccgaatggtggacctggcccactacctctgaaaactattgcctggccaggcaacataggtcctttgactttctttacatggtagaacacatctgagaccttccaatcaaacacccaggaggagtcctgagtgctttacctgttcctcaagcattctgaaggttctagtctggactagtgggttatggatatatggatatgcagtgagtccttccttttgcaacatacaccttttttttttttttttaatccagactggagaattcaaatgccttgttaatatctagtggtcacctttggcatgaagaagtcagcaaacatttactgaaaaagttgcacgtggagaattctgtatcataattaaggagatgccctccactccctgaagatgtttataattcttgctgggaatgagggaaaaacaaaacctatacaggcaaaactgcacagcacttatagaccaacacaaaagtgtgtacacacagtgtacaaagacttaagcagagcaaatagggttaaaaaaagaatttggaagaaagtaatggatatacattttccaaggtgagagagaagaataccatagagtggagaaagcataaacaaaggcatggaaatgggaactggaaagcccaccaacttggctaacatagagaaagcagagcagtaaagagtagggggtaactacaggggcatggggatgcatgaggaaccagtttgtaaagattaccaatgctaagccaaagctcttgttcattccattccagggaaacagaagttgatggagaccttggagttgggaaagaaaaggaggccaagaaggataactggtagtagagtggccttacagctagatgaggaattcggattctagtcttcaggtagaaaagcagcagtataaaatccaaggccaagaaatgagacatagaaaattatgtgtgggagcaggtatcctagatgcttaaaaaaattgttttgtgaagatagtttgaaggaagggtggcctattcaagcggttcagaaaggagataaggggccacttggtctagtgtcagcccttgaaaataaataaaagaaagaggctgaatgaagagatattactgggtgagaactggcagaatttagtgactgactgaatggtaatgaagggcaaaagaagaaaagatttaaaaatgatcgtagtgctggggcctcaggaaagggtcctatggacagtaattgaaaaagaaaactggtggctagagcagaagatgctctggtcagtggtagagcatcccaatgattaaggggtgtatgcatgtgaatgcatgtgtgttactataggcacacagatttaggagtaatacctcctttgccctaatgttacataacagcttacaattttctttcaattgaaatctttatttcaagtatttattaagtgcatactaggtgtaaagtttacaataagacttgtgcaaggtttacaataagaaaacataaaaaagttctattactgaacagaaactagtttaaactttactgcaacattttttaaagagtgtattttcatttttatattaattttctattatttgtaattcttaggccactgacataacagtgctttcattagtgctagatatgccaccttgacacaatttaaaaatcaataatttttcttagtgtacttggatatcttccttttcctaaatagtggttatgcatttggatgaagccagtgaataagatggcttttggtttaaatttgcacccagatcagtcctgatagaaggccatgtgtttctctgtaagagacacatgtgcatgtgcatattctctgcctcactcagattagccttatggccatggtatcagaactgcaaatagttatattgtggattctttcttgtttgtgggtgacaggagaaaggaaaactcacactttttttgaacaaagcaccatgtagatatccaactgaagtgggctctgttcatcctcaattcaggtgtgatgaaaacctacagggagttgaccttcagtactgaccttttacattatctcatttctctcatgcaacttctgtctaaggatgggaagagacctaagagatctattagtctcagaattacattcatctacaggtgtgccaaaaggatatcaagttttaaaaacacaactgcactatttcttttgtttttctttttattttctttttttttttttctttttgagacagagtctcactgtgttgctcaggctggaatgcagtcgcatgatctcagctcactgcaacctctgcctcttgggttcaagtgattcttctgcctcagcctcccaagtagctgtgattacaggtgtgcatcaccatgcccaggtaatttttgtatttttagtagagacggggtttcgccatattggccaggctggtctcaaatgcctggcctcaagtgatccacctgcctcagcctcctaaagtgctgggattacatgcgtgagccaccacacttggcctatgactggactgtttcttaacattaatataaagcaaaggttgcataaacaatggatgtaggaagctcattccttcataattattaagaactgaaaaggtacattgaagaaaactagccatgaataagaaaataacttcttcacagtggttaaagagaaaaggtactgaaaaaagtaaacaaacatatgaaagcctcttaatatactaaggtattactatatatatttctgacctttggctactgagaaaatgtgaaagatgacaattctatagctattctatataacggcagatgctcctcttattccaggaaacaaaatccttttatgacatttcactaaatatctaatcaaagagtattttatgtgctcatttcagatagtctcattcacttgcccttataactttaaatgagttcttttcttaagcaggccagcttgtatattatttatgataaaatactttctttaagatggattcagtgttaattttgtactatatgacttagtacagtgggacaattacatataacacttcttctatcagccctatgtttctatgttctttattaagatattatcaaagtaatagcaaaattctgttaaatgttcaatgtatatctttactgctaattttttttcaacatggtaatattactggtaccacagtgactcctcatatcttgaatatatgcagtacaattcattctctactagcatcaatttctttttgtaaacagaaatttggctttaacacagcaatttccaccaaactatataagtgctaatgatgaccaatttaggacataaacagtttactactgtcctttgagcctctctcttttttcatttctctaatcatcacactaaggattttttttctagaaagctatgggcagagttgatttcacagagttacaagttgacctttttcttttttttttttttttgactgatgctgttaatagagttttggtgactctatcagttaagaggtataccttgtacctgacattttacttgcttgagcaactggccccaactaactgatttttaatattttgcttttctgtttcctcaattttccttccataaaatattttttctacttctatataacttcttttttatttttttgagatggagccttgctctgtggcccaggttggagtgcagtggcgcgatctcagctcactgcaagctccacctcctgggttcatgccattctcctgcctcagcctcctgagcagctgggactacaggtgcccgccaccatgcctagctaatttttttgtatttttagtagagatggggtttcaccgtgttagccaggatggtctcaatctcctgatcttgcgatccgcctgccttggcctcccaaagtgctggaattacaggcatgagccactgtgcccaccctataacttctttatttattttttcttcccttatcaaattccatctcatttttcttacgcaattaaaatatttcctcactacagtttgggtcagcggtcagtcatatttacatcactttttccatagtttggttgatgatgtgcatagagtatatgcactagccaaactgatccacattcactgtggataggctgaagtccaaattgtaagctgatttgtcaacagctttgagtaagcctgatgccagacaatattttaattcttcagtgatatttcctcttcacttatgaaggaagccttgaagatggcaagttaataagtgcattgttttaactctgtaaataatgctttttggggggttgtctttaaagattctcatttactttttataaagaaagttataatttcttattttctggttccattcttgatctctttattttccttcagtttgtggatttgctctacttttaaaaactcataacttatgagtaattttacagatcccaagatatagtttgtttgttttttgagacagggtctcactctgtcacccacgctggagtgcagtggcgtgatctctgctcactgcaacctctgcctcctgggttcaagcgattctcgtgcctcagcgtcccgagtagctgtgattacaggtatgtgccaccatgtccatctaatttttgtatttttagcagagacggggttttgccatgttggccaggcttgtgttgaactcctggccacaaaggatcggcccagctcagcctcccaaagtgctggaattatacacataagccaccacaactggccaaaataaatttttttaaagaggatactgagcatctgaaacaaggggggtttgtagactcacaaggattaaaaattatttcgattgtctttaaatcgattgttttttaatcgattaaaaatatattcgattgaatatagtgatgcatttatcagtctatcattctgtaaatagtatggaaaattctggaaaaaaattcctgttcacaataaaagagattcaatttgcgtaacgatatttactgtgtgcctactgtgtcctgtcctaagacacagtattaaagttctttcacttaaagagttcatacctagcagagggattagacaaatttatagacaattatgcaaattaagtaataagctttacaaaagaagtgcacaaaaatttattgtgggcgggtggtatatacaagtcaatgactttcgttgcatgggagagctaaagagaagtaagcaataagggcctcagaaagttagaggcatttgggatgagcctttgaggataggtaatatttgatatatggaaatgaagatagagatatacataagcaacaaagtgaagaatgatagattggaagtgggctattcaggaaaaaatgcttttctttggaaaccatggataatatttcagcttctattcttataaattagtctcagcaaagttgccacttatcatatgttcaatatgaagtattttccttgcctataagaaacactacaaggatgtgagtagaggtgaaacatagagtagacgtgtcccaattgtaccccagatgtgtttgtaaacttctaggtatggtttccaaagaaataaagctcacagaacttttattaagaacacttttatttctataaataaatggaaactcatcttcagctaaaaatatagtggcggctcacatctataatcccagcactctgggaagcccatgtggggggatcacttgaggccaggagtgtgagaccagcctggacagcatagtaagactccttctctacaaaatattattttaaaacattatttgggcatggttgctcatgtctataatctcagctactcagggggtgaggtgggaggatcatttagcccagaaggtggaggctgcagtgagtcatgatttgtcattgcactccagcctgggtgacggagcgagaccttgtctctaaacaaaacaaaacaaaacttggaaattctagatatccaggtatttattcactaccacatagcttaactgtatttccttattattttgtctctagctgaagttctctggaatggtcatgaagagagaaaacatcaaagattaggaaatctatcccaaaaagatcacaaaatcaaggacagtgacacctttttgagctttttacttgactcttcctgtttttttttttttccacttcccttagtcattcactaatcagttctgctttagaaccattaaaataatagaaaagttacagaaacttggtaaaatgtttctctggcctatttccaaaccgcccaaaattaatgggaaatggttaaagtcaaaaaagctttttctctgacatggatttctaaacaatataattatggttcactccatggttatgagctttgggagctcccacaaaaaagtctttgctgcagatgtggccactggctgctataccaggcaatttgattcatgtttgttgttgttaaaaaaatatataaaactctcttatgttggattaagaggcttttaagaggaagctagacagaaaggccaggtctctctctatttgctcattcatgacaaaggtggaagcttcaaatttgtgatacatgtgaagaaggtgtctgttacttcgtgttacatttttgccttcagaattattgttttcaatcattctattttatataaatgcacaaaaaataagtccaagctaaactagtgatgctgggtcactccaagaagtgtcctcaatatagcttcacaaatttacccttttctctccaaatccacgtttatttcttgagacagttatatgatgttttgccaagaaagcaactgggagcaatgccttatgtttaactgggcttttagatttgagaagcaatccaatccaagacttcatgataagacttccacagcaattggatattagtgacatataaggaccttaagaactccaccattttatactctatataaatgtatgatgtggtacacaaagtattaatcaatacttcatgagcatagtagctctgtttataccaatttctagcaatgtacattaggcaattttgtagaaaaaatataataattgaaagtataatttaacttccactccatgaacacttagcctcttcataccatcctcttccaagcatttctttggtccttggaaaatcagtgaaaaatctgaaaaattgggattttgtgtttgattatatgtacatttactacaagtatactgggctttccttttctgatgctatagagatgaactatagctttcctaactcagtcttattattagccaggtccagtttatattagttaaaatgaacatcataaatttacagtataacttatctggtacattccttctattgtagtttgaaaatgtgccattcaggactgaaatgacttaaacataatcagattttatttctagagaagtaaagtctatacttctataattctgtgaacccatcagcaattaactttgtcccagtagaattaatatagtgttcaagttcaggattgagtagatgagaagaggaaggaacaataaaactcattcactcccatgctaggttctgcaaaatagcttccatattcccataatgtgatatttatcttccttataatagcacatttaaagtcagtaaccctaaaaatctcctacataaaggtttgcatctttccccttaaaaatgtacagatgagcttgtgataaagagatgatgtctcctgccaaattgtaatatcatatagaccagttccaggcaaagtattgaagaagcagtcaaaacttcatatacctatctatccttgtcagcctcacgtattcatggatggggtcacagcttatccctttattctttttggttagaaagtctttccagatgaggtcatcattttcattactctgtttcttcctctctcactagagtgtctttctaaaggaaaccaaggaccacttcagtgaaatattgaaggcaggggaggccctaaatgattaaaagaaacaaagctttcccatagcacgtgtccttttctttgtaaggagatgaggtaatatataatcttcccacgttactaccacaagggcattttgtggcagggagagatggatttctgggagtgaaatccaactgcaaagcaagggctattttcagaagggcttatcttcaatatcctcatttcagaattggtctctttgctcagagcaataccttgggcaacactgagaactcccatctctaaggtaagaataaaagttatttcctcattgatggaatatctgatgaagaaaaaggaagacaaaaaacaataaattattctcataaaaggtgatgcatatgaataaatgtcaaatccttctagtatttctcatgtggcttgtacacaagacttctatttgatctttggctctgcagtttctaccactagatgacccacatgtgtaatctggataggcagctagtttgcttacatataaattaaatagcctcaagtgtcagcagatctctgtatctttttaatatcccccaaactgcttcaagtaggaacagctacaaagaaccttaccaaaggacatggaattcacacttgccaaagaaatcactgcacgtgtaaattagaaactaatcatcacttcctctctggttacagtggcagctttgcctcatagtttatgttgaaatatacatttttatgaaatatttctcactgtagtcagcatcaatttaggagtatcaaacactaattcccagctccagcataccagaaaactagagacagagaagtgcagacaaagggaattgacaaaggcctggacttttcttatacttgaagaagctaattgtatttgtaaatttctggttaaaaacctgacaattatcagatctgccactgcaaggctattcctcaatttcttcatcatatatttttccctaaagtctctcagagaagtaaagggcttctagagatgaaaatgaacttgacaatcacgttgcaactcaaactgatcttgattcttttcgtcactttttaatttattgcagatggtgtaaatgggatgtttactggttggcaggtaatgagtcttgttgtagataatagtgatggacagaatctcacgcctgtcgacatcccagcatctcagcagctatatatggttatcatccattgctttgaagcacatataatattgtgacaggatgcacaatatttcccccatagaaacgatgattggtacacctgaatctcactagttcacatgtcatttgtcctgattccatcctcactgtccacatgagtagacattctaagatgtgatctaatggaaaatgtaatctgtttaaacatccaaacactcctcttccaaggtatcaccatttatcacaactgtcagtgcccctgtggaagagtaatgaccctcaggcatgggataatgctccatagaggccttatgaatgccactgtgaaacacagaaattgaccagttttcagttgggctggtatgtgcatcatgaaagatctgcacttactcactaaattacaagtggctgtttaccctttatacaataaagtctaggttgggaagccacagaccctgctgacttcaattgtcccaaacatgtgagtactagatttggacctgcctttgaaatggacttaagcagcttgaaactggaagttggatcacagtcattcaaaaatacattgggagataacataggtgtcattgccttccacttttttgcctttttaaaaaatcctctctatcaatggaggataacaacatctcactatccactattagcaattaaaaactaaacagggtaagcatgccagtgaaaagttaactatttgtttccttcttgtaagcttcccttcatccagaagaaaatctggatctggatctgttcatatattgtttctacaaagcagaacaaaggtgaacagttatgtggtatgaactcatgattttcaggtccctcccaatgggtccatttcctcattgacgatttccttgaagtcccctgtaccttcccaatcttatctacattttctatgaagtcaccttagataataggatcacttgcactctaagactgtttacatctcagtaaatgctctatcactatgaaagtttcatctaaaacatatctattcctcagtgctcagacaccctgaagatacccttcaggatgtagcatccatatgaagtcacaaaataccagttgatcttcccgtggaaattgttttccaatctgtatgaattgaatggctcaactaaataaatgaagaaaatgaaatattttactcacagtgattcattccatattaagaaaatacactaagtaatgaatggcccctatgaaatcattacagttatgagcatcttttctacttgacagatctctgttcccctcgcagatgagttatgccaacctaactatacttttggtattcacaatattctgattattagtatctccaaagatgggacttaagacactttcctgagaagagaaatttacaattagatacatcttaacaattaataaaattaatgagataatgaaataagaagctctcagtatactgctgaggatgcagaaatctttttgagaattaggaatgttctagaagacaataaaaaagatcagattgtgaactgagcaaaacaacctttgatgtgaagtgtcagccagaaatgtcaatccaattcaagactgcatacaaaggggcactgtgtctttgagctgagaggtattatgttacctgattatcttctctggaagaatgcattatggtttagacacttttattacctgaaagatgtagacaaattagggaagattaacaaccagttttattaggaagtagcagatgagctggtgtgaatggtactggttgttatgagttctgtattctcttttcagctttgatatgctctcatgtgggaatagtcatccttgaaatttagataggataatttatattcttttccccagagaaaagacagtttgggaatgaaagggaggggaagtgtttaaaacagcacaagaacctgggataacagaagggtcagaaattctattatagaatttttcaactcccatttacaaaaatacaaccaacaataaccagttcttaagcctttatttgaataagctcagtacatttagtatttgcagtatgtttttcatatatagtacctaattgtttttggtccacagaataaggctattctatgatactatgttattatgttcatgttttcctggaaatataatttgcaaggtcattctaggaactctgattatgaaattcaacatcactttaagtcagttaccctgaactctaatgcagtttcttgtctcttcatacttaccctggagctataacctatagtcttatagaagtgcccttttcaaaaaggctcccactccttgccttctgaatgactgtctagatatattttcacctgtaattgcatactacaccaaatttgcattatatatgaatgtgattgagaaatgattaagataattgtttagtttattagtgaaaataagtggtatataagctaaaataaattattatttttacacatggcattattcctagttgtatttattatgatttaccatttactaaagtatttcagttggttgacaaggaataatagcactaaacttccttcaagcaatactggtgactcactacagccctaatgttaatacattccctcagacttaatcttttaattctattgggaaacacctataaacacaacagaattttttccttttctgatgttcattcaaattacattacctatttccaccattcagtgtagtaatttctgggaactaccttgaggggtggatggtggtaaagaatcaggacatttaaacttctattaaaaagggacagaagaagactttaggtcacctgtgatcttaggcagctttcaggaaacagaggaagcacacttgtgatgaaccttcataaaattggcccatattcccaataattcccttacctattgagattcctggttgctaaggactttatcagttacttcaacaatcctccctccccgctaataacagtacctcatttgcgaacaatactggactgtactcacaattccttttccccttcctttcagaaagaacacttttacgcccctaaatagtcctataaatggccaaagacataggacatgctacatgattcatctcatgaatcagtttctgttctcttggctgttcaacaaaagacatttcaaattctccacgaggcaatgtattacactgccatgagattaatttctgtcttcaactttggacatttcttaactattaactgggattacttcctttttgctcctctacaacccattctctacacagaaactgtagtgatttctttcaatgtgacattagattctactacaaaaatcaccaatggctgcttactgtaactagaataaaattcaaacttctcactctacagcctatatagtctggttcctgattccttctctgaacacatcaccagtatacttttccttattcactgacctgtcataattcacatgcctagctcacttgagcctcaaggcctttgaagttgctattccaatttgcctgaaatgattttccttcacatcttcatatggctagtttctaacatcattcaggtctcaaccaaatgccatctccttacatgccatccgtgtgagattttactcttactttcttcatttcattcttcattgtgtgttagtgagtttacatgtttattaactatctcccttaactagaatgttccagaaggaaggaggactttgtgagttctgatcactattgtatttccagtgtctggaatagtaggtgctcaacaaatacttgctgagtgaatgaataaattaatgaccaaacagtaaataaatagtaaacaaggccaatatcaatgctctttattacagtagttatttaaatgtacctcaaaatgctctaaaaataaatatgtgctttccctgcacattaggattaaaagtactcattttactaattaaaagccaggacctcaatttacattaatgactggtccaagatcatatggtaaatacgtattgcacaattctggtctgaaatcttgttagcccagtcagtcctacagtgatttacttagaacacaattgtgaaccaggtataattaatctgaggtccaccaataggcttgagggggtttgtgaatcctttgaaaaggtattgcaccctcttttgggaagagggtccatagctttcatcatattatcaatggaagccataaactaaaagaggctgggaatctctttaagcaataccattctgaaacaaattattcttaacctccctaggtagattggaaggctgctggcttcaacattttctgtagagaaggaacacctatgaaaatcctatcactggctgagtagacatattttcctttccagcaccaactctggggaatggtgggcctcacaggctggctaacccttcttggagttcacgggaaaaagatgtctagttcaaagacgatgagaagggaggtatcattctaatcatgtggaaagcccactgtgcttttagtttgtgtttgtagcattcttagcttaatttcagggatgttattgtagctgtgaagattagataataataagaaaaactaattcttaggcaccagacagacaatatgaaaaaaatatataattctaaatgtaggtcaaattttatatttatcagcattgatgcagtgttgttttggtctgttcttaaatttttgttttatgaaaaacaatgaatgcaataatcttctaatacagtgattaagaaacagtgtatatttttccacatactatcaaagcagagtaaagagtgaattttgccatgggaaatagtgtattgctacagtaagtaagaatattaagtttaccaagtttttctagactgaagacttaacaataaataaggcacatcttccctgtaaggtttctcttgagtctgttacttttcagtagatgatgatgatgacagcaacagcagctaacatttgttgcttattatgtaccaggtcctgctctaagtgctttacatttattacttcacttaatcctcccagcaactatgtccatgaattaggtattattattatctattcttagagatcaggaaagtcagatgaggggttatttaacttggtaatgaggggtaaaaccaagattcatatcccacctgtctgatgccatgtccaagcctttcaccactacactttcctgtctccctctgtggtagtgcagggatactttggagatgtaacacatcttaattaaaaatactttattgctgaaaagtgctcaccaccctctgagctttcaagattaccatctgagtggtaatctttttgctggtggagggtcttgctttgatgttgatggttgctgactgatcagggtggtggtttctgaagcttggggtggctgtggtaatttcttaaaataagacaacaatgaagtttgccacatgattgactcttcttttcacaaaggatttctctgcagcaggtgatgctgtttgatagcattttacccacagtagaacttctttcaaaattggagccaatcctctcaaactctgccatcgcattatcaaatgagtttataaaacattctaaatattttggttgtcatttcaaaaaatgttcacagaatctttaccaggagtagattccatctcaagaaactcactgctttgctcacccataagaaactactctttacctgttcaagtttgataatgaaagtatgaaagtacaacaattcagttacatcttcaggcttcacttctaattctagttctcttgttattttcatcacattatgtacagttacttcttctactaaagtcttaagtgcctgaaagtcatccatgagggttggaatcaacttcttccaaatgcctgttaatatttatattttgaccttgtcccatgaatcacaaatgttctttatgacatcgagaatggtggatactttccagaaggttttcaatttactttgcctatgtcgatgatagaaatcactatctacggtagctatagccttatgaaatttattttttaaatataagacttgtaaatcaaaattaccccttgatccatgggctgctaatagatgtcgtgttagcaggcatgaaaacaacattagcctctttgtacatctccatcagagtttttcggtgaccaggtattgtcaatgagcagtagtatgttgaaagaaatctcttttttctgagtggtaggtctcaagagtgggcttaaaatattcagtaaatcatgctataaacagatatgctcttgtcctggctttattattccatttatagagctcaggcagggtagatttaacataattcctaagagccctaggattttctaaatggtaaataaacattggctcccagttaaagttacctgctgcaccagctcctaacaagacagtaagcctatcctttgatgctttgaaaccaggcattgacttctcctcaatagctataaaaaccctaaatggcatttccttccaagtagaagactatttcatctatattgagaatctgttgtttaggtcagccaccctcatcaattatcttagctagatcatccagataacttgcttctctatcagcacttgatacttcactttgcacttttatattatagagatggcttctttaattcatcttcatgaatcaatctccactggcttcaaacttttcttctaaagcttcctcacctctcttggtcttcatagaattgaggagtcagtgccttgctctggattaggctttgtcttaagggaatgttgtggctggtttgattttttttttttttttgagacggtgtcactaggctggagtgcagtggtgccatctcggctcactgcaacctccgcctcccaggttcaagcgattctcctgcctcagcctcctgagtagctggaactacagacacgtgccaccacactcagctaatttttgtatttttagtagagacggggtttcaccatgttggccaggatggtctcgatctcttgacctcatgatccacctgccttggcctccaaaagtgctgggattacaggagtgagccaccgctcctgtttgatcttttatctgcaccactaaaactttctccatatcaacaataaggttgctttgccttcttttcattagtgttttcactagagtagcacttttaatttccttaaagaacattttctttgcatttacaacttcattactgtttagtgcaaggggcttagctttcagcctttctgggccttcctcactaagcttaatcatttttagctttttatttaaagtgagagataacgtgactgttcctttcacttgaacacttagaggtcattgccgggttattaactggccttatttcaaaattatgtctcagggaacagggaagtcccaggagagggagagagatgaaggaacagctagttggtaaggcagtcagaacatataaaacatttattgattaaatttgtcatcttatatgggtgtggtttgtggcacctcaaaacaatcagaatagaaacatcaaagatcactaatcacaaatcactcaaacaaatataataatgattaaaaagtttaaaatattgccaagaaccaccaaaatgtgacacagagacatgaagtgagcacatgctgttggaaaaaatggtgccaacagactcaatacagggttgccacaaactttcaatttgcaaaaaatgtaatgtctggaaagtgcaataaagtaaagtgcaatagaaagaggtatgcttctatatcctattttcaatacaaagatgctgggtagccaatttctaccactgtctttgtctatttgacaaaactttcccatgacttttatactgttaacttttttgaatagcagatgagacacatacttgcatcctcaaatctgcaaagacaccttgggccagtttgaaccgaatcccatttttaactgaaaatgatgaaaataaggtacattattagcctgaactttgcataactctaaaatgtattaatcttcggtaaaaattttaatcttagttttagaatcctcatgaagtacttagaatgtttaaatgagataacactgggtatattaaacattatgaaattgccatttctgtagcttaaaaatggtcaattgttgccacagtcaagtgattaaacctaaggtaagtaatcaacttaccttattaagttaactgctattgttgtaagataaattattctcactctacaatcctccctccctgaaaacttttctagtctggaatgtactgctgataactagtgctagggacatagggttgaacttgcccatgattttaatttgtaatacataggcttttaaaattcatatcatagcaggtatacctccaaatgatgccacaaagacagcctagaaaatgggccttagaagattaagttaataaaggcttattatttttcctatagctggatgtactcttaactagataactttcaatagaaatcaagttcatgaagcaggttcatgggaactgtattagtttcctatcgctgctgtaacaaattagcacaaacttatagttctggaggtcagaaagtcctaaaatcatggtatcagcagagttatgtttttttctggagtctttaagagaaaatccctttccttgagttttccagttattagaggccacctgtattcattggctcatgatctattcctccctcttcaaaaccagcaacgcagcatctttcaatctctctctctctctgacctctgcttccatcaccacatctcctctgtgatcctcctgcctgcctctttcctttaaacggcccttataatcatattaggcctaaccagataatctggcataatcttcccatctcaaaaatccttaatttagtcacatctgtaaagtctctttgccatctaaggcaacatactcacaggttctgaggattaggatgtgaacatcttcggtggggtggggaggggggcattaatctgtctgtcacagagaccgaaatattctaggtacccaaatttcaaatagcaagcaagatggtatcttatttctttaaacctcatagcatggtaagctgcacagacatttttacatataccctcataatttttaaggagattgtgatgtacaactctccagtttctcttctggcacaagtgtgtggaaatcatggtcttagctttggtttgtagaaccagattttactcctttacccagttttagtcaatcccatttatatttaaatttgtcctttttgagcattcatactgctatccttagccaaagaattattagtacagtaagtgctttctgcacttccttctcctaactctaggaataaaaggcacacgtgtttagctgagaaccaaccaggacagaattctagcacttctcattacatctttcttgtgctcttccttcaggcactacattgacatctcaataagcaaataacaccagcgttgcaggtgttaacaccaatgactataccatgagaaattcccttatgtcacgccttgcatgggtaaagttaactcaaatgtcttccttctcttacctaaaatatctgcttgcctgacctacatctcccttgtccattgtttccaatgaacactaacccttaaacatttaagcctcatcagcacatgcccatcataacagcataacatccttgtcctgctggaaactattcagcatccagaggaccatctttatgctgataacactaaaatataaaataatgccaacagctggtgctacaaatggcttttaaaaacgatgttcattcactaaaattcctcttgctacttttgacatgaaacacgcagtctctaattattctgatcaagacggtgaaatacaaaaacaaactttaattgtgtttaacagatatttaatcaggactcactgaactacagattaaagctgaaattcataaaccataattacccgattgtcgcaatcttttggtccacattctccttccgtctgggcgtctggcaccttgccccgaatttcttttactgtcttctcagcttcattactgttcatgttttccagcagagatttagcacagattacaaaatatctgttcttggcaactttcttcattagctttttctccccccttgcaaaaagtttattttcttttttctaccagagtagctggaacaggcatacgtttagggtgctttgatgacacaaactaattatatagttatcaggagataatacggtagcgataactaaagttactacagttatcatgtaggtatcatgcaatttctccagtataccatgcggtgtgtcccagtcaccacgtaattacctaatgtcactactgcattgtttcatggaaaatgcttatctcaccccaacaaaaccttttctgccacatttagagaaaaaaaaagaagtgaaattcttagttctcatatccagtactgctcattcccagtaagatgttgtcatgcaaatgtaagggaaacacctgccctctcctgaaaatttgctcttacagggagcaaatggagcaattattattattattttttcctgcttcactctttccaggtaaaagaagtaattaccaacaatacatacattttttctttttttttctttttttaaaagaaaccaatccccctaccgacccccgaaagaaacaccctatttacttaggattcgtttagtctggcacttcccccctatactctttcctttcaaatttcagtcactcacatttgtttttcctagaattatggtgtaaatcattcttaacaagctaacttgaaacttctctcactcagtagaaacacaaaatgccactgtaattgaaacacggaagcttgaaactctttctaaccagttcttttgggccactcttcagaagggcatgccgagtttccctcacagtgcggtaacccctgggtcacacagcgaggataacatcacagaccaaggcaagaggataaagagaaggcactggctaaagaagaggtgggtggttcctttattccccccagttgggcagtcaaccctatgaagcaaggactgtagttgctacttatttatctcaagttgatggcttgaagtctgacctcactaagacctttagatgtgacataccacctgagagttccagtttaaaacaggatgtagcagcttcctttgcagcacaagttgaaagctatttccaattctgcttttattagtcacctcccaatctaagagctgcccattcaattgtacacttaactcatgtcggggtaaaaagcacctccagatttagaagggccagaaaaattgctatcctatcctagcacattgttcttcaatcacacagttcctctaaatacagttgacagcctttgagatgcaaaatgtatcactttaatgtagtagaggtccccttcactgcattgccaaatctatttagcagaatcttcttggaataatctgtccctagacctgaggatgcacagtgatttcaagcattttaagctaatgataatggttagtgctgagaacagatgtacctggctgtgatgtgatctattccagtaggcttttatgagctgttcattcctattgacttagcattttatgtctgtgcttttgcctggtgtgatggttgcataggggtgtcatgtgtgtattttcctgatgtgtgatggctgcacagggggctgtgtgtattttctcagtgcaatggccacacagggtgttatgtgtgtgtttgcctggagttatagctgcacatgttattgtgtgacttttctctctatttgatgcttgctcgcagggtcctatgtgtatctttttcttagtgtgatggttgcactcaatgctgtgctaatgatggacatttctagcaattatctatctacagggtcctcgggaaaaaaattgcagtgaaatcaataaacagtgctagacaggcccttgtaaatatgaaatgacaccatgcataaatgccgtttcctactatagcatgttaaaatccaaattctgttatgttattggcattgggataaaatttctatggtccctccatctccttcatatattgcaatcttttgggggaagttgagattactgctggttggagggcttttacacatgcatctatgtaatactactttttgctacattgtcctacacatcatctcttatactccattctgacttatcctggcataatagctgatattctaaaagtgaatatgcctttcatttattccttcagtctcaccaagccctcccccatataacccctacatcacacatacaaaaccccctcgcttgcctccctctctctagtttctccgtatccctcctgtgttcaccaaacggaactgacaaaggaaacaaccaatgaggttaaaatcttttgaaacccctggaatacagatgagctgggaggcatctggaaacaaaaccagacacttgaaatcaaagagacaagtaaattactatcctaatctaggaagaataactaaaggtgtcagtggggttccattgatagcacttggctctgggccagaatgccaagggttcaaactccacaccagctttgggctcaggcccaagacttgctactgcagggtgcagcagcatgtgcagcagtgttaaaggtgtcagccttctgcagagaggttaagtccaagtccttctgcctgtttgtcattacaccccagagagacggagagataaccctagctttctcttcgctgcctttctcaatagaacaggctgaggaggaactagtgctcagcagcagtacttgctagtatgagtactatacaactaattagtaaaattcccctctactgataaggctgcttgaagtatgcgcaagaaaatccactgtccctctccccccacgaaaaacctgatgtttgtcctaaagattcttccatcaatgcaaagagctaagtttggaaacctaaaaccatgtgtctaaaagaaagaaaatgttttcattggaacagcttacatgtctggtacacttgcataaaaactatcgcatagcattttagagctaaaattgctataaaatgcttaatacagtaagagtaattatgagattttgcatgcacagctggtatacaactagagtctcagccacatattcaatggagcatgggaaaaccatttataaaaattcctggtatgccagtttaactcaccatcaacagcctatcaacacttcattctttaagtggatagggaagatatttacctaccaaatgctttatttcttctctcatggatgttatcaatacttgattcaaggaatttgagttattacttagagagtataaatataagctgttaacaggacatgaatgacctgaatgcaagccttctccactgagtgaagaagttacaatgatagtagtaagtaatgaaccagaagaccaaatcattaaatctacttgtatcttccctttttaacctccgctttttgctatatcttcacatattcttatctctcttcatttctctaagattcaaatcctcgggtgagttcctgggtactctggactcccctgccatagcccacctggccttgccttcccctgagtaacaccctgaagacagagctcttcgtttacattttcccccaatcaagttataacaggtatttgttctccattccctttagttccagctacatcacttgaaaagaaactgatttgggtgagttgttaatggttaataataatttaataaagtttatttcttgatgaaaacattgattttaagagtcaaatgaagaacctctttattgtggtcttttaggctctatggaaaatgccataataggtgagatgattctaatcagaagcattgatggatgctccattgcacattttttagccataggagccagtggatagatgggaattcccaggtggacaggaagtttggggtcacaaaggcagcatgacacaatacaaaatgaatttgaacagaatcaggaaactcaagttttaggaccaacaaactttgccacgaagtgtttggcagacattcagtttcttaacctgagaaatgaggcaggccctgggatcagaaactctccatgatcctctctggctcttacattctatgactctctgaccgcagatcagtcaggtctcctggattagctaccacctccagttaagaactaatagttctgaataaagatggcggtcattccacactgagccaacctaactaaagaggtgttgatgtccataggtgagttttacctgtctgcctacaacctgcatacactacttttgagttggctcctttatgctatacagatatttcttagcattttgttttccctcatttacttaattcagcaaacatttaatgagcactttctatacatgaaacacagagtcgatcactaaggacaggactgaacagggcaccatctctgttgcacagatgattttattattcttgtccattctctctctctctccccaccttcacttttatgcataaacacatacttctagaactataaaagtagtatagaaaaaataagaggaattagacttatctgagccagtctgaaatactgtttattttaaacaaaagaatatgataataatttgtgttggcaaaatatatgcattcaattacgcacttcaatagtataaagggtatttctcaacatgtattttgaggtcagtaatttgcaataaggataacaatttgggggaaagaagattataaaggtaaaacattcccttctgtagaatcctgataaagtcctaggataaaatctgtgacttgtgtaaataacctctgggaaagtgagatcatagaattttttttttaagtttttgtttttcctctaaggattttgggttcatatccctccaaattttatttcctgacttaaaaataataactgccacttattgagtaaatattaaattccatgcacttcaaatacattatttttataaatacagtatgaaatacaatatattaatatattgtataatacaatatgatatattataatacattgtaaatattaaattcaatatattattaaagcaactctgctagatagatattattactctaacagacatgaaaactgtgggtcagagagctgaagtaacttgtcaaagataattcagacagtgtgcagagttagaatttaaactcaggtctgtatttgtctatgcaatatggctccataaccatttcttggttctgctgaatctaactttattttaaaaatgaataatcttgcttgaatgctttgttagcaaataaggaaagcaccctttttactcttccttcacattcattcattgcattacatatagtacaatgaaaacaggagatggttaagattttttcaatgcagatctggttgccttttcatattgatttggactgagataattaaatttgggctctcaatcaaagtgaaagaataagctatttgctatctgaataagtatttcttattaattgatcagacatggataaggtgtgttattacaactatatttgtaaggtatgatttatgttgttctactgcatattactctgtgctgtttttcattttcttgcactttggactttttgttttgtttttatgaatttagtcacagttggttgtgtgttgaactttgtaaaaatgtaatactaaggaaattaaaaaaagaaagaaaatattttcaaaatgatgtcaaaatcaaatctacccctcactaatttgatttgtaggaaatggagaacaaagtattagaagcagaatgcttttaaataatcctaattacttcaatgtgcaaatgcattgactaaatcgaagcatgcgtttaacactttgcacttcaattgtgcttattcatctaagttctatagatagcaattctataaaaaacaagagatatagccagccattccatagttattgggggaaaactattgttctaaaattcaagcttacctctcaagtcagcccacttttggactaacgcagatcattaggtcaaagaactcaaaataacataatttactgtaactactcaggttttcccaattgactctgccttccctattctttttttctgccttcagcggggtggggtgaggacgtggaggaaggaaagcttctgttaacaaagccacagagtggaagcagcaaggcttttggtagtcaagccacacagcattaagcagggccaatcttaaggaataatgccatggggttagagtggtttgtgatcaaggctgagatggagtcatgatggcagggtaacttagtacctggtctaggaccagctgcatcagaaccacctgctgagcatgttaaaaagacacatttcagggtctcactccagagcaaaccaacagaattagtatctcttgaggtggaactcagatctccattttaaacaggctccccaagtaattcttatgctacttaagcctgaaagcactggcatatgcacttaagctctctaattctatatccagcgacagccctgctgctacacctgtatactctgtcccagtcttcaagacatatgtgcaagtccaactacttgtcctgggaggcattaatgctaataataatggcccaagggcttagctaggcatgatgttatttgacatgcagtatctcatccaatccccacagcaaactacgagacaaagatgattactattctcatctttcagatgagaaaactgaaattcagagagacttagtaacttgttctgggtgccacaataataactgaaagagctctgaagaactatactactgtactttaactcagccctgcagaaaaatatcttgaaagatgtttacttctaaaggtgttcataacttggtgatatcattattccaaagaaacttgcctagatgctagtaagatagattatggaataacacacaaagtgtaagcatttctacccaaggaacttttccttagattatttcatagagacttaaactctcaaaaactaggctaagaatccttcattagttcgttcaacaattatgcactttgccagaacctgaggtatacaaagataaacaggacatagtctctgccttcactagacttacagttctgaaaaagagacaagcttgtgtacaaatggttctgggttaacttatacagtcagtggaggcctgagggagagagagtagttcattctcctggcagaaggaaaagagggtgaggtctgtaaagttttagttactccagcactatgccattggctaatgtaaggaacttagattttaaagattatatttttacttgtacagttttgttactaaaggggcagactaagttacttgtatatttcgagccaataaaactttatctggttcattctctctggcatcaaactggttttcttttttgggtaaatttctgggtacagagccaagtaagttgttatgtttattcattcttacacagagcaaccgagattctattcttgaaatgagtgcctaataaattttatcagtagtactttattccacccaataaaagtggttcttccttgacatactgtgtcctttattttcacttgtttcaattactcagaatgctattattagatttgcatattttcataagagaaatttagaaattacaaatgattgaaaacaaagaacaatctagattctttcctttgtgataagagaggatgatcccatatacatgtaaatgtgctttgagtatgttaatcttagaaatgactgaagaaaatgacattctaaagaaaatgagggccaggcatagtggctcacgcctgtaattccagcactttgggaggttgaggcaggtggatcccctgagctcaggagttcgagaccaccctaggcaacatggtgaaaccctgtctctactaaaatacaaaaaagtagctgggcttggtggcacgcccctgtagtcccagctactcgggaggctgtggcacaagaattgcttgagcctgggaggtgtaggttgcagtgagccaagatctgacacttcattccagcttgggctacagagtgagactccaacaaaaaagaaaaaaaaaaaaagaaagaaagacagaaagaaagatgaaagaaagaaaagaaagaaacagagagagagaaagagagaaagggaaaagaaagaggaaaaaaagaaaaaagagaaaaaggaaaaagaaaaaagaaaagaaaagaaaagaaaaaaatgaggttctggaacatcgaagttcaggctaatcacttaaggcaaaggtacaaggatccaaaaaagaaaaagaaattatgaaatatgatatgattcagtttggggaaactgaaaatctatgtatcccatattttagtaactgaataaattggaatcatacatgtattcttttctaagttgaattattaccaaatttgagattcagtgtttagattatttactgcttgcttaaaacttttatttttcaaattatcagagtatttttcaagcattaagaaagttcaataaaaaggcaatagaaatatcaagtaattccaccatacagagataactcctctttacatttgaatgtattctcttacatcattatcgaatactttcatttttatatttgggattgttttaggtatatatatttatttgtatcttttggaccaggaatttttagttgtgttattttataaacttttcctaataaaatattgtttaaaataactttaagaactatctaatttgcatatatgatatgtggtgatacatatggatattcaataatttaataatttctcgaattttgtaatttaagattttaaaatcttttttctcttttataaatgacattgtgataaacacctctgtacctaaatctttgtctgagattctatttcctctagacagatgcctagaagtaaaattaatgggtcagaggacatatttttaaagcaaggttctggataacataatgctacattactttgcagaattttgtgtcaatatatagatatccactatcactatgagtgtctatttcactgtaccattaccagcactgaaaattactatttttcataaatcatgactttgaatcctagtgaattatactttttcatgtttattagatatttgtatttcctttcataatttttctctttatattctttttagccattctatttgactgaacatatatctcaatatcttcatatctgttgcttcaacttcatttctgattgtaacaccatagtctgagctctccttaccttgctctgaatgatggcatcatgtctgcctggtctgtattccaggtttctttgattctgatttattctgcacactgatgccgaacagttattttgaaaatatgctttcatcatgtcagtcctgatcaagaacctatgacagctcctggttatttatctatcagctacattcaactgcctcattcaggggaaaattcatcccattcttggatattcccttatgagttctgttgaataatttaggttattgctatatggaccctatatgcacttacgtttttataagtgggtatttctatataaagacagggagacacaatgtggagtactagaatacaagaactggaaagggctttaaagtacatcaaaaccaactgtctacatttataaataaaaaaaagtggcctacagagtttaatgaactacccatggtcatggagccaattaaatgacagaactaggactagaaactaagttgcattattctcttttagtgacttttagatagagaataataaaagtcatttttacaatttaaaaaatagaaacagctaggaaggcagtttaatttcaatctgttgttatgtataaaagattgttaaaatcatgccacatagaaggcttgagtgttcttttaacatgaataatatgtacttcttataaatcaatcaaatgtatcattagaatttccataaaatttgcacatctgcaaatgacctagtttatttatactttgctttttcccttgctaatctatattgttttatttaatctgctttgccacaataaaagcacagtattttttatcctagcatattgcagattttcactaagtttcttaatcatatcaataaaaaatccaattttcccagcaaattcatataaaagatttcttttgactatagttagggatttgaagaactacctttaaaaaataaaaaaaaaaaaaataggaactacttcaaaatgcctctatttaaatagtaaacaacacgaactattgtggaagaatgtgggctgtcatccatttaatatgatatgatgattgctatatatattcaagaatcccactgtatttgccaaatgaaaacttaacggtagtcactggtttagaaacgagagttaccaaatatatttattatttgtggaagaggggtagggcataagaggtaaatgtggaaatagccatgaatggacctaactttgatagaagctcactgatttcaaagggctgattaacaaagcatgtgtttgcctaacaaaataattgacagaaaaggtatttattaaatcataaggtgattcaactgtttataaaatacaaggtttaaacaaaatggtagttcatcagcagcaatgagagctcagctatgttttctttctccgtgtgtgcatgtgtgtaaccaaacaggtccaccattcacttaacactcaaccaatatttattaagcacctactttgtgctagaaaccctctactatccaaaataagtaaccctgttattttgttacagaatactcgactactctggactgctgtaaaataaaaattaataataatttagccgggcgtggtggctcacgcctgtaatcccagcactttgggaggccaaggcgggcagatcatgaggtcaggagatcgagaccatcctggctaacacagtgaaaccccgtctctactaaaaatacaaaaagaaattagccaggcgtggtggcgggcgcctgtagtcccagctactcgggaggctgaggcaggagaacggcgtgaacccgggaggcggagcttgcagtgagtcgagatcgcgccgctgcactccagcctgggtgacagagcaagactccgtctcaaaaaaaaaaaaaaaaaaaaaaaaaaaaaaaaaaaaaaaaaaaaaaatgtatacctgatataaggtgttataacaaaaataataaattgagtgataagaggagacagatgaaacagcatcctaaatttctcatttcatgtaggatactacttcattaatgacaataattaaacaggcttgaatgtttttcagaaaaacaacagtgattattaccgaaagaataaactgtactttaaaacttcaaattgctagattgataaaagctaaaaaggtaatcacacatcaaaaaagacagagagtgagagtgagaaagtgagtgagaatagaccaagcaagcataaaaacatagaaaatataaaaaagatttatgagatagtactagatatattttttataaaacgaatattagttaatttaattaacattaaaaataataaccataataatgttaaaagataacaaaacataatttaaccataggatagcagtttaaggacactagctttggtagcaaaaacaggattcaaatattatttctgctatttacttgttataatctctttcctactggtgtatttatttagactatttacctcaactttctgctctaaaaaatggaaataagaataactgaacgtagaaaggattgggaaaaaataatatgtaatgcttagtgaccagcacaactaaacattcaataactgtaatttgtaatattatgtgttttaaatgatgtatctaactatgtacccatataaatttaaaaaaaaagaaaaaaatagaaaaatggtgctgatagattttctcaatgcagagttgccacaagccttcagtttgtgaaaaactcaatatctgcgaagtgcaataaagcaaagcacaataaaaataatataaaaaacataataaagagagataagaatcaaaggagtattgtccaagatgtattgttaccttaaaaattccgtgaaatataaaatgtgaaaatcacagaaacacagtcagacttaaaaagaagatgattagttacagaaagctactaaaagcagcccatggtgctgaagccataggcctgctgaaatctggatctagaatcacatcgagatacctagaattccagctctttagagtaatgaggtcaaagaggctccatttgaaatggtggacctgaacctggcttactactttatcacgaggctacaaaaatttggccaactactgcctggggaaacagcttatatagggctgcaggacctgagagctggaagaataaagatacagcattatgataaaatattcatataagaatgaagctgaaagctaccattgtaagatctggattgggactgagaagatccagataaaggcaactgtaaaacccctagttagggacatgtgaacaaaacgaaacaaacaaaacaaaacctgtaaaacaaaattctaaagcataaccaagtaatggtaagaaaatcaataattgtaacattcactccagataaatttgattttatgaaattatctgacaatgacctcagcatgaatatgcttgagatgcttagtgataaagtactcatacctaaaaaagaacaagaaatgattaaagatagaaataaaataagaataggtgaataagagtaaaacttaatcagaaatcttaaaaaattaaaaatgttcattaatataaaagtacaataaatgaaataaaggaatttcaaggaaagaattgagtgtattggaaggtaatgttaaggaattcactcagaaaaaaattgtagcaagaagaattaattttttgaaaatgaaatagcaattgagatactaatcagtaagctgattagaaaataccaatgtttatcttataagaattccagaaaaagaaaatggaagtaatgacaaaggaacaataaagaaaaggataatagctgagaattttccaaaactggagtcctgagattaataagtatatcctgagttcatgactaataattcaaaataaatccacgtccagacacatttcagagaaactacaagatatttaggatatagaataacttttaaaagctaccaggagaaaaagcagattatttataaagagataaaaacagattgatagatttctcttaattaagaatagttgacagaacaatagtctaagatataattgagtaatgtctttaaaatactcaacaaaaaatacccagataaattgctatttaagataaaaaacaaaataagtacatttttagttatatgaaatatatgtattacccaaggtcctcattaaataattactaaaaaaaagtaacaagaaaagtgcacccagaaaggaagccacaggatctaagaataatggtaggcatagtaatatctaaaaatattagtaaatataattaagcattgattatagacaacagtgatcaccacttttgaatatggttaaaaacaaataggtaaaactaaaacttcatacacaattatagtaacaagattgatacttaataggtaattaaaagatgctatgttaaccaccttttttatactaagaagaaggtcagaaatactaaaaggtcgattttatattttcttagaaaaatacacagttcagtatacacaaaagaattttagaattagtgctaaagaaacagataaaccacctacagatttcaagccagaagtaaaatccatgtaccagataaaatcacaaaataagctaaaaaaagtttttcaattaaaaccacataaaacacatcattttattttaatgcgtttaaattcagaaataaataataaaaatagagcaaatatgtttacaaagtaaaagcatacccttctaaatacctcaagggctaaaaataaaacagatattatgaaatatttaaaattgaacaaaactacgtatcaaaacatggtatgcacctaatgagaaaccaggagaaaaatttagagtctgaaattcatttttaaagataataaaaattattgaaagtaaaagggtaataattcaattcaagaatctagaaaaagaaaaatggcctaaaaatataaaaaaaaagaaggaatgaaataacgctaatgctgataaaagcagaaagtaatgatttagactacaaataaataataaagtagataagcagaatcaaaagccagtttttgtaaagaagtaaatgaaacagaaaaatgtctagtgtctaataaaaaaaagcagaagggtcaaataaatattaggaataagaggggaacataaggacaaaaaattaaaaatcataagaatatataaataactttgtacaaataaattgaagtataaactgtgaactgtatttaaaaaaaataacttcccaaaattgactagagaagaatcagaaatttcctctgtggttattggtttattctgatattcaagtctgcctacctacaacctactgatgaaaattaccaagttcagatgacaaatactcagaataaaaaatcccaataatgtgaaaactgtttaagatatagaaaaaaatgaaatgttactcagcttattttgtgaggccagtattgtcacagcaaaactctatagtaacagttaagaaaataaaatttaaagattgatctccccatgtaaacatactacatgtcagtaaattaaactcaatagtagattaaaaaatacaccaagagcaagaatattttttccaagaatataagaactgtttaatatcaggaaatgtattaatatcttataaaatattaacatagtagtggaaaattttatcatattattgatgcagaaaatgcattagataaaatttaactagtatttctgattaaaaacacttagtaaactataaatagtttaggaacatattaagaacttccttaatacaataatttcgatttctcaaaatcccaagcaaatgttatgtttctaaaacatttccattaaaataagaaacagaatagatattcttaatgtgactatcctattcacactatactgaggtttagtaatgcaatatgacaggaaaaaattgaacatttaagaattagaatttaagagaatgactgtcattatttactgctgacatacatgttgctgtagaaaacttaagagaatttaccagtttagttattcaaagtagtaagagagctcagcaaagttgctgaatatataacaataataaccaataaacaatgaaatggaaaacagatatgaatataataatgtaagaatctaagttatatgaggaacaattttacaaaataggttcaagaaatttatgatggaaattttaaaacatgattataggatatgaagatgatcacaaatagagggatatagtatgtcactgggcagcaagacacattataaaaatgtcaattctccccagattattttctaatgttaatgtaattacaaataaaattcagcaagacttttgccaaacttgaccaactagccctaaaactcatattgaatagcaaaagaccaagggagctaaaagaatcttaaaaaggaacaaggtagagagacttatcttaccaagtaaaaagaatattataaagctatggtaattaagggttatggtgttagtacaaggatagaaaaacagtccatcggatcaaataaagatcatataaacagatttgatataggcaaaagatggcattataaattagttaataaagaatgactaattttttaaataatgctgggataactgggttatccatatggaaaaagaataaaatagggtgcatgtagggtaccagaaccaaaaataattccagaaggattagagatctaaatgtaaatgggaaatctttaaaactgttagaagaaaatacagaaaggtaaatgaccttggcatgtgaaaggatttcttaaatgacataaaagcacaaattatgaaggaaaatatcaataagcctagttgagttaatattaaaagctttataaaaacaaatactactaaagccacagttaaaagggcacctacaaattgggaaaaaatctttgtaatctctatggcccaaaatatgaaaatccagaatattacaacaacagcaacaactaataccaaaaaccaaatcaagccaaacaaaactcttccaaaataacaacagcacaacaaataacccaacagaaagatggacaaaagatgcaaattaggcaacacagaagagaaaatcccaatggcttacaactaaaaaaaaaaaaaaagttaatgagatattattcaattccgatcagactgacaaaaattttaaaaagtctgaccatcacaaatgttgtgaagcatgtggagaagctctcatagattgttactgagaatataaattggtacaaatacattggagggaggttttacaatacctagtaaagttcaaaatgcatatttcttaaagtttagcatttctacttctatgtatatatgtctataaaaatgttaactgtggtcttgtttgtgattgggaaacaattaaaataatgtccaacaatgagagaattgataaataaattttagtaatacatacagaagaatacatttcatataaaccaaaatatatagcttatgtaaaactaattcatgatgatagaggttacagtggttttgcttgttctttaccttttgttaaaactttggaaaatttcaccttcaaggggcacatacaaaggattcttcttaggtattataaatattctgcaccttgggttgggtgttgtcacatgtatactcatcaaggtatacacttaatttgtctaattcactgtatgtaacctataataaaataataaaaaataggttcagaaacaaatgttccaaattattaaacttcgtttaacctgggttctggattcttgtatttcatattatcctttatacttccatgtgttttaatttttttttttttttaaagacagagtctcactctgtccaccaggctggagtgcaatggtgccatctcagcccactacaacctccgcctcctgggtacaagcaattctcctgcctcagcctcccgagtagcttacaggcacgtgccatcatgcctggctaatttttgtatttttagtagagacagggttctgccatgttggccaggctggtctcgaactcctaacctcaagtgatctgcccactttggcctcctaaagtgccgggattataggcgtgagccaccatgcccagcctgtgttttaaatattttacattagaaaatgtataaggcaaacaccatagattttcctaactagaattaatcgaggtaaaggaaagcactagtgtcatcttctcttcactatctctgataatagagcccaatattagtaagcacttcacagccaaacatgcctacaaagtgattattttgttgaatcaaaagcaaaagttttcattcacttcttgactgactatagaatctcaggcttccttaagtgagtgaccagagggatatattgttgatatagacagatgctgccaatgcacaaagatcatccatttaggtttttcagttgatgaagtgaggcatgcattgccagactttacttacatgaattaacagaatcaacaggtgatttggtatcagtactgctattggctggcgggtttcacctctggtttcagaaaagaaagagatgataccttttcaatgctgcatttcaagtcaaccatatgaaaagcaaagttttattccagtcacttttctttctctcacattgtggaagaaaagtgccagccactgctactctaaccactaaccatggtacagatgtttgaaaaatgtgaaacagagaaatgaaacaaaaaggaaaccctcaaaaattaagtttcgcataagtgaaaaatacagtatttatgtatcataactgcaaaaagatcaatggacttttttctcatgtattaaacaaaaataaacacaaacattgattttttgacttagtgttttgttgaaaccaacaattacaaggaccaactcaaacatggctaaaagtgggaataaaaataagatttcttttatcctgataaaagattttttatcaccaagaacgttacagtatgacctacttaagtgaatacttattaaagaaacagattcatttaaaaaacatgtttttaggtaaataggaacggtgcaagtgtttctttgaaatcttacaaaagataaaaattaattgaactaactaaggttccttaccctatgcaaataagaaacggcttagaaagaaatgtcttcaaactgttgaaatgtatattccttagttggtgtaaccaatgtgaggtctcagttactataatagcaaatgttctattagatttaagcacatcagtgcaaattattaaaatgagactgtctttgtttaaaataaagctttaaaaaatgtaatgtaatctctgagggagtattgcctgaaatgaaagttttaggccgagctctgccacaatcctattgcgcatcttggttcatctgattaaacatctttgggtctcaaaattcacatacattcacatttctaaagtgagtgtgatataaagtcatagcttgatcatcaaactcctttctagccctaaaattctacgtatctaatgagattaatttatcatgaggtgtttttcttctttcctttgttaatttccttacaataaatagacaaataaatgatcaaataagcaaataaataaatattaaaaagacatacacacactgatagctatccatctgaataggaagaaagacttttttttgtttgccattatctatcccctaatgtgtatttaaaaagagagctcccacagaaaagatttttatttttttctaaatcaaaaatagtgtatcatttatttgccatttaagttctactaagaaggaaaacacaaaatcattatggaaatcctattaggaactttagaaagaaaaagctgatgaaattccatttacaattcaaattgttcattcacgtatttccttttgcagaaactttaaatgctgcctcaaactatcttcacctctttttccagggacaatatccctaactctgttaaaaaaaaaaaaaggctctcttctcacacccttcccacctgtcctctgaggtagttgttccacaaagctaaggtatagattacatcaagagatatttgggatgggagtaaaacatttcaccctggagacagtaatgtgtgcaatttgccaagtctaaaagaaagttaagcctcatcaccactttggcaagaaatgtggttctcatggatggacaatgattatcatttttacacagaacttttgaaaatgaaagtacctggggcaccagccagaaaataagtacgagaatgcaagttttttgcgtcaatatttaaatcagacaaaacactatcagtgtacccttaacagacctgaagcgtctagaaagaatacaaggcagctgacaccttggtgaataagagcagctcagttttatgaaaaggccaaagtcttagggcaaactctctgttgttccaagtgctgatatacctatggcatcaacaaaggcaaaacaccatagggggcaataggcaaggcttctcttacaggcaaggctcctgttaaaggctgggaccctctggactacacactcgaggaaccccaagtgtgggtccctgaggggaggaagtttcctcaaacagaacggcgagaggctgaagttacacagtgtaggagtactccctgctggcagctgaggttggaaatgaactggtgatgtcctagagagggctgcttaaattttctatgaggaggctaatggagataacagtgctcttgaggggacaagagcatgggtctgattaggtttagataactccagatattatgctgagtgaggaggaggttaagggaagctactgatgacaggaactccaacaattgacaaaaactatgtgtagagctggtatatacaattttcatttaagtttcccatctcatatcattctataaagcatacacagccgtatgtgcacatgtgtgtggggttcagaggatgcaggaagaaatctatttctgtgcagttcattttacccctgcaagaacaatctttgaaaccgtctaatgtattcacatttatgttttacaaggaatcccttccatacttctaatggacctgcctggtatgccccctgtaccactatacctaatccctaggcaggtggtctttgtatgggcctggggcaaccacactggtttctccccagtgctctgctctgttagggttcttctgcataataaaatgaaggtcaaaatggcagcctgctaaaagcagcagtatttcagttgcaggaataacttgcttgtcatcaacttgttaatgcaatagtcaaacatttctctgacatgtacagtatcagctaacttcagcagataaagggtctagaacaggaagatgctgcagatgctttagctcggaggaaggcttagcagagccaaaacgtcagcagggcctgtttgttccatactttccatcgggctctgtgaaagaaatgttagattactgcaatgacaagtttgtgacaagcaagtcatttgtgcaactggtgcgctcctgtttttatctgtttaccattcagacttgtgaatgccatttcaagcacttagaggatttctggctcccattaaggggaaatggttcctccatgtttagaattttctacctcaaagagaattactaagcaattatttgttcctgtggtcagtgtcacacaaaagcactcttgagttgtttagctggactctgaatcatgaaatgaagtcctgaagactggatagcttggagcatcaaaaatttcccatctagtttattggaatgactacaaagcaagcctgtgagagacaataaaattatggccagcttgaaataccttgcccttttgctctgggatcatatatcaaggccatatgcttcaagccacataaactcacttgtaacaagtagatcctgagaagctaaggcctggcgatgtcacactgacatgtgatttagcatatgactgttttggtgacaaggaccactttagctgttgagaagagaatttccactgacttctctctataccttgtgggtaactatagggtcaatactaatccagagaacattttaactgtggtaaaataaagtaatataatatcaaattaataactagggccatcctcactaggctgactttttaatagtgaatggagaccctggcagatttgagatcaagaattcaagatcctctcattaggtccttcacctgaagttgctgagtttcttcaagtcattttaacctcctgggacgaaggtagaaaataacagcacatgttcctttccatctgacataaatggtctcagggtcaatattacaaaagatgaagagtgccttcagactcaagaacaagaatgatactctctaaacatcatttattctttctacaattttacatttttgcccattgttggtactgaatttatacataactctaggtataactcccttttttttttttttttttttttttgagatgaagtctcactcttgtcacccaggctggagtgcaatggtgtgatcttggctcacggcaacctccatctcccgggttcaagcgattctcctgcctcagcctcctgagcagctgggactacaggcacccaccaccacacccggctaatttttgtatttttagtagagacggggtttcaccatgttggacaggctggtctcgaactcctgactacaggtgatctgcccacctcggcctctcaaagtgctgggattacaggtgtgagccaccgtgcctggcccaattctaggtataactcttaaagaacataacagaatgaggctttgaagcagacacagatgtacactatctggggaagcaagtcaaagccggaacaggtggaatgtcaaggactagacaaaagtaatgatgtaaagtgaagcagagcttagaaagggctactagagaatgttacagaaagcgataatagtactcattgaataaaaattttattgtgaatgatcctgtgccagacactatgtgtattatacaatttacatgtgtaatttaatcattacaataattctatggcatatgcatgctcaatattttttcagatgtgagaactaaaatgtagggagttaagtacttcacaccataaatatgtaagctgcagagatttgaaaccagttttccattgttccaaagcccatgtactcttaaccatagaagaacgaaagtcatttccactgcctccagaagccttttctctcttgcttactggaaaacatttcagtctggaaatacaggaattcactaatttgatacaaaagggccagtgagaagattctagctctatctgtattgccatccttgttaggcctctgagaaagctgagtttcatcaagatgtcattcctttctccaggcctgacctattcctactttaatgcactggggaagaggtaagtgattctaacctaatcacatatctccgtgctatgaatggagggtgtttggcggcatctccttgtgtccatgacaattcctttctctctcttcatgtgtatagcctttagttcatcctactctttgctcccatattacttccagggggccttcttttgtcacttgtctgctattctgttttaggtgggggaaggggcggacagctttcttaccatgacaaggatcactgaaacagtctcaacttcaaactttgcacagaatgtatcctttgttcggtcttctgctttgtttctctttaatgatagctttgccatgagtcccattcgtatgtaactcagagctatgcaaatcaagctggtaagcaagcatttgcagttactcagtcttaaaatgaatatgtgtccaaccagtggaaacctgagtgaggaatgtctcctgaacattatgtgtggaatggctcctttccttgatgggtggcaaataataaactcagtgagatctgcattatattccctggtctcttttagtgtatgctcagagtgggtcacaagagtggttttagcttatgtaaaattttttcttatagtatttccaattttttttaacttcttgatgtctcccaaacacagaattcttaatagctactgaaaaatccccatgcctgaagaatcctaagatcccagggcaaaaatatggtaaagaacattaaacaacccatggtctgggtcttaatctggtgctcacagtgatcattcagtctctgctgcataccaccagggcacggaactctccactgtaggatacttctttctgttctgttcttccttatgctgaatcttaatccatattagtctgttctcatgctgctatgaagaaatacccaagactgggtaatttataaagaaaagaagtttatatgactcagtttcgcatggctggggaagcctcaggaaacttacaatcatagcagaaggcacctcttcaccgggcaacaggagagagaatgagtgctgagcaaagggggaaaagccccttataaaaccatcagatctcatgagaactcactcaccatcacgagaaaatcatgggagtaactgcttccatgattcaattacttctcaccaggtccctcccacgacacatgaagattatgggaactacaattcaagatgagatttgggtgaggacacagccaaaccatatcataatctatctttctaaaatccccccagtgcgtctagttctttctcaccctaaatttcagttcagagcttcagaaaattattagtttaatgactcatttaatgacaacccttgtgtgtattacataccaacaactgggtttagattgtcctgccttgtccctttctcctcacccaacatgatttaaattcccactctatccctctgacaagccggggagaaataaaagccagtcacacccatttctcatttccatttggatgcaggtagtactggtggcaaagcattcttaatctctttgattttctgtcctattctgtggaaaatctttcctgacaacctcaggcatctttgattgatatggctatttatagattgaccatttaatttattgtccaagcagggacacttttgacagtgaaagggccttataaataattataccaagactacagacttaaacaagaactttcccaggcaaacttacataacaccttgcatatacttttacttcaatacccatctttttgcataaaaactttcatgtctatttttcccaccaacctgtgaacactctttagcaacagaaacatatttttacctatgcagcttcagttcctagaaaagtgcttgtaagtataaagacctgggggtaaatatgtactgacgcacatgcatatgcctatatgcatgtgtatgtgtttgaattgatggtatatttttccataattacattctgtggacctctccccttatttcatagcaaataccaccaacacatgttaacttcatatttttggagatgaatcaaaaatatttcacttaatgccataggaaggaaatggtctgagtatattggtaatgggtttgcttttaatattgacagcaacaaacagaaagtgaaatgtgataaattttccactaaaagtctactgcatatttttttaacaaagcactgaacaataagctttaatcgctttcttcacaagtattataaattgtttcaggccgtgtgcgaaggctcacgcttgtaatcccagcattttgggagggcgaggcgggcggatcacctgaggtcaggagtttgagaccaagaacggccaacatggtgaaaccccgtctctactaaaaatacaaaaattagccagtcatgatggtgggcacctgttatcccagcaggaggctgaggcaagtgaatcgcttgaacttgggaggcggaggttgcagtgaagctgagatggtgccactgcactccagcctgcagcctgggcgaaagactgagactccgtctcaaaaaataaaaataaataaataaatttatttattaatttatttaataaaaaataaaaataaataaaaaataaacaaaaataaaaataaataaataaataaaaatttcagcagctgtatccacaatttcaagtttgtagtaaatgagttattataggaaatgatggtaatttaagagtgatcctttaatctccattaaaatgttggtggcatttctattgctttcaccctcgtcaagcacatttggaagtcctggtaacttttggcagtttttttgcttctgagtaactgtggctttaagaaaaagaaaggtaaggagaaagtgcctggaaaatgtgaaccacttagagaagtcatttcttcccttctcgctgacacatgcagaccattccagaaagatatgactctatactggttaaagagcttcatagaggataatctcacaacttccctttcagtgtttagcactcactattaataacctatctcattatcaaaccttaagattttctgttgcagcatattttgtcattatcagacctcagtgaagaaaagagagaaagccttgtttcccacttctcatcacttgcttaacagctactattagcgctctaccttaacattcctttttccaagataaaaaaagtcaatgtttttgactcttccttgagaatttttttccaaaatgttaaatttaaatttgtttggaggggtttgataattctgtctctctaagatgtttgtattcagtattatctgaaatcagaacaagcatgaataagtatgtaatctatgctcataagaaatcagagaaatatctatatttggcatgcttcttatacattccactattatagctattttaaaatttcagtttgacatttcacactcttgataaactttctataatctacttctagatgctatttttcccacagaggaagtcattctttattttcagtccatcaatgacatttaccaaaccatcacggataatgaaaaatataagacttataagattcaaaagaaacaaagttacatgtctattatttcagagtcttaaatatgtggaaaaaagaagacaatcccacacaaaagaagaaacatggataagcatgctcaggtgtttggtgctagctcaccagctattagtataggtgaactaatacagctatatggaattctctatacaagtgatgaagaagtagtggatgaaatgccacttttgaggtctgctttctctcctgaagaaaactaacaataacttttatttaacaacgttttgtttattcccagttttactgagtgttcatttcagtcctccctctgaagtggttagttatacttatctctcaaattgttgttatttggacactgtacgtaaaagcattgcactttgaaagcatgcatttcttgtcctcaacatctaaaataatgatttgcaaccatttagaagttctggtatcctgttgttaatgtgatttttgcatcactcttccttgcctattccttaaaatataattttaaatgaaaattaatttcattttgaggttttgaaatgcctctaacaataatttagaatacactgaatttgccaatattggaaaacatgtatgtagtctagattatcaagccagaatccaggaccgacctcaatagcatgtcacttctatatctctcaatactgagtctcatctcctactaatcatttcctgagaattctgaagtgctggccacaaaataaataggttagaattttttattttttggtcatttgagacagaattaaaggctctgctggttacgtggagttatatcataatactagctttgccttagttcagcaaaacttacattgggctaagaaagaagataatatattatcaaggcgttgtgtcctggtatcatcaaacgatgggcaaatcgatttcattaggtctctcctaggatatttcgtggaataaaagttagagttctatgtctataacttgcaggatagaattattaaaaatggttgtatttaagtgcattttcccaaatagtgagtttccttttggcagaaaagagacaatgaaggtaaatgtgaaagtatcatcaaccacaaactagtaagctgaactcaagtataatggcaatcttcctgggtgatcagccatagagcaccatttgtgcaagagtctgaatttctatactaacttacttttaaatttcgttgaatacaaacataacaatgtttttaataagtggcttatctattaagtttatagagaaccttccactaaagagattacttattctaatctattcttttgtccaatcttttccccatttttgcccagtgttttgtttatataatattttattctataaaaatctatattatacattttctacctgccttgtctattcttatacattcacaatctattctactcttagtatataatttgaacagattcacatacataaatcaacattcattacttctgggcatataaatggttgctgggtccatgacggctgtttaaataggtagcttccaggccactatgacatagggaaaaactgaaaagtgtatgttttataattattgagtaaaagaggattttcattatggagacatgtacagctatctcaaaggcttatttttccaaaaggaacaacgacactgtcccctgggatatgtgaattgaaaattcagtgtcaacctcttctaaaaaagtagatattttgaggtattaaaaagcgttcttttattagtgataacacctcttacttggggtcgttttgagatgaaagttggcaagtagatttttcaataaggcggggtgggaatcactataaattcataaactaaaaagaagaatgacaatttattggcccaaaaataggggagagggagagatttttttgttcttttttcttttctttttttttttttttttgagacggagtgtcgctcttgtggcccaggctggagtgcaatggcgtgatctcggctcaccgcaatctctgcctctggggtttaagcgattctcttgcctcagcctcctgagtagctgggattacaggcatgcgccaccacacatggctaattttgtatttttagtagagacagggtttgtccacgttggtcaggctggtctcgatctctcgacctctggtgatccacccaccttggcctcccaaagtgctgggattacaggtgtgagccactgcgcctggcctaggagattttggaataaaggtgtctctgtgactaaaaacatataactggtcatagatagtctgtttacctctagtgtcttttggagcaagggtgtgggtctctctgttgagtggtgcctatcattaggcatcacagcaacatcaacaaaactcatctccgtaatatagtagattttacattgtgttaaggtagaccttttaaacaactccttcaagttttctgttgatttcctgccagacagtcagacagctacttcttttttagtaggagtagtcaaggctaaagtcaatacatgtgccttccttgctgagttagaatcaggcatattccatcaacacatatgtcccactgttctcatttctctcactttactatgtgattagtagacaaagtatatactaaagaaagctgaggaagttgctaggatttctaaagaagaagaatccaaatcttgcctactttaggcaaaaaacattttagtattaattgaaaagagatggttaaattgcaacccataaattaaaatgtagttccaaagtgtgtctatagtgatctacaagcaaacataatttctcatattctttttttttttttttttttgagatagagtcttgctctgtcaccaggctggagtgcagtggtgcgatctcagctcactgcaacctccgccgcccgggttcaagtgattcccctgcctcagcctcccatgtagctgggattacaggcacatgtcactacaccgggctaattttttgtattttagtagagacggggtttcactatgttggccaagatggtctcgatctcctgaccttgtgatccgcccacctcggcctcccaatatattattaaaatatattctgcaggctaattctatgttcttatctcattcctgtttcttcctctgctccagaaaggattagtgtctagcataaaacaaacagtatataataaagaacagataatgtatagtcataaaattctgaatccacagcaaaaagagggtaaggtcttagtctagcaggtaagtcttattgacaataataaaggcatgtttctaagccacccatggaaaataccaaaaatgttctctattatatcttgaggtgaagttttggccgtgtaaaaaattatggttaatgctgtgtatgttatgttttatttgccttcattctgggaccacaaaaacggatctaactatagataggggcaggagagcatttgtgtttcttcattagaagctgtgcatgttagtctaatgtataagaattaggaaaacaatactaaatctcttgatgcaggccatgtcataaatccatttatacttatataatattttcctttttcttattctttcaaccttcatgcttcttttttcatttaaaaaactttggggtcagcccttatattaccagatgatttctagtagttgaagcccttgggaaattcatttgtccatccatgctgcctagtttagtacaacactccaaagggaacttccttctaccaaaggcaatgactgattggacttaaaaaataacttctataaatatgacataatatctggaggccacatttatagctggtcaaatgcactgttagccctacaaaaggctggctcataattatgaggcaataacatgtaaatttccctttctgatgagaaactaaaggtcacataggtcctgagttgtattaagactgcattaatactgttcgttagacatttcttttctcagtctcaacaagtcaccttaaaatctatggtatatagcagatcctgagcacctacatgaaaagcaagtactcaaatgttagagacctgaattgaaatcaagattgagatccatccaacttaggagttactgctggttcaatgagtccagggaagaggccatttaatgattcctccaaggaccattaagagttccagggtattcccttggatatctggaaacctgggttacttgatctgagcatgactaaaaactgggcaaagtcttgcatgcttatcctaggttggacacagatctctaagataagactggtatttggtaagctctcatctttcccattccttcctttagagttcatattcctgatgtattcttgtcacaagatacggtcaaggttacacatgggttaagagctcacagcagtccaataacaaacatgttgctgtaatactggtctcccttgtagaccttgaaagtccaatatgctatcatctagggcagttcatgggaaagttgacataataatgcttcaattattcaatttataaatgggacatttaactgatagagtagggaggacaactgagaaacgtttgaagatgtaaatagtttttgtttcagagaacaaccttatctctccaacacagtaatattttttctttgtgtagccaaatttctctaacacgaggctcacacagaagctatagagacttcacctagaaggtctcaatggccttagagccatatatatatttctactataaaacagcaacaacaattttggcccaaatatcataacctaagcaaaaatacaaacaaaatcaaacaaacgaaaactacctagaatataatcttaaaaagtactgcctatatgccatcaccatgtatactataaaacccaccaaacttagaatgcacaatgatgtcatttacttcaatttttataatactgctttttgaagattcctatttttatacgtaatgggaaacatgacatcatataaatgaggcaggcaaacagaaaggtgtagaaggcaaatgcaagatgcctatatattgtctaccaagtgttgccagttgtgaaaggatttgacatgctaatatccattcattcactaagagcatgatggctggcaggctctgcatttaagtgcggttatcgaggcccccaaatattgacagagtgccagattctaagaaactattgatgtacacagccggccacagctccagacacctctcagacagagtctttaaatgtcacagataaatgaattttcatgaaactgagagagaggaagagcaagaggagagaaagaacacagaatgagaggcaggaaagaaacaagaaagaagaaaatcacttccataacactgacatgaaagcatgtggcatctcatctctaaagctcaatcataactccttacacaggatgtgagatcaagccttctgaatgcattgcattaccaaagcactcaaacacttttaatcatttcattgcatggtattttaaaagttaagggagatacatgttacagaatagcttcaacaaactatttctgagcaaaatacagttcaaatataaatacttcccgactcaatcctaaagcaaattaaaaaaatatatatatatataaaggcccacaggcacagataagcattggagccttctaagcagttctccatatgcataaaaggtgaaaagtcaaggtgtcatgaaatctattttatgccaagacacaaatgtgtcctctgacattttcttctccacagtcctactgaaagtagtgacccctagtgggtttattgcacgatattaagggatgccttcttccttcacctctcttttcctgcctttccacagaaaacatctgccaggaaaatatacgagtcagttacttgacacatgataacaaaagtgagccatggttataactagaacgaccaagtattccttagaaatcatgtgtaactcaatatattttaaacgtaaaggaagcttttttactttgaaagttttccatctgctgagggcagcttctcttgaccttgatacactgtgccattgaaagcagtcacactttcaaggttagaatatggcttgtttgtgcatttactgttctatactagagttgtacaatctccacgttttacataaagcgatcatgccaaggcacacaaacaaaattcttcttccaattcaaaagcacatgggtaagttttctgttttggtttttaacctgcagcaacatggtttcacaaagccctagctgcctttttactagcatcacaaaaagccttggtgtaagttatttttctacatctggctctctctgttttggatacatgggactttagcaggtatatacttggagaataaagttccatagctcaaatattcaatagaggttttgtttttgcatcaacttttcagtaatttcttagtacttttcttttttatgttaggagataaaatgaaaggatttagatttcctgccatgggaaaaataattattttccctgtctttaaaggcttttattttgaagacaaaatcagttttaactcaaatggaaattgcagtaaaatctcagacactgtaatcagtgactgcattaaaactctcaagaaggaagccaacttccatgtgaggccacaattcagccaggatcacaaagagacattatccactttgcctgtggccattctgtcattttagactgtaaaatttttatactgtaaaattaaggttcaaggaaatcttctctaactttcacatacatacacataaatatactgatttttgcctgtaaccatataataagcagagaggttttggcttactttagacataggtatagaagacacttaataaagattattaaaatttccttcattatataagtaatagtgttcaccaaatattcagtgattggttaacacaaactgtgttatacaccctacagaaaatactgtaaagttgctaaaaaaaaaaatagacttaaatgtgctatatgacaggatatgacattatatatgctcaatccctcttgtataaagaaaattagtatacatatatacacatatttatgatagataggcatatacacaaacattttcttctggaagtatatgtaagatacttttgatgtatttggggaaaataagatggagaattttacttctaattacatatttttctattctgtttgaattcttcaaacatgtttaaaatataatgccaatagggatatccgagtggtaaggttatgaggaatttttttctcttcatttttttatatactggaaaatttaatatatcatatttcaaaacggaagcatcttcaaaataattatgtaatagtaattcatgttagttacaagaaacttgaaaacactaaaaaagcatgaagtatatcaacaaacagccttgtaattctctgacccaacaataaccactgtcgaatttttgctgcgttgtgtccagtttgcaaagtctcttctgctttgtacagtgtaagtaagaaagatcctttacattcccttaacggggggggacccaaaacagctttatgtgtcatttgttctgctatataccttcttagacaccttcaccaccacaccgtttttagttgccaggacattgttgaaatagcatgctatatgtgacacctccctaaattacacaggttctttattcatctgctattgccccctgaaaaacatgatctctgtgctatttcataatagtacatggcatttcatgatggaagccatggagttgaaggcaacagtggcctcatgctccacaattattatagtatacatactgaaatagtttcgtgaggactcagaaatgttcttctcttctgaatgcacagagatgcttccctgtaaggagctctgtcttagaacttcttcaaagcctaataaagttgaaggaaaaacacagaaaggtgatatacttggtgtgatattttaagcaactgacctattaattataataccttttgatattttctttgctgaggatcattttctgaagaagggtatgaaccttctctttcatgcaaaataccttggtataactgttcatcttttaagtatcttatttgccttttggcaaattaaagaattttcctacctttgttgttgctgttattgaaaagaagataataatgacaataataatttttatagctaactcttattggttgctttctataggttgggcagtttacttacattatttgcatttaattccaaaaatacctctattattattgttgctgttattcccattttatagatgagaaaacccaggcatagaaatgttgaaaaacttgcccaatgtcacaaatctactaagaagtagacgaagaaatctacatcagactcattccaaatcttccttaagattattatctagattagggttacatgactgtactaagaggtccaaaccatgtccagagctttcttatttttctaatactatggggggtgaaggggagtgggaagagaaagagagcgagcgagcacataagattccaaataaaatgttataaaatttatctaagacttcattttcctcacctctaaaatggacagcacccatcacagaggtttatcttgaggaccagttgagataatataagtgaaagcatctagtacaactaaaataaaacaccattattgctctacaagtttccttcctttgcataatggatatgttctggataaggtgattatgaaaaggtataggcttaacttctgttgtcaaatcaaagagcaattacactataaaatctcagagaaggattcccaacagattgagatgaagacctgatgtaaggcaggggttcaggtggaggctgggtctacagatttactgggagcactctgtgggttggtaacacattctagatcctcttacctctctctcctcaggctccttggtctgaaaattcctgagtgtactacagcagtttccagagatgattgctttctttttcttttatctggttacaaagtctagtggaatttatttgcaatgatgatacttcacttgaaggccttatcccacacattatgatataaaatagttagaaattcctttaatgtgagattctcaatcagataaattcactgtgctctatttactctggatgtttggttacaggtttccatcatattattaataatacttgcattaacttcctcatattcattacattgaaaggctctgagttagaaaatatgtattctactttcttggaaaccctacactcactagtgaggcctataaataaaatgaaactttaaatagtacgaacttcaccttcaactcataactaaacccaactctgggcttaaagtgctattttctccctccagtctcatcagatataagtatatcatgttactaactgaggccaagctatatatttacacaattcacttcatactaacaacctgctgcattttgttgcttgccttttcttgaggtactgggacttactcttaaattaatgccttagtttttttttttttctctagggacatccttttacttatggaaaatattcagaaagaatggaatttttaaaataagccatctgctgcgcagacctcaagaaaaacagttatgtttgaaaataccagattcaactaatgaggggcacaaaagccttattaactgtgttagctttcttatctttagagctcaggtaggaagtaagagccgacctcagcatgccaacaggtatcaagtgagagaggtcagcacagtctacacccttatgatatagcttgaacacatcagctcagaagtactcttcataaattctaaaaagagaccttcttccagattatctcgcacatggcagcagcctgggagtccttaagacaaaactctctagttctagaacaattcaaacaaggtgcatttacattatatttaatattttgctgtaagcagacgatagaatctactcaaaactatctctatttcactgtttgcccatattcccatatccgtcctttatttctcagcttatatctttcttgaatttctaaagataagaaatctaatttattcatgtattcattatacaataaatattaagtatctcagaaaagggcaaataaatagatgatagatgattaatagatagctaaatatatagacagataatagataaatagctagataaaacagagatgagttatggcctaaagaaatggctaaggaagaagattgcatattgaggatgttttaaactaggtattgaaggatacttgggatttcaaagtatagagagcaaggagaaatcatttcgagcagaataaactgcatgaacaaaaaggtcatcacacgttgggaaaagcagattatttggtttgtgaaagagagtagtaaaaataaaactgagaaggtaaattagggttagatcacatgagagttcgagtgccaaccaaggaatattactctgtcaataatctaggtttgaggaaagcacagtcaacaactctctagctttcataatttaagtaatgagtattataatccaccaaacctctggtctttaggctccacaggggatacgttagatcagtggtagagaaaaggtcctcatatttaatgagtcctcctccagctgagattatcatgctgcatctattgaagttaatcatctcacatgatttgaacaagaatctcactagttcctaatcacactagcattggcccttcattctcaataacaagttctatagagttacctaaaggctgacactgaggctggctgagatgagagcggtgagtatcccaagcacatgtgagatgtctgtagaaagtttgacataagctgtcatttgattttgaataaagccaaattgttcataagtgattggttacttatatatgtctagttcaggttctccctatgatacagaaagtcattatagtatacgtggaactctgagatctccttacacatcttttaaggctcactcctaactgtttaggattctttgatagaaggtgtttcccagcaccttctgttatgctccctctttattgttctctagtggacttactgacttctgatatgctttgtttttatgtatgtatttgtttactttctgcctctcctctccaaatgttaggtctttgaaaacaaggattatttgaatgtgcctgttttgctcactgttgtatctccagcatgtagaagagatacctattgaaagactgcttttgaaactgaagacaaaatatagaggaaggtaagcacatattaactggtatatgggggaaaaaaggcttctgtataaaactccccccaaaaactcatatgctatataatttgaaaatatcatcagctaattatgtcacggacgaattttctataaaactcaaagcacttttaaattaaaagtatgtattttttcttcctgttactgaagtaacaatctcattctctctattttatacaaagggaaatcatggcagagagagagatactctggagtacagcagatgaattcagagcttctgactctaagggccatctatattctatgcactatttaatgttagtttatattttactaccagtgagatttaagtgctgaattgaatagagtcctagaatttgtaccaataaataatgttattaacttatgctctttctgctagcacatggccttctcacagatataagcaaacaaataaataaagagcaacacagaaagaggaaaggtgaataacttaaaggggtgaacatggttgttcttatttttaaaatccagattgttcattttcgttgtaattgtattgtattctactggcagaaagagatgagatttagtgtactatgcaaattatagtaggtccaccacagcttatcaagttctgagaacagtatggtttctttttcctcagatcctcttttacccttaaaatatcttctggattaaaattctcattcaatgaaccacatctttcaatataaaaaatgaaattataaaagtactaaaagaaaacattagtaaatttctttataatcttggcataagaaaggactttttacctataactcattatctagaagctacatagaaaagattagtaaatctgattatatttacaaacaaacttcagtatggccaaaaaatccataagtaatttttaaaagtgggaaaaacttatgcagctcacatagataaaaggattatcatcttaatgtataaatagcaagaaatacataagagaaagactaacaacccaatagaaagaaaaggctaaggagatgaacagacaccttatggaaaaataaacgctaatgacattaaacatattaaaaaagatggttgacatcacttataattttaaaaatgcaaactaaaactataccgagataccgtcttttaccaatacaattggcaaaaatccaaaagcttaaccaagcactattttatagttgaggcttgggtaaaaaggtacttttatatatgccaatggagctgctaattgatccaactcctgtcgagatcaatttggcaaaacttttcaaaattcaagatgcatataaccctttgatcaataattttatttctgagaatttatcctgcagataaacttgcacatctatgaaatgatttatatataaggttgttcactgtaatattgtttgaaatgaaaaaaattgtttatcaatcgggactgaataaaccatgatgcatttatataatggaatactgcaaaactataaaagagattaaggcagttctctatgtatcaatagcaaaagacctctaagagatactggagaatacaagattgagaacagtgtataaagtggtttaacttttgtgtaagaaggtggaaggagggaatatatattcactttttttgcataaaaagaccactggaaagttacacaaaaaaaataatgaataaaagtggttactaatgggaatagaaagagaaaaaggtggatggggagaagtgaagacgtttttacatagttttgatttttgaaccctggaaatatatagcctgcctcttcaaatatatttaaaatatatgtaaaatatatttaaacaaatatatttaaaaactaaatgaaagataatctcatattaaagtaaaaatgagaacagcatagcaatgataaaaatggttcctgagctccataaatttctcccaacttttagctaccggtgcagccaatatctgggtaaacgtggtaaaaaaaacttggcagtttggtccaaatggcgtctttggagcaaaaaatgattcaggttcttccctttgactttgtagcattcttcagatgttattaaacagttattcctttctaagctcaatcgagttaccagtaaaatataaaatgacattagtgttgcagctgtgaactagttgggatgaatccctttaaaagcctaggatgatttccatgtgttgagtggagaagacctggatgtttgcttgttgctacgtaataagaacaaaacacatttcttgaggaattttaatgtgtaaaattgtttttaaaaataagtaaaatctatttattaattatataatatttatcaatcttctataatacttaggcgatgtactcagtatgcataacattcttaacaggaggcagaatacatcattaggcagatgatgtatgttgagtacttagaagttcctaaaggagaagcctataaagacagtgcattataattaataataaatgtaatagtataatttttttgtaaaataagcaacacatttatccactagtcagaaattatagcttcaattcaataagctgctttctcatgtttgtattgagaatgccatctagaacaatctagaagccacagacaagagcaggggtgaaagctcctaaatttcctatttccgttgtcccatgactttttggtaaaaagataatcagtgaattacccattttgtgtaagaatttcttcctctgggttctgttcttattttaggcaatgattttaaaacatggaggtaggtaagtagggagtattcattcaatcattcatttgtattaattaaacaccaagtatgttctgtgtatttcgctaacattagaaatgcagagacaaaagacataatttttgcccccaaatatttcaatctagtggggagaaaggaaagtaaataaccaactaattataacacagggtgaataacctgctgtaattgacttaagcataaatagctgtgagagaacagaggcgtgggactctgacttttaatgaggaggctcaataacaagttttgaggagtgggtgccttagctgaaacttaaaggatggaagaagttaacaaggcaaagatttgagaggatagaaagggattctaggtataggtaacagaaaaaaaaaagtacagagcaagacagaatatgatccattcatgaactgcaggtggttccagacagaggatagagtgatggttgggaatgccaagaaatgagttttcaggcccatccagattgtgatggaagcactactttagataaggtgataagggaaggcggagatctgaatgaacagaaagagacagccatgaagagcttggtgagaacaacgttcccagcagagaactgtacttattgcacatatatgcctattttaaggaatggttaaagagctaggggaactgattcctggttgtcagagatgagcagcactattccaaatactcttcccctgacaattatctaatctcttttgttgtctctggaagcatggttctttcccatcaatgaattcattcagtccctgtaatcaactctgattagtgttgtttaacatcaatcttttctactttttttcaaagaaagataccaatcagttgctgcacacccctgcttgttaaaagcagcacctctcctgctgacttaccgttcttttaatcaaaagggcaggaggaagcagttgggattcacttttctttttttttctttcaaagtacacaaatgtcaacttccttaaggatgtctggcatagctgagttcagtcatgtaacatacaaagtcagcttgatcaaaaggttgcaggctgcccactgctaaaatggaagagaaaaggaaaccatgggcttccctgaagtgtgaatgagtgcataggccactgccacgtgtgtatttatactgaagacatgctgggctgacaagggagattaggaaacataaatccccaccactacactgctctatcttcacctttgaacctctggagcagcactttctctctttcctatttcttctgttgtgcccagtgaaggagttactatatagctttatagcaactgcaagccatggctatttttgaatatttaaaaaaaacatttttgcggccaggcactgtgcctcactcttgtaatcccagcattttaggaggttgaggcgggtggatcacttgaggtcaggagttcgaggccagccttgctaacatggtgaaactccgtctttactaaaaaaatacaaaaattaactgggcgtggtggtgggcacctgtagtcccagctacttgggaggctgaggcaggagaatagcttgaacccaggaggcacaggttgcagtgagccgagatcacgccactgcactccagcctcagtgacacagtgagactcaatctcaaataaataaataaataaataaatgaataaattcttttgccccaacatttagttgaagtttataattctcaatttgcaatatgaggttataattcacaatatgcaatatgaggttataataatctcaatatgcaatatgaggttataatcatttctatggatttaaaagtgttaataactagaaaaagcataaaactgttcattcattttttttttttttttgagacagagttttgctcttgttgcccaggttggagtgcaatggcatgatctcggctcactgcaacctccgcctcctgggttcaagcgattctcctgcctcaggctcccaaatagctgggattacaggcatgcacccccaacgccgggctaattttgtatttttagtagagacagcgtttctccatgtttgtcaggctggtctcgaactcccgacctcaggtgatccacccgcctcggcctcccaaagtgctgggattacaggtgtgagccatcacgcccagcctcattctcttactcttttaataaatcagtatgtatcatgtgacaaacctgtatctgccaatatgacaaacccttgtcaataattctcctggaagatgcttctggcaacccagaaccagaaaataatttttccaaagagttgattatcttagactaaactaatgactcaagttggttttacaaatagggaacactctgtaaatactcatggacatatctaaacctgaacatacattctcatgaagcacaaaaatcatcatatatggttacagtccccaaacaaggctgcagaagaatttaacattcgtaacaatgtacagctagtataattacattttgtgcaacctcgtaattctttaacagtacaactgaagtgatgagaaggtacatactgatataaggtaacatagctctgtgttctagccaaaactagaactcaggatccattatttttaatctaggaacttttatgtgatgaccatttactaggaagggttgggagtaaaaagcataaggcaattgatatagagaaacaaggatgctttaaaaaaacaaaaacaccagtctaaaagaagactattctttactcacttgaaatggctctgaattcctgggaagagcataggaagaaatgtaactataggatcacttttatatgagtaaattaataaatcatttcccctatgttctctaagaaatcttttagaacaatatttcccaaacttccctaatcataccaattgactagtttcttgtttcagatccaaatgccaaggccccttcgtgaaaatttcttattctctaggtttatggtagactcaggaatgtgcatatttcaagggtgaccctgatgattcttagttcagggatgtttgggaaacactgttctggagaaaactttgtacaatagctaaacatttcttcattcctaatgaatcatcccattttaatgtttctgtggtgtgtcttaagcaggtgcagactctcatagcaaaccataaactcctatgttcctttaaaatagcttaagatacatttactcagttttcaggattagcaaaaagtcaaatagggctgttaactagcccattcccacagaagcaccaacctgtaattcccaagtatcaattctaatgtgttcaaaaataaaagcatatgcttagtcatgtaacagagggtttctttttttacttttatttcattgtctgtcaatctggttgatcagattactaatttctactctactggaagtgatctttagaaaaacaggtctgccatgtttgcattacagagatattaacaataataatgatttttaaaaagtaaaccaaacataaataaacaggaaaagaaaccaccatatttgagtccagtctttgtcctgcctagtgaaacatctgtcttatacctttttgacaggcagaaataagacctttcacatcgcctcatctctctgataaatcagtctatttccttacaaatttggtctgagacaaaactcttctgctcttccacttaccatttagaaaggcacagtcagaaacaccatctaagatgagctcacttctgggtgtctttcagttagacttctattaaatggataacaagaaaactaaccaagaaacaaaaatattcctgtcacttcttttgcaacaattccacaatcttgaggaaaattgaattttgaagaaaagaatggtctatgccatcttacaagcatgagatggaggagcaatgactataaagaatattcgttaattttggttgtactgtagttatattacaaattgcacaattaattcccactatcaaattacactggtaaacaggcctagattaaaaacacaagcctgctctgcttgttttgctctgttatacacaaagtaatcttaaattcagtttattatcattagtatggtttcactttgggggaaaaaaactctttttcctcataaggcatattgcatattgagatgatgaagaccaaagtcaatgctgtagagagttgtagggatataactgctgctaaaataagcacttggtttagtagactatttcccttagacgcttggagcacaataattttttcctgctgggagacaatgtatatcctgaatggggtagggcctgaaagacagtgaaatacagccggaaatacacctgatggcagaatccaccaggatcagacagcatcaggacagcattaaacacagtgtttgaagatagcagaggtatgtggactctcaaggaacactgaaagattacagattgtaggtgagcatggttttgagagtctatctctgctagccacaagaaaattagcagtcaacatttgcaaggtctgtttaattatgtcagtgaccagagctagcctcccaggttaagtgagaacgagaactaacaagctgcccctagcctccttcaggacttaaatgataaagccatggcaatcacagcagcagcagcagcagcaaaagcagcaacagcagcagctgaagcagcaacagcagcagcaagaacatggttttgacccgcagttcttgcccatcaaagagctgtgccctgtctgctcccactgacaggcagataaatacagagatctgttggcaagtacatatttatgtgtatctacagttccctcacacagacttacagagaatgcataacagcttctagtggtataacaaatgcacccactaatggggtgagacccattactcacaaatgggtgaaaagaagcatcaatatgcaggtcttaaccccagtttgtgggcagaaacctgtcattccattgcaggccgataggtctcctattcacacagtccttgtttaattttccaaacaccctttctctaaatggtgctactctgagctgtgtagtgcagacagacaggtttgacaagcagagctgtcaatttcacatttttcatcccaactgcagggcaaaattaggccttgtacgtaactggggttgactggttaggaaggcaggagaggttggcatttaagaggtattttccacattagaaactcagaactcaagatagaaaactcaaaaagggttgtccctattcaacatccatgaaatcaggagagtccaaagatgtgtactggtggtctactgtggggcatatacattttgctgaaacgagaagatgaagggaaaagtaaagcttggtcctatctagaaggagctatgggtaagtaagtagtgaaagacactcactcaaataccataatataaaaatggggcacttgccgtaagagaggaacatagcaacgtgtacacacaattcttggttaaccaagaagttgaatatataagtaatatattagtcaaatttttatccttcaaaaaattttggaattgtccaaagaaaggccaacaggatacatgctaggcaatgatgggtggattaggcatacaacgaaagcaagttaaccagcgctgtttctaacaaccaagtcccagaatatccttgggatctctgggactatctcaagcatataacatgagtctgggatggttttgaaatctctgctagcatatgctctgccctgaggtttctttttggtgctgatttggttgaactgaagaaggaagggagaacacatagaagaagagttctctctattttcaggcggcagtcctatctataccggtggtacagttaagaacctagaatgaatgctcctccagaatcccctgtgcagatcgacactctatggtatatgagatctcacagagtcttgcatatcagaaactcacaaacgggaacacagaagagtctgtgtgtccctgagtttatgctcaagctgtcaaacatcaagagtaatttatgttgttcaggaacatactataacaaagctctcacaggttggaggcttcagtgagcctgagggctcacttcccaacctggacttaccccataaggagcaacggactttgctaacatgaaatcaaaaggcaaaggaaatcaggcatttaggaggtattttacagttacaattacccaatcctaggttggactaggattggggttggtggggaaggagacatggaaagtgctgttaaatgttgtttgaaatgtccctttttgatccccacagtcatgagtgtatttgagtcttgattgctctttacttaaattattgtcattgcccctcagttggcatctctgactaatcccaaccctctcaatctactctgcacactatagccaggttaacttctaaaacatgcctttcattatttttgcttgtctctgtaagtgtttcagttattcagcaaatccttattgcattctaactgtctgatagctattgttctcatcacccacaaaaaataaatctggactctgcctgccttttggaattcacatcctagtcttcaataacatggctctcatttctagtttcactacttcctgtatacaccaactttatttccattggttgatatttttcttcatcctccctacttctctgttttcccatattaaaccattggctaccatctttgcttctttccaaaagaccttttattccattatctttcaacgtccagcttttacatctacagctaaagttctccgtctactattaatcaagccttctatactcctttctaggccaccataatgcagattcttgtagtactcactacctttcgttattgctcatgttggtgcataatggcagattggtaatttccagttagttttaggatctaattactagtctctgcaataagagtataaaaaccataagctctctgtgagcaggtattgtgtttctgatagtaacattattaactgttgtgataactgtgaattaagtttagcatcatacttatttctaaatttaaattgtaccacttctaacaaaattttctccatcgttttattaaaaaaaagtccaaaagaggatgacaataacaggaacacaataaatatatatccacatgtaatggtcagtggtcttttccagtgacaataatgctgcattttgctattagctcctttcttttttacgtgatattcactattagacatactactacactaatgccaacattttccagtaaaaattgacattaattaagctttggatgttgtcagcactagcctagggatagggtaggtttagggccactgagaccaagttcagggtataagatctctgatattcatcaagcagctaagataagaagcataatgaaaggcaaaacaaatggtacaccatatagtatgccgaatatttttaatgctgatttttgtagatagaacttgatatcagcttttactcatttgttattgatatatgtgtattttcttaaaatataataaatatagaaaagggtttgtgaataacataatatgaagatcagaatcaagattagagccaagggcatcagattaaaatgcagatgaataatgaatcacctgtaagattaaagctctaattccaaatggaaagaaagcattggcaaaggcatacaaacatggttctagtgtggtgttcacagttccatgaaggaaaagatgaagcagataggagggtgggcctactgtatggactaggtactggtattaagggttttgtattaggcaagaagacaaaaataattaaaagagtttggactggaagactgggaatgataactggggatagtgaataggatggcctaggtgtacaatgaggtcagcatttagcacatcaggtggccaggactaggacctaaccaagaagctggaaatagaaggaaactccttcattcattatttgaccttacatttttttattgaataatagtagtagactgatctatagacctaaaccagtggatcaacagacctagactagaccatgcttaacagaatttacagtttggagggaaaatagacatgaaagacttaagtaataagatgagagcagccagagacaatgagtaggtaataggagtgaggcccaccaaagaagtgatcatatatcagctacttgaaaccagtggtaaaagtaaactcagtaccaagctcacttcatccaaagcatggattccttatatgttctctgcttgggataatattaagatcaatctgtatgtaaagcttacacagctaggacaagcaaggattcctaggtcgggggagtgtgttcacatatgatggtgtctgtgcatgtaggtttttttcctaacaagtattaaccatgatcctatagcataagagtgagtgatgatgaggaggatgataatggtaatgatgataacagcagctgtttattgagtgcttattatatactaggtattggtttaaatattttacatttattagattacttactccccacagtaattttataataaaaacaaatttatggtcccccacctccttctcctcatccttaatttacagataaagaaactgagtcatgagaattagttttcttaaggttacagtgttgtagaatctacgtagtcttcactcttaaccacactgctctactgcctaaattcaggtaaccaacaaaagagttgccctgcctcatcttggagcttatagatgtctacagaatatattgagaaatatatatgagaaatgatttaaggatattcttaccagagcagtagccattctaaaaattatcacaatggtatattatattgtttagacataaaatgagagtattggggtaacatatatcagagatttggctcttacagattttaatttttaattgtactatttaagggaaaaattgagtattgtgaggagcactggaacaatggaaaaggtaatatggaaagtaaaaagtttagtctcagcctggtaagtgtggctgtctatctcttcaagcttcctttcctcaacggggtgacataagggttaataggatgactgtaaaatgcagttaccttatgaagaatgaaaaatcccattattactgagatttttcaaaccctgataattctgctgggattttctgaaccatgataattctgctgggatctggtattaaacagcatgtagacagattaatcccaagcccagaaaagagcaaacaaataaaacataagtagcataatgactgaagaaagttagattgtagtgtccaatctcatagtggccactttttttgtttgtttgtttgtttgtttgtttgttttgagacggagtcttgctcggtcgcccaggctggagtgtgcagtggtgtgatctcagctcactgcaacctccacctccctcccagtttcaagcgattctcctgccttagcctcccgagtagctgggattataggtgtgtgccaccacatccagctaatttttgtatttttagtagagacgaggtttcatcatgttggctaggctggtcttgaactcctgacctcaggtgatctgcctgcctcgcctcccaaagtgcccaaagtgcttgggattacaggcatgagccaccgcgcccagcctgtagtgcccacttttgacaaagttgattgttcatgtgggagcatgaacatgaaaatttaattacaaactaaggagaaacatacttaactttgaatctttcctattggtttcctggagtcaattttaaagtatcacttaataaatactatttgacaatttgcaaatttatataaatgtattttccttagagtataagcattcaactccaatatgatggtttcctattttcagtttgagtaaatatcaaaatagaatgtccctgttagatatctagggaatcacttttaggggacactatataatgccttactaaataccaagactacagtactattattttcacaagtgagcatgggtcaaggcaaagaagggcaagttggggtaaggatgtataggctgttaaccttgctgcacaggtaaatgtaaaagttccttttttctagcctcaacatgctggaagatcctgactttaaactgagtagagaatgtcttaaagcaaagaaacaagaactcctgtactctgaactttgttggggagttctggccccttttatcatttgatcgtcaatgaataatataactgcgtttagcccttaagcctgtatcagctgcaaacgtgacagatacctgtcatattttagaacagcttatcgcctcagcctctggagtgattgagtatttatagacacaaagatagaaacataaagcacatatgtataggcaggagtcccctggaggtggcgattaggactaggcagtaattttagcttgaagttcctatgacttaaatagccacttgagctctgctcttgcagtttacgatgtcaatagaacccctaaatgaaattacagccttctgatacgcagcaggatatcctttctttgccatgcaatgtacacggccaggagaaattgctctgtatatggagtttcactaaagcagaatttatcataaggctgctctgctaaaatatcattatgctgttattcactggataacacatctaatgactcgaggtgcacttgatagccatgtttcagtgaacacagacgcatgccctgatgtgaactgggcactccagtacttcaaagcactatcgatttcaattctaccataatttacacctggcttgttttgccaatagcttgaacccatgctaacactggaacatacacatacaagctttagaaagatcagaaatgaggtgtatagcaaaaatgaatgcagcaaactctccaggattttgcctttataatcatctcccttgatgccgattaaatattttgcacgattttcctagttaagtttgggcattccctctgttagcattatcctttggttggtgatgatggtaataagaacctcttatatttggacaagctatggacacttctgcagcaggatctgggtgccagtcatcttggttctcccactatctagcacaatgactggcacataatagttgctcatgataatctctgcaggctcctcttcctctctccattccagaaatgcactgtatataaaggaccttctcccttttgtcatctttcaatatatttttcctgagaaatgtccactccataattttaactattaccatgatttggatgattcagatgactgccaaagtctgtccctgacatctccagcattcctgactaaatccaactgccagtctggatgctcccctaacacccccaaattaaacaccttcaaaagtaaatttgtaatcttcccccatcctccaaaatctactcttcctcctcatagcttttcttgcttagttgtataaggcagaaacctgggagcaatccaaaattccttctctccatgcccagcccaaaggttattaaattgtgtcaattttgcctatctcttgaacatatctcctcctctctgtctattcccacagttattgtcctagttcagggcttcattgtttcctgtctgaacaatttcagttgcctcctaactcattttcttgcctctattctcccactcctataatctatcctctaccctgctgacagggtgatcttgtatcacacaatttcatcattaaccttctctacttaaaacctttcaatagctccctgaatgccacaagatgaagttaaaacttctttgcatggcaatcagggtccaacatgattgttccctgcctgcatctacagcatcgtttctctgtactcccctactacacataagtgatagtgttccccagctctgccatgctatttctagttaactgcctttgcccctgctggctcccttactgaatgttcttcctccctctgaccatctgggaaaatccttccattcccagcacggatttatcagctcttctgtgaaacttcctctgatcccccactccaagatatgttcagctgaacactcactgtgcctccatggttccttgaacatccttcagttacggcacttagcataatggtattaccccaacttgtttccctatctgcctctcctctagtgagcaacttgagaccatgttgtattcatctttgtattgtaaatgacaaagccaatgccttcacaacagcatattagggcccatgtgatcagacacccttgtctcccttacttcatctcctactagtctcatgcttacccactcagattctgccacacagacttccttgttgtcactcaaactttccagatacattcatgtccaaggcctttgcacttgatggttccactgttgaaaatgcttttgcttagatatccacaaaacttgcttcttcactttcattgaggtcttttctcaaatgctgtcccccaatgaagacttccctctctacctctccaccctatttaaaattgcaaacttatccctgacacaaacacacatgtatacactctttctcctctttaaattttctccatagcacttatcataaaatgccacatattttacatatatatatatattttatcttctgtctctcctatctagaaagtaactacaaggagaacaaagatttctgtttttttttttctaaatctactgcagtatccccaacccctggaatagtgttgggtacataatatgaattcctcaataaatatttattaataaatgaatcaatctttagcttcttgaataataactgacacagagtagggattcaaaaatgtttctttcctttttttttttttttttggtttgttttttgagacacagtcttgctctgttgcccaggttggagtatagtggtgcaatcatagctcaatgcaagctcaaactcctgggctcaagggataagggatcctcccatctcagcctcctcggtagctgggactacaggcatgtgccatcatgcctggctactttttaaaaattttagtagagatgagatcttgctatgttacccagactggtctcaaactcctgggctcaagggatcctcctgccttggcctttcaaactgctgggattataggtgtgagccactgcatctggcccaaaaatatttcttaaactaaaaaatacatgggtgaatgaatgaattaatgttaaatccatctttaatgaatataatgaagaaacagtctgtgtacagtacagtctgtgtacagtaagttgaatgggttactattatcctcattagacaaatgaaatagatgagtcccagaaaggttaggagccaaaattaaagctactatacatagcttaaacaggtttgctactctttttcaattcactattgaaaggaacagacaattctttgcactttgttcatgatgtacctctgacatttgttatacaattttgcttcctcttgactaggaatgcaattagcaggaggtgcaaggtgctaacactttttattacaatttatgtctttccatattaggtgtttttcataaaaaagatcccctttctttaattttcacaagtggattaggcactcatataattttgcccttcggagtggtttgtacatgactacccaggaggacattgtgttacaaatcctgccagaatgaactggaaggtgagtgcagcattcatagcttaaggatgaacaggttgtttggtgccaggtttgtactaatggagatgttctccattagtgttaactcccaaaggagaataaattcaataacaaaacatttcagtttttggcatttctatggagagttaactttccattgttcaagggttaattatccattatgtgaatcacttttctttctgtggctgcttacatctaggaattcagtttactagagagtgagcagggaaaataaagagacgaaaaggaatattctatatatataaactccaggaaaaaaattggtttaggggacagaatgagatatagtttggggattgctaagttgattgacaattgaaaatgggtaagattaaagcatgttttattatacacaatattttgggttttttttttaaattgtttattagggtcagtttgtagtacatgcagttactctctggatgtgattcttgtcagcacaataccatctagggtgctagaatgggcatttagcaaatggtactttagaggctagctcgacttggtgcccctctcctctgaagaaggcttagtgtgctgcagcttaatgaatgaaacagcactaagtgattccacctatttctctactcattgatgagaaacaactgcagtaggctattttcagctattatttacctcaaacagggcatttaattagtgcttgttaagacagtgcaaatgatttggctgccagtcttcttgcccctgctctttattgtgctgtatgtctgccccgcctctctcctgtctagttcacagggcatccatagccagtcttcatgcctttccataactgacatcagcctgacctccacggatgtggaagtttgaggaaaggaagaacaagtattgacaagctggagggactgttggttaatatgatgcattataggtaagtctggtactttctgactacatgagctgaccaagctggatattcggtcaccctcataagtccaggaaaatgaatggaactactgcaaactgaagatcccatgttccatcagaaattacccaagcattgtggggaaccttagcaatcttagtaaatggttggaaatgctgtcagatagttggaagatctaatgtgggagttaaggaggctcagatatagaagactctgccaatttgtgttctagacatggacatgtttttttcttttcttttctttttttttgagatggagttttgctcttgttgcacaggctggagtgcaatggcacgactttggctcactgcaatctccacctcctaggttctagcgattctcctgcctcagcctcccgagcagctaggattacacgcatgcgccaccatgcccggctaatgttgtatttttagtagagagggggtttcttcatgtttatcaggctggtctcgaactcctgacctcaggtgatccgcccgcctcggcctcccaaagtgctgggattacaggcatgagccactgtgtccggctgtttctttcactatgataagcaagatgtattcactgtcaatgcactgacatgtagatatccattcattcatcacctattcattgatcctccactcagactgagccaatctgacactggttgggagagaaattaacaaacctaaaacacaaaacctgccctctaaccacttgcagtttcatatatagaaaaaacttcaacttaaaagcatatataaatgctaaatgaaggtagatttgtaaaatgctaccagtgtcagatcacttttaatttgggttttatggaaaacttcagagaaaaagtgtgacttgtcaaggatatgatttggctgatcttgaaaagttatcagaaaaattatggttgctgatgctaatatgtaaatacagcatcaaaatatttaacatatagtaaaatagctgagaaactaaaatgggatcatctgtatatgtactcagccttataaaataaaatgaattcattaaacatatgctcaattttaagatatcaattaatttctttctacttaattttaaacttttatatatatagcaattaatattttgaagctgtacataatagaatttaggttgataagctaatatgtatatttgctgaaggataattaccaaacttatcagctaactacatctttctttttgcaaatactgttcataaatatttgtgtaaactttcggtgttgtcagtgtgataaaaagtcagctacatttcatttatggtcattatgaccaaaacatttgactgaaatcaaaggcaagtaagcctggctagaatttggtcatatttttaatagctgaatatagatatatggttgtgcgtatatgtaggcatttataagctaacatacatatacaatcatatgatacaagcaatcaactcctttttaagtttttaaaatatatgtctttcttaggggaatcacataaatactaaaaaccacttctatataaataagaaagaacaatttcttattggggtaacaacaattctgttatttagcaatttgatttgtgtatatctgcgactgcctaattaaatgaatatagcatataggaagtacttacagctaaaatatgcacgcaagaaaatacacatttcacaacatgcatcctcattaatttaatgaaattagaatttccaggtgagcactaggaaattgagttattgacagtgcattgtgaaggcttatgatcaaggtattgaaaaaataagtaatattaatatagccattgaagcacaaaaaatacatcgtcttgcctttgtatcagaggtacactaatcaaattctgacttcttatatatttcaatttagtcatgaaattcttccacgaccacttggaactccaagccttagcaactataagaaaaatctctctggcagattatatttttttaaatgtcatgtcttgggaatactcttaaatatttgttttcacctattctcttcttaaagttgcttatataatttcatatgtagtcattaataacatgttttcaaagtgttagagatctagcttgccttcaacgcagttctaatagacatccctaccagaaactatgagacagttttcctgggagtctgggcagtttgaatattaactgaggaatgttaacctcctatgtaggtcttggtggtaatggcctaagagctagttacattttttataacgtattgtaaacaccatttccctttcaactttttttctttagaaaacaagataactaatgaaaattacccaagaaatattatacatataaatagtatagtcctaacacgagctaactacaataggcaaactttactattaatataacattaaacttttaccatactagccctaataaaactctgagactattttctatcacaatgacagctgatgaatttaatgtgcctcacaaactataggaattgtgataggaagctgactctgtcctagaggccactgacaaacctgataaggctgtagcaggggtcagtctctataggaaacttgggctatatgagcatgtatgagttctgtggttaagaatctgaagcactcagtatagcaaacaaaattccaaagctgagtaccaatgtaatacgctggatcgctgtacctacttggacaagagtacatgcaacaggcacatacaatatacatctggttaaatgtaaaatcatccattgctaaagcattttaaacttctaggagaaatctactggcaatgtgttaacagcaaggacaaccaaaacaataaaataacatctctttcctaaaatttaagaacatcaagtaagtgccccttaggctgggttgtgattcctggaagtttcagcctatgagaaccatattggcgacatcaaagactccccctctttccaaaaagcaattcacttcagatgctgccacacaatcgaatgcttttatggccaccatgtttttttggtttttgtttcgtcttttgttttttccatgcttaatgaacatgccagattcttgaaatagaaagaagatgagaaaacccagtaagatggaatacctctagaaaagaaactaggcagggacctgatggtaaaggataaaaacacattccaacaggaattctacttttagggagagtatgagttattaagaaggatgtggaaggcacattttggctatgaaagctggtccgtggactcctctgccagtctcacatcagacaggatgcaaccatccccactccattccttcgacaacttcccagagcacattcaatcagtgtcccttaaattgaggacaatactatatttgggtttaatactgtgaggacagtcatttagttttcctgtggcaggatgataaatttcctgggaaccaaataaggattctcattgcattcttctgcttgatactatgaatgcagaagaataaagaagagggtgtgacaaatcatattttccaaaggtcgggtgtggggaggttccctaacgtttaaaagcaaccagttgttagcaaagtgatctttagaacagtattagcaagaatgtttgctctacatccactatagatattctctcctgcttagctaggcatgtaagtactgtgagcataatgtaaatactcagaacagaaatgcatggaaagctggtggagtgaaactccaaatgaacaattaattccactttcacttcccccatctacctccctgaatactacctccctgcccccactcacctatcttcctccccccaacaagcatgtttgctaggcatgtcaaggctgacatccatcggtggcagtatgaaacctatgcctacaggctgctcctgagcatagcctcaaggctctgccattgtccgtagagtgctctaagttgtgcccgctaaaaatcttcatcattccatttgactgtttggtagtatttctttaattgtattttttgtttgtttgttttaaaaacaccctttatttcctgcttgccttagagacaccaagaataaaatccttgacacatcaaattctggaacctcaccactcaccaggactatggttcctgatccaaggagtgacgactgagaatcagcacacagtctcttgagggtgtccaggcctggctgttaagctccctgctctgattagtttgtcgagttcacagtgttccagagtgctgaagcacagaaattagggaggggaggtggaaggaaaatcactggagcctcttacgatctaacttccactaactgggaggaaatgtcttataaataaacaacagtaagagaaacaaaaaaaaaaaaaacccatcccgtcctgccagaggaatgtacattattgtctcccgacggaaaactttacaccacaccagaatgcagccatgtctcctgaaactacctccctcaaaacagaaagaaaaagagaatcaaaaaggaaaggagaacaaaacagaacaaaaaagatttcatccccttgaattctgttgggaagttcatgtgagttcccagtagacaaactaaactaagcaatttcaacagtgtcactgttccagaattttgtgcagaggctgcttattagccaaatttcatttctgcccagatcactgctgtaccatccagacattttcagaagggaagttcagggaaggggggaagggtacgactgtggagaagaggaagaagagaggacaaaggaaaactcctgatgaaccagaatgccctagccacggccatgatagagcgagcccccacccaccacccgactactgcttgttgaggacttggtgatgcggtgtgttttatctacttactctttctgctcgggaggctgaggttcctacatttccagctcatgctggactgtaccgtaagcaacaagtgaaatgagttcagtgatctcattctagtccttcgactcctgtccacatcactaagcgactgcacagcttggcacaggccaggatgagtcagcagtctctggtcatgagaggccaggcctggaatagcaggggggtttaggtcaggagcaaaatgaagcagaaaggcagtctagatggcagggctctgttctgcaatacacagaaatactgcaggtcaaaatgaaagcgcctcatcagctctggggtgaagattgtaggactgtaaaaaaagaagcatcaagagaaaaaaaaaagctgcctaccaaacatagcaaggacaaaacagagtaccacagtcagaaaaagagggcactggtagagccctggaggataaaagatgctcattaaggtttctgaaatgtcttttcttccacatgctcccaaacttgaattaagaaatggtgacttcctatatactatcctagtattttggtactgttttcccaattcagtaagtagcaaaacaaataaaatgcaaggcactgcagttaaatagcaagaaaagcctcatatttcataaaataatatgagtctgatatctcaaaggtgtacatttgggttaatagtgtctgtatatagcctgtatgaaatggttaaagaggagtactctttaagttgagcttgggtgggggtagagaagagcttagagaaaagagagttaccagttaatgataaaacataggggaactatgacactgtgaccatatttctactcaatggggccaacatagacctccattagacctccatcaagaagtgatgctcccactaacaggacttcaaacacttctccctctgcagtagtactgtaatatagcaaggggagagggaaaataaaatagatagaaaaacaaggttcaacataaaaaaaattagtgatagacattttgtttcagaggaggcaaattgctctataagtcaactgataaaaaaaagtcttggtatctgaacagacttagagaaaccatatctagatgaagatgccaggtggagactgataactatcaggaaatggtagtaatggccataaagaaggaagaaagcaatctcaagtcacatgatgtagaataaaacagcatggaaaacagaaggagagcaacagacttcgggaacacgagtaaaatatttctttaaagtccttttaagaggagtaatgaggacccaccacatattcctaaatgttgtccctcagagatgcacagatgtatatgggtaaggaaatgtaaaataaactttcagctttcatttcagagggtattaagtcatctgaacacatatttactaactgtttaatcttgggcaaatgagctttctagcctcagtttctctctctttgaaatggaaataatattatcatcctcatggaatcattgtaagcactgaatcaatgttcattaacccttatctcagcagtacctgtcacatggtgaacattcagtaaattgcttattattcatattatttgattatcatatcatatcatctttataagtatccagtgaaagaatccccctccagtgttgttccactggattgagaggaatcaatatgaagactctagtaaaatcagttgagtaacactgcttacactgctgctttaaaaagattatttctgtctgggtatgttaaacattatacttgaagacacaggatgttgaaaatctattatgtgaaatccttgaatttgggtatctatgttgtcaaagcaacttggagcctaacagttgtccagtaactagaggcccaaaaaagaaaagaggaatttttagaagcttctccaaaagcaacaggataaaagtgttattggccttaaccgcatgatgagggctttttaccaaaggggaaaacgtagtccagttgatcatcgcagcctaattgattaattgtgggtctgaccatctggctgatgaatgctgacacccagcagtgattactgtgtaacacaattccggatgtgctctccctgatgcctcccacaataatggcaactctgaacttaaggttagtttattcaggcctcttggctcaatctcttcatggaatagtggttgtggcagggaatattttactagacctggtcaagcattatcttctcttatttcagttacccactcttttccaactctactcctacccactcctaagccctctcttgtatataatcacttttcatgcaaagcattccatctgtagttttcatcatattatctgattctctcatttctggttgctctgttctgaaaaatatttgactaaactaggagatctatactgctagaatgccatttcacaggggatcctattgggacatgtttattgtatcttatttgctactggtttacttcaaattactctgcgcttccaaataaagaaaattattttacctaattcattagcctgattaaaagtcccacatatggcccaagttttccatgagattatcagaatacaagggttaatagacgataattcttacatcttaagcctacttctgaccctcagttaggagtatcccatgaagaagattcccctggagcatactttactgttagagaaggaaagtcagacccatgtaaatgacaaggttcaatagcaatgccatccacaaaccaatctacacctggagatgacttgtacatggagaattcaccaagcaaataaaacctgtacatataaatataaaccctggggaattataacaaaataattccattgtattttgtaggaatgcacaggggagtaactgacacaaaatatcttatacaaccttgaccaacaagtcacaatgacaaatcatccgtttcctcttttcttttcccagattgatttccagctctaaattcatcttttctttcactccccacagatgctgaattcttctatgttccaggctgagttagtgttaattttcagtagaggacggcagtagcatgctgaactgtagagttccgggctgggagttgggaaatgtttttggcctgactgtcagtaaacaactatgtgtcttgggcaagtcaagtcccttaactccccatgtctcagtctcttcattgaaaaatgatagggtaggactgcataaactccatagtctctgccaacactaagattctatggttctatagctcatttccttttttttctccctttggcatcaactgctcaacaactccgctcatagtaatctctatgctctcagttactaatggaaaaatatgtccttcatttactagttggtattttgtatttgtaatctctctctttttttatttgatgctagatattttgagtcataaacaccaacatatccaaatagatgctttaaatttgaaggcgtttaaggaaaatagctttcccatgtagaatatttagtgtagcagggcatggaggaagccagccatccaaaagtggagcaaaggggccaattcacaaatgagagaaagcctttcataataagagtctccacactctttaacttagataaagctaaaatgctaccaacttctaactacttttccaatcaatcccagacaccatcacagacacttaggactacaaatctgaggaccagcactggcagcaatgcagttcttatttcacctccaccacccattgccaagcaggatttaggatggcatactaataagagccaagaggacgatctgtcatttattttcctccaaactttttgaaatttcccatttgggctctgtttcccagttttaatttggtaactgccatttttcagcatttcttttaacaggttactaataatttctgatacaggatctcatatttcattttatgctgctagagctgctgttaatatttcatctgccttcaattcagctctgaataaaggctgctaggttttgatagactgttaacactttggttctggggatttgatcactatgttcatccagtttgtccatattttgttaaaaaaaaagtaataggttagctatctcagaaatatctcagggtgtgctatacattctagggatacttcagagtttctttttctggatctttgatgaaaaccaacaaaaacaagtatcctgggtttgttttcacaaatgacttgccatttgcttcagtgtcagtattctggaagcagtgggcagtggttaagattcagggctcataggcagatctagattcaaattttggctctgaaatttattatatatatcacctcaggccagttccttaaccttgccaagtctttcttttcccatttgtaaaatagggatgataataatatccacttctattaattaatatgaggatccaataaattaatataaagtgctgaggattttctcagttctcaataaatgatggctatcattatcctagcattaataatctacaaattcacattatagaattattattttgcaacatcttttcagggtcaacaaattattttttagtacagcctttgttgtttgcttcactatagcttacatttttaaaaagtctcagtaaaatcatgtaaaatatttaaaaatttgatatttaaactgtatgtacagttagactaatatatagcaccatattattattattgtagcacttttcagtgcagcagcaaattctcaaaagtttttgtccatctaatagccagccctagataaggcacattgtaccaatactaatctgttctataaaaagatgacttatcatatttatcttctcctactcccaaagaatatagattattttaatattctttgggtatgtgtcagtcaggccctgtttggatacagagaccatatagcaatttgaatagaaagttagtttaaattattaataataacgggattaaagtaataagagtagctagtaagaagtaaagaatactttaaagaatataagaataacatgggccaggcgcaggggctcatgcctgtaatcccagcacttagggccgaggtgggtcttcagcctaggagctgaagactagtttgggcaaaatggtgaaatgccgtttctacaaaatattagtcgagcatgatggtgtgtgcctgcagtcccagctacttgtggggctgaggtgagaggatcgcttgattccaggaggttgaggctgcagtgagctgtgttcatgccactgcattcaaccctgggtgacaaagcgagaccttgtcttaaaaaataaaaaagaatagaagaataacaaatgtaaggaacagccattatttgcagggctaagatagcatatccaaggaagagtctcctccatccctggactgagatctagacattgtaggactcaagacaaaaatctcctggacccctggaccaggatccagaccttgttggacaacacacagccataactcattggatggcagagaagttgctggggagctgcatcagtagcacctgcactctagggtgctaatgaaagctatttacagggatgtatctcatctgaggcactctgctataaattgcccaatgtgtgtgtacacatgtgtgtgtacgtgtgtgtgtatggtgggtgctaggggtagctgctacctgccacgtactggagaagctacctgtgcttcagctgctgggtaccaggttagctgcatttgctgcaggagctacatgctgtaaaggttgcttatgttgtagaagccaggctctggagaaaccgtgcacattgcaggaggctgccaaagtagtgcatgacaaccaggaaggaaaatttcttctttctgcaacgtctccctaccttctctactgacaaagcaccctcaaaccagctagcaaagaaaaaatatttaaagaatccagatacatttttgcagagcaggcaaggagaactacatttggaaggaggcaatgggaggtaatacattggtaactggcacagatattattatttgctcacacacttcatgaaataactcacattagagattataatccagtattttcaactgattgcactactgttcacatttactaataaaccaactccctttgcatagttaagcaaatactgtcagaattaagaaaaataagaggccagtagataaatacctataatagaatattttaaagtgacagtactagtatatgtacataaccttttcccccaagtgctgcccacatacattttaattacatgtttataatttacttaagaaaaaaatatacagaagtactaagctattgacctaaatgtatgcatcagtgatctcacaccagaatctcaactaagtgggtattcagaagagtcattacaaacaaccaaaagctttgagagaggtaaaaattgcctcgattatcatttttcctttctctttccttttctttttaattaactctagaactcatatttgcttcttctatgacatttttgtggaggggtggggtggctcttaaataggttattcttttttttttttttttttttttttttttgagatggcgtcttgctctgttgcccaggctggagtgcagtggtgcaatcttggctcactgcaacctctgccttccgggttcaagcaattctcctgcctcagcctcttgagtagctgggattacagacatgtgccaccacacccagctaatttttgtatttttagtagagacagggtttcaccatattggtcaggctggtcttgaactcctgacctcgtgatccgcctgcctcggcctcccaaagtgctgggattacaggcatgagccacgtgcccagcaaaatataggttactgtttttcagaaaaatacatatttagaaattttttcttatgattctggtcctatattgttctactcttaatattaaatagagaagcatcaataaatgaccaatttggtaaactatgatactgtgatcattgttagaactagttttacatatggggagagagtatattccaaaatacctcccctacttttgcctaattcccttaagaagggaacaggtgcttttgctgtataattacaggtagagtttaaaaccacaaacacctgacattagcaaggagcgtggttgtgagaggctgagagcagaaaagctaattgggtgaggagagtcctgtagagagtagactatactgaggtcaggaccacagaacatctttctcaccattcatccgtttttacctatgtctggccatcagcactatctgttctcactattatggaaggggtctacttgttacctcacagttgtgttttcttaaagccagtggtatccagcaaagcaagccatgttgggttgtctcacaatcacactgtaggcatctctgccagctgcaggtggttatccttatgatttccttttgtttgtgctatgcgtgagtactgaggataaatttaatgaccctatgtttagttctctcctccaacacacatgcacacccccctctcccctgcaattcctgagttcaaaaagagatgaagacaaaggaatgtcataagtccgtgtgattcaggcaggcaagtccattttattttagtttgcccttctgttctgctggcttttctgctatgacccactatacttaacctgtcggctgttcttagtagcaacatgcctttttaatcagccttcctggggtctgcatttgattacagcatttgtgttctattttgattcttttgtactgtgccctgtggtgttcgcttgaaaggtgttatttataaaatgaaattctattgtattgccacttggattcaaagaggacatataatattaatgcagaatgtatttaataatatcttcaatctattaaatcaatttcttcatgagaatacagaatggaagggaggcacatgggctgataatcaggtaataagacttaagaatcacctgaacttttccttcacaagctttcctgaaagctggcacaagaatcattctcttaatgtcagggtttccaagtggaggagactacctttcttcagccagaccagtgcagtgcgcacctgtttaaacattcaactgtgcaggccaaacattttcctaggcttttagatgcaaattttttgactaaggaaactatgagaccaaacatgaatatgacttttttactacatagaaagaattaggttatgaaggaaatgtaatcacctatttctaaggatctactttcaagatttgtaaaaagaagtatatttgttctcacactgactcttctcaaaagcaggataggaaaattctagtgataccaagaactgatgcaaagtttccaaggtggcatgttcagaatgatgttctcacctagcaaaagggcaggtttcattgtgggctgctgggcctacagtcaaatgtttctagattagattgatggaggagtccccaagttttttcaacttctaattttaattccagctaaagactgaaacattgtacactgtatcacagcttgcacagcacatttcttgctgcatacattctattctttcactacaatttttttttcctgttgatctatctgaaatcatcaatggctatgctgctgtttggatagggaataagaaagaatttggtttgaaagatgatttaggaatcaggctctgcagaacttactaaaagaaactgtaacatacaaaggaacctggctgggcagtcttgaaatgagagttcctggatttttacctgttctcattcagtggcatattatataactccagaaaaatcagggtccagttttctaatcactaaaaggggaataactgtccttttctacttgcactgggctactttagggatggataagaaaatgattccagaatcttgtaaatgctttgcaatgaagaggaaatacaaatgcacaatattattaaaatgatagtttaggccacatttttgtttctccaaatctagagatgaaaaatagtaacaaaggaataaatttcttccacttcaaaaataaataatatacccttatttataaatgacatgtcaaacataaggaactaggatgtgttggggaatacacatctcagttttgaaggcatcaaattataagctatttgcatgaaggaatcacattcatctctgtatccacccaagttctacctcattgatttacattatgtaagtattccattcgttaacatatgttgaattgaaatgacaaatgagatcgcacaattttagagctcgaattaactagagaccatgttaaatcctgttgcctcattttgcagatgatacaactgaggcccagataagtaacttaactaagtccaatactaaaaatattacaagttttagaagagttattttaaagatctgccactgaaaatatatcactgaattaaaacaaaatagacattcttctgtcaaaataagaagcactattcagctcaaataatccgatgtatcctaacctaatcaagaaggctgaagcctaaagtaacaagtaaacataattaaatagctatagacccataggcatgttagaaatgccaagttactgaggggtgcatatcttaatactttgtctatcagccagtccaaatggcatatttttttcaagtaaaattaatgtcttaacaaataataggggtgaagtcagcaagatggcagagtggaaaactctacctctcattcttccacagaaatactgataaaacaatgttggaaccaaaataccttgcaaatatattcagattgtagctaagaaatagaggcaccctagaggatcccaaactaaaagcagttgcatttgcatgggtaaaaagtgcaatttcatgttagaatgtcatatcagtacttcccccagactggcttagctcaacactgagaggactgcttcagctcatgatttctcctgtgccacagaaagtgagattggagtgtgtatctggcttcctggcctctggcctctcagagaaccctctgttgggtcagttcctatattgcctcatactgtgtactgacgcacctgtagaacttcgttcccagggatgcgtaggagcaaagaaatgaggagggcaactccttacagttagagctgccttgcaagattaggaatggggcagaactgaggttattcttagatgagggaggaaagggaatgaagggggccttattctcagcatttcagagttccctctgtgaagccagtttccatttcaccttgtactgagccttgtgcgaccattagaacttggttctgagggatagttagcaaaaactaaaaggagcaggcatccctttgcagctggcactgctctgtataataagaaaaaaacatagaaccgagccttttccttgagaaggcaaggaaagaagtgtaaagggccttgcccccagtcttagattgtgctccccaaggtgtatgtctctatcttgtctcatattaagcaccatgaactggtaaaggtctctactcatcaaaactcatctgtagagactgggaaaggtagctgctacttcaaatatacagatcacaaagaaaatctacaaggaacacaaagagtcatctccaataaccatcctgaaagaaacagagatccctgaattaactgacaaagaatgcaaaataaatgtcttaaagaagcccagtgagttacaagagaacactgagagatagctaaataaaattaggaaaaagatacaagaacaaaatgagaagttaaataaagagatagagactattaaaaagaacccaatagaattactgaagctggagaatacaaaaattgaactgaaagattcactagaggagttcaaaagcagacctaatcaagcagaagaaagaaacagtgaacataaagacagatcatttgaaattatgtagtcaggagcacaaagaaaaaacaaggatgaaaagtgaggaaagcctaagtgacttatgggactcaaacaagtgaatcaataaacacattagggaattctggggagaagagagggaaaggggtagaaagcctatttaaagaaataatggtaaggaacttcccaaatcaggggagagaaatcaacatccagattcatgaagtccaaagagctccaaagatctacaccaagacccattataatccaattgtcaaaagtcaaagacagaattttgagagaaacaagagcgaagcaactcatcacattcaaaggagtccccataagactgtcagcaaatttctcagcagaatcctcacaggcaaagagagagtaagatgacatattcaaagtactgaagatcaaaaaacaacaacaacctgtcaaccaagaacgctatactcagaaaagccatccttcaataataaagaagaggtaaagactttcctagacaaacatgcagaggggtgttcaccatcactgtacctgctttgcatgaaatgctacagaaagttctttaagctgaaatgaaaggatgttgattagcagcatgaaaagatgaaagtataaaacttgccaataaagtcaagtatatagtcaaatactagagacctctagtactctaatgatagtgtgtaaatcactttcaactctggtataaacattaaaagacaaaactataaaagtaatgacatgatttgttaatggatacacagtataaaaagacgtaaattgtgacaccaataacatgaagtgtgtatataggagaagtaaaagagtagagattttgtatgtgatcaaatttaagttgctatcagcttaaaatagatgattataagttgttttatggaagcctcatggtaaatacaagaaaaacacctgtagtagatatataaaacataaagagaaaggaatcaaagcatattgctacaaaagataatcaaatcacaaaaaaagacagcaacagagggacaaaggaactacaaaacaaccagacaataatttaaaaatggcagtaataagttctcacctattaataattaagtgtaaatggattagcttccccaatcaaaagatacaaactggctgaagagattaagaggaagactatccatatgctgttaaaacagcaacaacaacaacaacaaaaaacaacaacaacacactttagctttagggacaaacatagactcaaagtaaaaggtgggaaaaatatattccaagcaaacgataaccaaaagctagtaagagtggctattcttatatcatacaaaatagactttcagccaaaaattgtcacaagagacagagagaaggtcattatataacaagaaagtgattaattcattaaaatgatataataatccccttgattaggatccttttgattggaatcctcttgactggagtagaacaaaaactgaataattgtaaactattattatgaagtagagatctccaatacactactttttatttttccaaagctttcctggagatcacagagaactgaacatggagaaaaagtgagcaagagacagcagtaggctttatgccttaaatggctgtatagcttgttaaagattattgtttgtgtattaaaaaaacatgattctagaaacataattggggtttcacagatcaaattcaaattattaacttagtatttcagcctccattacttgctctatcttgcttaggcatcctaggttccagtacttcccaacaagtgttctgtggtgtatgcagactatgttagtgtttccctttattttggtatttccacaggagacctaattttaaattttctgttctatcatctccatgatttcttaaattatgtctagacttctggattagaatattattcatgtacttactatgattcaataaacatcttctatgtgtgagacagtaggaataagatacaaataagacttatttcctatcttcaaagaataaaggaattcacaatacagtggccacttaaatatataacatgtgttcctgcttttaagcttttattctttctataattagagtatcctatcattattttattgattgaattcctttaattatcttatagtccagcttatgttctgcttcttccataaattaatttttactttttatagcccacactgtttccttttccccccactattacagtggaagtggacactattccctaaccaaacttcattccctcattcttcctagccgcagacctctattttgtgcagagtgtcaatgtgctcagtgctggatgatgagttttgaaatttataagccaattatgacaagtgtattctctaatttgcttgcttctctagcaaagaagggtggcctagggattcagttatagccaataagatctatgtggcaatccacttgagaggcaagtttctgagaaagctttttttttccgttacaaagaggaaggtaaaaggcaatccttctgtttcctcctccttccctctttgaacatagacatgatgcttggagttgtggcagctattttgtgatcataaagtgacaagcatgaaagaaagacaaaaagaatcccagagatatcagcacagactttatcatataccaggaatttcctacctctcaacttctggacttcctgttaggtgagaaaactgaatctctatttgtttaagccacttaagtcaggatttgctacctgctgctgaacacatttctaaccaaagtaataatagtaacattcataatttgaattcaccaaactgttcttcctaactagataacagacattggtcacattcttggcacttcataaacattcatttgcttcacatcttgattaaatatgctagacttttatatgtaatgaaattctcacacagaaaggaaggggggaatttggattagtatcagaaaagaggatgaaaccaggtcaaaaaaggaaaatttgattctataataaaaaattatatgacaaaaatttgttacaatgtagctcaattattatatacaataaaagcaaatttttaaatattttccaaaattaatagcaacatattttaagaaataagacagtagaataagcccccaaatgataaatgttttaaaggagagatgatataaacaagtcttctattaaatgtgaagacaataccatgcagttctactgaaacctaagtgaggaaccagcgtttgtcaaataccaccagcaataagactttttctctgtcctttaggttgtatgactgtgattcaccccaatgctacaggctccttagcatgctcattatttctaaaatctttcacctgaggtttgaacccatgacttaggaaactattatcgcatttgcttttggagaaaagactacataagttgggacagaagctattttcaaggcttccaaatattacaagtaagtagtggggaactgttgagaagagaaatgagtagctttgggtcattttaggttagtgaccttaaacataaggtgtgatttaatcagaagccagagtaattatggcaggaggtggggaaaaagactcagagctgtctggagttagggaggactttggtggcagctttcagcttgagctaaaactgcaggattctgtcagaggctccacaaacaaagggctgcattatgtaaggaatcttgtatttctttgtgaactagtccacaacaaaatttcattagtttttttttttttctctcctagagatttttttttaccacttccagcccgtaacttgttgctcagaagggaaactttctaccttaaataaaagtttaaattgtaagcaaactgacatttttttaggaacaaatcaaattaatttgaactttataataactgggaaaatgctttttaagttaggtggatgataagtaatcttatatgaagaatttccaaataatttagcaatagttggcaataatttagcaatagttagcaatacgagttcatatctctctccctctctgtctctatcattttctgatagtctgtttacacatgtaacacttttgggtcacctttcaatggagcatttcataggcagaattggaagatagcaagacacatggatggcacatagcaataggttctcataaatattatctgttttcaaaagaatatttatttttttgcccattataaagatattctaagattaattacagtcctaatactgtcaaatttagctttgatatacaaaaatctattttttagtagtttaatttttttttatcaattactaacttgaggctttcattttacaacattattttggtcagttataaaaataatttaactgccaaatgggttttcccatttgacatttcaaatgttggtttaatacttatcacttagacctctatgaaggttgactcaggtttactgggggatattgcatagatcatgtcttttggtccaacagtttgggctgtgaatagtctaaatttgcatggaagctcccaactaccaagctatccaaaaactacagggacagggcggggtgaatgattctcagcaggtggcactcttccttctaattaggtcttgaatgaatgcaccagcattctgctatctcttgggtggagtgtgagactgaatcattcaataatgcttatagcgcttaagaaccaaattcaagggaactgtggaatgaaggcaagttataggtaacatacaaggattttcattctgctggactttttcattcaaaacagcatcattctcagactcagaattatggataaccatgcctctcagtctactcaggagagtttccagtttcagttccaatggcccagtcacaattattagtagtgttcattttcactttcaaaagtgtcctagtttggatgataaaatatggggttaccctgtatataagctttaaaaaagttagtcataacaccatttacagtgataatcattctatttaggacaaattaaagtagactctattggccaacttctataaagagaaagagataaactaaaacattattaatttaatctcagagctttaatcagaaaaagtttattttaagatgacaacaaaatttctatgaattatttaggatttctaattttaggtcatttttttttagccttattttatacaagcaagcacgtatgcccttaagatttgtggtggagaaagaagtacaatatctgaaataaagttctttgaagcttaggtttgaattctaattctactatttactcggtgtgcaaatttaaataatttctgtgaacattattattaaccctttctaaaatatgtttaaaaacattttaaaaaccagaagggaaagaactacatatgctgtgaaaagctgtaagttattaacagttactattatttctctttataaataatgatagtttttccctttcaacttctatgacacttttacagactgtagaaaaatttggccaagcatgttgtagcaagggtccttaactgtaatcacctttgacacagatccatgatatttctgggtgacatctctacatggacattgatggcctgcaaagatctagaaaagaaagactatagatcttgtacaccaaggccaaagactaaaaggctgaaatttaaagtacaaaagtattgtgaacagttttgttagtagtataatatataccacttatatagataatttttcttatatagatataagaataatttttcttatatagatataaaatagggtttcttatatagataatttttccatggaaggaaggggaaacgaggcgaaaagtggctggagtagaaagactagtttgtaaggcagaaagattttctaattactaggtagattttattttattttacttgtttttactagctaaattttaaaaaagagattcctagatctctatagacatgttcctctttctttttgctgatattttcctatttcttttctgaaatcttaatttgactagaaaaaaaatgatgttctgatttaattctcttagtctacctgacatcaaaaagtatatggagggtgtctttagttttttatttatatgaatgtaatcaaataattttattttttaaaaaaagactctcactgtttttcattgtttaacagacatttctttaaaactttgaagtaattatagaaaatgttctcataaattttccctccaaattaaccaggtagaaagggctaatcctgttatgcatgccatttttgtttgtttaaattgactattctgagaattaagtctgtagtacctagtttgaggcctcaagattttcaggtatgcacaaggttctatcaactaattctttgtctcactgatgatcctttattttaaatatactctacttgcaaaggtggtagggtaaaaagaggagtggctgacaagagactaaagaggggaaaggattcccaacatccttaatatctcagggctgaaaaagagcattagaaatcttctccaatctcttggagaaaaaatatctttcacacactctgtctattagaacttcatttgtgtttaacaagcccctcttttaaaatgcaaatttgccttgtgaacctgtaaacctcattcacaccttattgttaattactttgatgttctagaatatgatcaacacttaactgatattggcaatctaggaatgaacaaattgctcagggtgaaaaaaggaaaattttgttggagtggggctgtaggtggtagtgtgagaatttcatttgtgagaaatagagcatactgatattctgaagttttgtctaggagaatggcagtagttacggtaccacaaaacgagcacttttcccgactgccgatgtctagttgagatcagaaaaagcctggaagcctgcaaacctaagttttaaatatttagccatagcaagctaatcaagcttgcaattttctgaaaacgttttaagttaattcataatagctctacaactcggtgaccttgggttctaagactcatttggttcaaccttccaggtttaaaattcaaccaataaatgaattccaaggaaaaaaagtgaatatggcccagtccttttttactgtctccctagtcattcacttcagagattttggaatgcaatcctagaacatactgtaagcaatttcagaagaatacacaggatgcagtatttctctatgtgtcttagtaaatgtcacttgacccgatatatcaaaaaggttgcaaaatttgaattagactttagttgacttaagctacacatcttagcttggcagaaattcaaggaaaaaaatattttatggcctcttgtaacattattaatcacccctccttttatataaaaaataaatatgctaaactcttcactgttcagaaaaggggtcatttttcctgccaaaatggctaattttagtttttatgtagttggatacatttgtaaactattacatgaaaacatatggttggaacatgcttactccttcatgagtgttccccttttgaggctgcaaaattttccttagttgctccatgtgctactttgttgtgctgatgacttcttgttctaaataattttcttcattttccattgttaatgaaatgagttctaataaggaacaaagaaaccctctgatgaaaatccctttcttgtagaatggactgggaactgatataggacacaggggaacagcaaatgctgtgttgcacattcttcaattaaatgatccctttgtagtttattcacctgaatgcattttggcaaagagtgaagcaatagtgggaaaaggattgtttgtgtggctaatctttggttactcagaaagtactagacatgttttcctgcatgtttgattgatttcctgcacagtttgattggtgaatcaacactttaaggtatctaacccataaggaagagtgaaaaacttccccagaggtattgaaatttcactaaacctcttcttggagttttggtgtatgattctcagttgatctttgagtgtaacagtcaactattaaattggcatgactgaagtacagttttttcaaatagaagagtattttagaacaaatgagaattctaactctttaactgaatttctaactttacattttgcccgtacctctccttgtaacattcttccctttttccctatatatttttaccagtaatcctttcaactgctccttaacagtgagattctactgttctggcacattataggttctctttaactattttttgagtgcacaaatgaccatttggacaaatattataaaatgaacaataaaaaaccttaattatgcaaattaataagtctatacctttgggaaaaaagccatgatagtaacaaaatgaataacaattccaaggatatttaggaaggataaagcctagaagattaaaaatgagaaattttagaatcataaaaaacaaaacgaaataaaatagctcaataccattgaaagcacatgtatgcagaaagaagctaatatattattgtaaaaaattaaatggaaagaaattagaaatctattggtattattacatcaaaagcaggaagttctttctttctggtccaactttagagagaagaacaaatttgccagtgccaccaagggcagaatagagagagatgtttggaatttaagagttacaggttatgttatggttcatttatatcattgccatcactgcagttcattcattttgtgtctaattattgatgttgccacggttgtcaataaacgctcagcattactaatcatcagagaaacgcaagtcaaaaccacaatgaaataccatcttataccagtcagaatggctgttgttaaaaaatcaaagaacaacaggtgctgcatgattgtggaggagagggaatgcttacacattgttggtgggaatgtaaactagtcctacctattaggtactgtgctcattaccataggaattagggtgggattcctattccaaacctcagcatcacacaatattcctatggactaaatctgcatatgcaccctctgtatctaaaataaaagttgaaattttaataaagatggaactaatccctcatatcacagaattatgtagttgtgggtagtcaggataaagaatatttaggatataatttaaatgaattcactagctctgaaaatgaaagaataaacagaaaactaatctagacattaaatttttttctttccctaaggataatgtatagtccctaaggataatgaatattcaaggacatactgtaataaatcatatacatttattattaatataatatagtttattgcacacacacactatgagctccacgatgttcgttgaactattacaaagtttaaagacatacgaaattacagtaagagccatccatataaaaataaaatgttagtgtttggaaggaccaattgtaggagactatattggcgagttaatacaaaagatcatcttttgtttaagagttcatatatttttgtgtaaattatatctatttacagaaattttctttactaccaactgttctcaaacccattcactaataaataattactatatgtgattacttaatatttacctcaaacctttatgaatatcactgaaagcattactggcaaattaattatataggcaaatggtgaggatctctcaacctcacctctcaccttcttcccaatcactcgaagactgactatatcaatttgtcttgttatccagaaattggctttatttgttaattccagagatgcttcaactgtagtttcagccagctgtttccttacatctttctgggtggcatcagtttacaatgcatagcattgttgagggtcaaagttattttattttggtattactattggatttttcccccagtgcctcaaaggggaatgttgagtcatggagatgtaatgtgactccttaaactaagtagacttctaatacaagtatacttttattatggagaaaccaaattaattttatcaattaaatgagaatttatttaccatttgcctttaccagatatttcattagacacaattctcagactttacacaattacaaagaatgttgtataaaaactatctataaagcaggagatatttcattcttagttttttgccaaacaaattatgttgcttcgaggaacagagggaaaagaaacattgatgaaacacagccctcaactatggcataaagtccaaagcacagagaaggtcagaaaagaataaagcagttttgcagaattattatgatagggagtactgataaagaagagtcaactttttggccttagtcatttactgagttcctttattaaaaatagagcataaacattttagaaataattttttctcaatctttttttataaaacctctacagaaaaaagaagcgttatgtgaaaagcagctaaatgggaggaaagtaggggtctgtgggtgaaacaggaggttaccattgcaaaccctgtccttgatgccctcactcagtaggactggtggatggaagaagtttgaaaaacttttatgtagagatgaagaaaagtagaagccctagtttacagagaacgaaagatacatttttcttctgtgtaggtagagtttgtatttggagaaggaggagactcctttcttctgatgaaaactccttcttccaagagaaaactccattaggaaaaatggagcagcagtgagtgagagagaccaggtttaagatttgttttggaggttaaatttgttgtggaagttgacagaatgtggtgaaagcaagacacatcataaaataagccaaaaaaaatctctctcttccagctcattgtatattggagagttagttgacttttctactgtaaatgtaaagaaaacaaaagtttcattcatcctcctgtaatgatgccaatctaatttgctattaaatttctattcaaaagccctattttgtttagttacaagggatttgatccccttaaactttcccaggcaatttgtatggaaaggcggttgctaagggtattcctaagggaactggcaaacgttggaagataaataacctcagtacaatatgcagattaagtagaagggatggtttaagagttaccttttgaaggaaaaataaaagattcagaattcagggctagagttgctagttaatcactgatttgaaggtacttaatcaaggcagttttattttattttattttatttatttatttttttttagacagagtcttgctctgttgcccaggctggagtgcagtggcgcgatcttggctaactgcaagctctgcctcccgggttcatgccattctcctgcctcagcctcccgagtagctgggaccacaggcacctgccaccacgcccagctaattttttgtatttttagtagagactggctttcatcgtgttaaccaggatggtctcgatctcctgaccttgtaatccacccgccttggcctcccaaaatgctgggattacaggcgtgagccaccaagcccggccaaggcagttttatacttctcaagaaagtagaactttcacattgttcctcttgggaataaaggtaaaattatcatagagaggaaattagagagaaatgttcaccatttccttccttatattcttcctttctttcctctctctatctctagagctcttcctcaaagattcaaataaccaaaaatatgaagccatgggtggcagcttggagttctcaaaagtccaaagtgaggttagcttctgaccaaaacttttggcaatttccttaggttgagtgaaagaagcaatgtgaaaaagcatgagtttagagtcagtcagccatcaatttaaaatcaaactccactatttattattggtgtgatcttgaatacattagccaacctctttatagtccagtcatttctaaagaggtgattatctatgaaacctgtattacatatacaatgtgtaagtactcagtaaatactcagtacttctctagtatctctctaattggatttggctagtaatcatgacaattgtgggagagaaaaaaaaagatatgtaatcctgagggcactcagtctctgtaacaatcacttgataaataatcaggtgatacttcgttgacatctctttaatcttccaattgagaaaacattaggagtagaagaaaaatgattaatctccaacttctgtcattggaaaataactaaagatcagaactataagaaacataaaacttttctagattattaaagttaaccttttagacattttccacaatcacatggtatgcaaattttaactaaattattttacattaaatgtattttgtgctatgttttgactagttgattttactgtagtatagaatgtattatgacattccattatcctcttattactcatcaataaaaaatttattgagaaaacaattaattataattaatatttattattcattactagtaggcattgtagtaattacactattattggtattttaaatatcattaatagctataaacatgttatacataataataatagaaaccatttgtggagtgcttactgtgtaatacattttgctaagcattttatatacattcttaaaattaataatttcaaagatttaatgagctaagtgtcaccagataaacgagaagacataataatctttatttattaaaggaaaacttgccatatccacacaatcttccaaagcactgatagaacagaatgatggcatgatggcatcttaaatttagaaagtgtcattcataaaagtgtactgttaactactaatttgtgctatctgcaataataatattatattacacaagatggaaaggctaccccctaaaagatagcatttgataaattgtacataaaaatctagaagaataagagtataacagaggagtgaaatttgatctgaaatacagagaaaattaagaaaaacaaaacatgttagccctactggaatttgtctcaatgtatttcaaggttcaaagtatagcagaggaagatcattgacactgtcagaggattatcattaaatttcaacccaaaggcaactaactcaaactatgcagatatggaaagtagtgtttcctaaaatgaaactaaggcaaatattatttattctagcttctactcttttgactaatcagctgacccagaaattaaatatttaaaggcttaaaaataatatagttttaagaagttgacctatacgttactaaataaaatgatcctcgttgtatttgaagtagctcaccatttaaaaatttaatctatgtccacccattttctttcttcccaaataatacaatgatttaattaccccacagtttaatttgacagaggagccaaaaagatacactattccttcattgttaactttaaggagaaaaatacactataaactatattagaaatcttattttttgggtgtccaccacaatgttttcactacaaaatcccttgctgcctgaatacaaaatgttaccattcaatcagatgagtctccatgaagttagaaacattcaagtgaaactcataaaataaagaagatatactctaaaaattccagttcttgagaagctgtttacacacaaaagggctattaaaagtgaaagggtaagtagaaaatcttctgggctcatttaataaaagaatgtagagttccatgggattcttttctaaagaaaccactaacaatgttgcagatctacaaatcctaaaagagtgcataatggactcaagtctctgctttgtgactcatgggtgtacttcatcaggatgtacttcctcttttagggggtcatataggtgaataagctgacaacaccttcagagagagaaattccacatgtgtcataggaatagaatttatttgatctcaagctttctatatatagaaaaaaaacaaattctaatccaaactttaatgaattcagtattgttgttgttggtttgcctctagaatgtctcttttgaccaagtcacattcctttaaatttacactaggtaaattatatattttccaaatcttttataaaagcataagctaaatgagataacattaaaaggctgattggagatttccctttaaaagcagtcataagaacaacagcaataataatataacaacaatatacactacattttgggcaccatgctttgaatttatatacactaatattattaaggcaatctgtgcttttgagaagctactccagactaggcactacacaaactctgccacacacaagagagaaacaatttcaattacaaagagagctagaaaataaaatggataagagtatcatgaaagattttttgtaaaactgaatagatcctttcatgtttctcagttttaatctctccaaatatccctattgtctgctttttaaaagaaaaaacactgtaaaaattctgaaaaaattattcacaaagaaaacttccactcgtttatataaagcattattattaacttcataacatgcataatatcatctatttctgaaagaccattgaaaagtagccataaaaacttaaaaaattgaaaataatctttagagatcaacaggccaggaagagttctaagaatatgcattggcctttactaaccattttcaatgccatgcacttttgtctgtcaatactttctcctgttatttttaatatccctagattaagaaatattaacatctatttacaaaaaaatattctaacagtttcccccacaaaagcatattcccatgaagatcaagaaaacaaaaaacatagcagggagtcagtattctgacagccttttagtcttcttcatcttcttcctactattattattagacctactgcctattaccagtaggctttttaaaggtcttggacataaatatcagttgttaagttgctattttcatggtcatttaaaattatttcaaccataaatgcttttaatttcctgaatatcttaaagctgtctaagtataaatattctcccattatattcctctgtgctaacacaataatctagttggagtcaagtttcatgaaaataagaaaattggtacattataacattttaaacactgaaaaataaacgtgatagctgtaggatgtaaagtgtagtcaggcctgtagaacttcggatgcatcattttacaatatcatttatcattttgataaaactgaggtcaagtttctaaaaatacaacttgttaaaagcaggaataaatgaatgagagatgagtcagctcgtttgatggaaagggtttaaaaaatacttcaaaagcataccacatgacttggtaaatattcagtgtatcaaaatgtagttgccatctggcattgatagactgggctagaatatgtgtttaaaaagaacaagaaaggaaataactcagccaggttaatgtgcacttgtctacatttcataattcaggtattaagtgctttaataaatattcactatgaaagaaaggctgcattacaatcagacttgggcagtatttgttggggacagctagaaagaaatgaaagaagacaagacctgatggcacttaagaaagctaaaaacaacaataaaaaagtggtttaggtaaacagaattctcaatcatatgtaatattgccagaacactagtatcacagttaaatgcagggaagtggtaagcttatatttgaaaataaactgaaatcttgcttattttcagctttgaatattttaattattcttttctttggctttgacaatttaaaagtatagagaaatccagggaataagtaaaacccttggttggatagtaaaaaaaaaaaaaaaaaaaaaaggaaaaacgaaaaagtcctgacattctttgaagttttaaacctagagtttgatattaactttgcaatatgcaacaaaacaaaaagtaaatttgaaggactcctcttttctccctcttgctcaagaaataaaatatatttagaaagcagtatcattcacaaaagagaaaagtgaacacgagcagtgaacacttgcccaagcgttcgactgtccaaggctgtatctgggcttgttaattagatatttctgtctttaaccttgaacattctccagatttccaaatcttgacaatttacattctaccacatctcttggaatcagagcaataggcagaagagaaaagttttaaaacagctttgaaggttaattaggacagggaccagggtagccattaggaaaatagatgaagcacttcaggtgagagttgattagggtcaacatgaaatttttcagagttgaggtataatttatattcagcaaaattcatggacttcaaaatgtacacagaatgagttttgattttgataaatttatacacctatgtataaatatgtatatataaaaatgtatatatttaccaccataacagagacatagaaagttcctttgtgcccccttccagttaatttctatctcccataaacaaccagcattctgatttttatcacgatagaatagtttcgccttcacataacttatgtatactcttgtgtcctggctcttctgcataccatgtttctggaattcatctacattgttgtatcatactctgttttgttttatttgcttgttagtatttcattatatgaatataccacaatttgtatatccactttccacatttgggtgcttccagttttaggcaattacaaataaagtcagtataaacttgcctgtacaaatctttttgagggcattattttcattattttttggtaaataactaggaatgtaattaccaaacaatatggtaggcatatgcttaaccttagaagatactgatccaatgttccaaagtagaactatatatttacagaaagtcttgaaattaggtaatgtgagtctttcaactttattctttttctaagttttctgcaatctcatatacattttaaaataaatttgacaatttatcttaatgttagaaaaacaagatgttgatattttgatggtgattgcattgaatctacagataatttggggaaaaatgacactttagaaatactgagtattcatctataaataacggatttttctctaaggccttttaaaattttgagtggggaatcttacattcttttgttaaacttttatttaaatgtcttatatttataggctactgtaaattgattttaaaacttcattttcaaattatttgccggtactacataaatgcaatcaatttttgtatattgatcttgtgaccttcctaaatgcactgttagctctattagttgttttgtatatcccctaagagtttctaatgtaaacaatcatggtatttgtgaataaacacaatgttacttcttcctttcctatgcttatacctttaatttattttactcgtcttattgctctggctaggatctttagaacaacgctgaacagaagtagtaagaatatatatctttgccttctactatatcccaggaggaaagcattcagattttatcattaaggacggtattaattatatgttttcatagaggcccttcatcagattgaggaagtttcaatctgttctaattttctgagagttttcactgtgaatgactgtcaaattttttcaattgctttttctgcatctattgagatcatatttttcttctttattaggatgcatttacagtgatttattttcaaacgttaaactaaagttgcttttctgagataaatcctacttgatcatgaggtattatactttttactttttattgttgaagtttgtttgctaatattttgttaaagattattgtgcctagaaccatgaggaatattggcctatacttttattttcctgtaatatctgtcaggttttgctgttgggattatgcctgtctcataaatcaggaagtgttttgtttttacctcctatgttttctgaaagagtccgtgtaggattaatattatttcctccttaaatgttatatagaattctccagggaaactatctaaacctgaagttctttttttaggaatgcttttgacgacaaattcaatttctttaatcaataaaggaatattttgatttctttggtttactatgccagttttgttaatatgtttttaaataaatttacctattttatcaaagttgttgaaattattgacatgaagttttcataatattcccttgttatcctttaatattgttatgatatgtaatgataatctctcattactgatattcataatttgtatcatctcttttttcttgaacttttctgttatagcttataaattctgttaatcttttcaaatattcatgttttgctttcattaatcttctttgtagtttgtttttatttcacagttttctgcctttgttatttgttttctttttttactgcttttgggtttaaaatgattatactttcccactttcttaaagtggaaacctacgctattgatcttaaacctttcttcttccttctaatttaggattaaaagctcaaaatttctgctaagcttctctctggctcatattataaatgtcaatatattgtattttcatttaatcagtttcataaatttcaatatactgcataacttaatttaattattttaaaatttcatgactttcaaccatgaggtattaagtttgttgtgtagtttccaactggtcttttctagatattttattgttttctttttttatttctaatttaattaattataaacaagaagcatattttgtagtatctcaatcttttgaaaatgtttgaaactcatttgatgaaccagattagggtctactttaataaataaagtagaacatacatacaggactctattcctgtatgttttaaatatgttttaaagaacacatattctccaggtgggaatagaacacattctccaagtgggaatagtgttctgtaaacatcaaacaggtcaaggcagttgatggtgtttttaatttcttgtgtattcttactgattttctgcctatttgttctatcaagttctagaacaagaatgttaaaatctccaattgttattgtagattttactatttctctctagttttctgtcagtttgtgtctacatgtttatgacttatgcattcatgataatttcacacatatgattaggaaatatccctccttatctctaatagtactccttggcataaagtctattctttgtaatattaatattccaacctagctttctcatgcttattgtttgcattgtatatatctttctatcttttcactctcaagatatccatgttattacatttaaagtgtattcctgtagacagcatatgttgactcttgcctttttattcagcctaatactctctcttttaattgtagtatttataccatttacagtgaatggaattattgctacaattaagtttaggtctaccatttatttcattatatgcttttgatttttttcttttgggtttttgtcattgttattcttctgttttcctttcctttttttttttttttttttttgagacggagtctcgctttgtcgcccaggccagactgcggactgcagtggcgcaatctcggctcactgcaagctccgcttcccgggttcacgccattctcctgcctcagcctccccagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggccttcctttccttttttaatgagttaaactgatcaattatttttccattcaattgcacaactggctttttagctgtaccttttttgttattttttagcagttgttctaaggattacaatatgcctctttaattatcactgtttacacagagttaatattttaccactttatgcaaatgtgagtatcttataagtataatttcatttactgccacccagtactttgtagtatttttacatacttcatatctgcaagtactatagactcatgagaaaatactataatttatgcattagtcagtttttcttttaaagaaattaaaagaataaaaggatattcttttacatgtaaatagatactttaaaatttttagtgaaaattttctgtaaaaacaagtttctatcttggttcatagtgtcatttcccttcaccctgaagcactcactgcctttcacactacttataggaattccactgacaacagaaaattcatttcttcattattgcaagatcacattgctctacataaaattctggttttgcagttgtttttcttttcaatcattaagaaatggcattacatttagtatgaggaatgagtcgatgtttgattattcccctgtaggtgatctattgtttccacccttagggctgcctttgagatttttctttgtatctttggtgtacagaagtttgaatacagtgcctacatgtgattttctttgcatatttttgtgttttttctcagcaaattttggacattttcagctatgatttcctcaaatatcatttctgtcccattttctcatctgccacccacaatctgctgttaagattctccaacaaatcattttttatttcagattctgtactttaacctttggttctttttagtaatttcatttcttttttcttcttctgagacatgcaaagtatagtggactggttgatattgttgtacagatcactctgcacatttttgaatcctttttctctctgttctttacattaataatttctattgacctgtattcaagtttactgacactttcttctgccatctacaatctattgttaagccacttcaatgactcttcaaaaaaatttcaggtattataccttaactttttacttatttttgaaaattttcatttctctgcttattttctcatctgttccctcattatgactatatatatacatatatttttagagacagggtctcactctgttgcccaggctagagtgcagtggagcaatctcggctcactgcaacctccacctcctgggttcaagctatctattctcatgcctcagccttctgagtagctgggattataagcatacgccaccacatctggtggattataggcgtgagctaccgcaccgggcctgaaaacatatttttttaaaatcctgaatatatttataatttctgctttaaagtccttgtctacaacttctgaatcatcgaggaatctatttccatggactttaaaaaaaaattacatgtcacatttttctgtatccatcactggtaatttttgaattacagttgaacattgtgcatgatatttatacaaactctgggtttggttatctttctctaatgcaatgcatttttcttctagcaggttattaaattactagtcgaccactttgatttgaagaggactggttttattatttgacagaaactttcaatgcttcaggtttgtctctctttctataattaatttcttagttcttagctatcatctatatttctaaggtttgatccttctgggattcataaagcctgagacatttaccaaacccttctaactttgtaaactcaaactcctaactttgtctcctcttcatctaatgtatctgttcagctcttttagctttctagttgttgcttttctccaggcacttataggctcccacatacatgcacagtttatatcagccagaatgttagggtaacttatatgtagattcatgggagccttccctcgatggctccatcctttctaatacttccttcctcaatttcagctactttgccaatgccagctccattcgctaacatcacaaaccaataagattgtggttttctgcctgaattctaacttctctataccatacagactgggaagttccttgagggaagaagctgtaacaaacgtgaattttacccgggacagttcactccagattccaactgcttttggtcactctccggtgccttcaaataattgtggtgttttttttttaagtttttaattggagtttagttttatttttaacccataccatggtttggaactgttatctgtggaaatatttgtcctgaaacagtacaagttactcctttattaccaaaatcacaactaccaaaattgtggttttatgttagatagcacttgaactgatatggaaaactgcattagaatcaaagtgtctatagggcttcctctctcaatattcagtattttaaaattgagacaagactattttttaaccttaaaaaaatcactcatagtgccctaggaaagtgctatatattccactcagtcgctaaatatggccaatgaatatttctataattaaatttagcagaataatctgtgaataaaatgaaacagacctgtatgtaaagaaaactaccttaatgaacttgcttgggagatcagtggtatgtgatatttctaatcatgacagagaagttgaacatgtggtacagttgtgtagggaaaatggataactcttatcttcattattttttaagtcattctaagagaagcatttgctaagtagtttatatatatgaacttatataattttcataacaatttttaaaaatagtattgtaacattattttgtagatcacaaaactacaaagtatcccaggccatcagactccagagttaaattccaaccattccctctaactacctgctcagaattgagataaaactcatccacagcagtcatcattttttctaagaatatacatcacctattaatgttctttcccatctcccatgttaacaactttcttcctctatcatgtaaacttgctctctatcatctccgtgcctttcttgttcattttcatggagcagccataaaatggagaataacaattgaagcagtgaatagccaagaagcatctctcaatcaatgaacctgagacagcctgttcacttctgtccatcattcttgtcctttagatctcagtttcaaattcatttcttctagacattcatctcttcccatgtttaatctggaaccatctacccttccaccagaccaattatcctggcaaattaatgtaatagaccagtattaattatttgcttgtatgtcttaacaacattctaggtgctgtgccaaaaacaaatgaatagcaacacaaggtcttctggttacaagcacattacattttggttggggagattttgacccatctcacagtcataatcttcatccaggttatctcgtcaacctctatgtatgcatatattccaatattttgttttgcttttctttcttccttgtagtaatttcacacagactattcgcttcaagaacctaactaacttcctgttggtacccaatcctttaactctagagggtcaaatggagccctgtggctcctggcagtgttcctgaagatcaggtccctctggtggaactcagttctcactgccttatctaaccttcctcactcagcttgtaatcaacttaacttttaaagtctttgtacacattaggtaatatttgttctctgaactcccagaggggctgtggtaactgcccaactaggaagccctacccttcattattcagcaacagcttgaagaatattctaattctaactttccgccctctgacagaccagctgcatcaaaggctgtgttcccctgtttgtttttttcctgaagcagagtcaccatttcaaactaagtaatctatgagaaaagtaagagctctgggtccaaatgtttaaaacatggctcttctgtgaaccacggcaaatctaaactggattatgccttatgctggagtcagaacttacttggtcccttgttctttgccctctggctccctgcatgctgttcaggggaagttactggcttttgaactggcggtttgaaaacgaaggcatttttcttttagggagaacagtctttcagtgatttaaacaacaagccttgtgatcaaaataattcataaaggaaaagatttatgaagtgacttcactagcacacaatgcattttaaaaactttgttttttaaataaatctgtcagtacagaagccaagacaacacatctgaatgcaatatcagtggacacaccctgaatctcttcttctttgcttgtccaagactgtggtagaaaagggaaatgattctctttgtcttttcttatttaatattattattaaaaattttttaaaaattctagttccatgaaaagactttgaaaaattgtgcctacttttgtttcctgcaggaaaacctgccttgtaaaaatgtattttccattgaccacttgtgcttgtttaagaaaataaaaaataaataaagaactccaacttataatgaatacctctggcattagggagcctgttctaatctccctttatcaagtttgagtgatagttctgctcaacgagtattgacagggccgtcctgtttctcaggctttcgtttccctcggttggagaaggatacagtgcattttcacattctcaaagtctgcagttgtttttatataagaagcaatttgcttgggtcacgtcaggtcgaatgggatgcctgcccagctcttggttttaaaggaaaaacatacagaaagacacaaaaacacagcagtttccttcattaaattccactctacctgccatgggcttctagccacaatggaatttcccaccctggcctagcctagcctaacttttatttttagggattttttttcccctttaaatcttatgagctttctttcaagtgaactttgaggtaaggattattaaatgatagagtaattgcctggttaaaaaagaatcagacataaaaaacaaatgcctagtgaccttccataatatcgctggataaccaccccctggataacagcctttcaaaaactgttcataatcagcacaacaagacaggtcatgtaatttaaaattaaaacctgaatcatttaatgaatagggatcagcatttttttcaatagtaccctcttcttacctaattgcattggatgaagataattttggagaagaaaatgaataaatgaaaacacaaggaactagataaatagatggggcgggtggatggggggtggagagagagacagcaagtgagagagagaagcttttggacctctctctccaaaaagccatttatgcttttccccattgcctaggggcaactgatttaatcaggattgttcatgtggattatctaaactatgaaaagcaacagggagcacttcccaagaaatccagactgggtgtgctgcagaatacttggtttggggcctggagctaagtagactgttcacattgtactcagggtcctaagaaaagtggctcagtgtctctgtaattctttgtccctttgatctacctcaacatttggtgtctcttggcattaggaaagctcacgaaaatgaccctgcctagttaacagattcatagtctgggcacacaaaaaaagggtaagaaagaaaaaaagctttggtaatgagggagagaaacgtaccttcttgctatctttgctgggcataaataaaaatcgaaagatgtgatttttggagatgtgaatcccgttcttcccatatttagtaatagccttttcagagccaattcaagaccttctatcaaccacctctgttaaacatatcaagttagatttctcattcattattttcaagctggattttgcataatcttccttcaaatgaagaagtttacttttcgaacatgtcatttgctcttagcactgttgttctccttcacccattttggcttcttatcctcaaatccctgattccttattaaagtggattgttaatgcagccattctttagcaccacagcacatttataaatcaaaaattagtttactctgcctggcttccaaaaccatttgctgcttgaaaccatttcatgagtttgtctactcatgtgaataaataaaaacttgcctataatgtgactttgggaaaggaaagagcaactatatgaaacgaattctacagaggccaaaattattttcacgagtttcatggattcagcccttgcatgtgccattctacattaactttatctctgagattaggattttgcttctctttttttttttaattatactttaagttttaggctacatgtgcacattgtgcaggttagttacatatgtatacatgtgccatgctggtgcactgcacccactaactcgtcatctagccttaggtatatctcccaatgctatccctcccccctccccccaccccaccacagtccccagagtgtggtattccccttcatgtgtccatgtgatctcattgttcaattcccacctatgagtgagaatatacggtgtttggttttttgttcttgcgatagtttactgagaatgatgatttccaatttcatccatgtccctacaaaggatacgaactcatcattttttatggctgcatagtattccatggtgtatatatgccacattttcttaatccagtctatcattgttggacatttgggttggttccaagtctttgctattgtgaataatgccgcaataaacatacatgtgcatgtgtctttatagcagcatgatttatagtcctttgggtatatacccagtaatgggatggctgggtcaaatggtatttctagttctagatccctgaggaatcgccacactcacttccacaatggttgaactagtttacagtcccaccaacagtgtaaaagtgttcctatttctccacatcctctccagcacctgttgtttcctgactttttaatgattgccattctaactggtgtgagatgatatctcatagtggttttgatttgcatttctctgatggccagtgatgatgagcattttttcatgtgttttttggctgcataaatgtcttcttttgagaagtgtctgttcatgtccttcgcccactttttgatggggttgtttgtttttttcttgtaaatttgtttgagttcattgtagattctggatattagccatgagtaggttgtgaaaattttctcccatgttgtaggttgcctgttcactctgatggtagtttcttttgctgtgcagaagctctttagtttaatctacgtctgattggtgtacctgaaagtgatgtggagaatggaaccaagttggaaaacactctgcaggatattatccaggagaacttccccaatctagcaaggcaggccaacgttcagattcaggaaatacagagaacgccacaaagatactcctcgagaagagcaactccaagacacacaattgtcagattcaccaaagttgaaatgaaggaaaaaatgttaagggcagccagagagaaaggtcgggttaccctcaaagggaagcccatcagactaacagcggatctctcggcagaaaccctacaagccagaagagagtgggggccaatattcaacattcttaaagaaaagaattttcaacccagaatttcatatccagccaaactatgcttcataagtgaaggagaaataaaatactttacagacaagcaaatgctgagagattttgtcaccaccaagcctgccctaaaagagctcctgaaggaagcgctaaacatggaaaggaacaaccggtaccagccgctgcaaaatcatgccaaaatgtaaagaccatcgagactaggaagaaactgcatcaactaacgagcaaaatcaccagctaacatcataatgacaggatcaaatccacacataacaatattaactttaaatgtaaatggactaaattctccaattaaaagacacagactggcaagttggataaagagtcaagacccatcagtgtgctatattcaggaaacccatctcacgtgcagagacacacataggctcaaaataaaaggatggaggaagatctaccaagcaaatggaaaactaaaaaaggcaggggttgcaatcctagtctctgataaaacagactttaaaccaacaaagatcaaaagagataaagaaggccattacataatggtaaagggatcaattcaacaagaggagctaactatcctaaatatatatgcacccaatacaggagcacccagattcataaagcaagtcctgagtgacctacaaagagacttagactcccacacattaataatgggagactttaacaccccactgtcaacattagacagatcaacgagacaggattttgcttcttaagtagatgtcatttttctccagtaaaaccaagtggtttaccctgacatttagtagtaatttagtgatttcagagttccttctaaatctaaagtaaatgttcatgagactcatgaacttgtatctagacaattaatctgagcattttaagacttccctgaggctacatataatctctcacaaccccttgcaaaacctgagattttgaaccactgtcaagtttgtggttgccctggtaaggagtaaagcaaaatcattacttatggcaactaccacacaaacattgtagtgaactgaagtataagaaaatcactactatactttagacagaacattaggattaatgctggtaaccaaggaactaagagcctgtaaatataactggcttaagaaggagaacaggattaaacaatattggagtttagaaacaaaagtagtactgtatcaacctgtcactatgcagccagtcattacaataaaactaaccaaaggatggcggcagaaagaaataaaagtatttttgtgtacaattcttcttgaagcactacttgaattgcatctgtagggaacaggtctcataggtctattatttgcccacctccccaacacacacacacacacacacacacgtactagcctaggccgatatctactgtggtaagtttgcatctgtgagccactgagcagctgctttatatatgcagcataggatgaaagagagaaaactggggtactcatggtttttgtgtaatatcacaaagaaaagaaaacaaaaaaaggcttagagaaagttaaaggaaaatgggcagtggtacatatacagaacaagttaggattccctaggaactggtaataggactaaacttgcttaacatctatcaaaatgacttacttattccagggtcttgcatatacatagcagaagcacaattaatttttgctgaatgaataatctggaacaaggaatgtaaaataaattatccaaaaatgttgatggaatgaaacttttctgagcaaggaaaagctaaactgatggaacacaatatttatccaggtgtgcagaaaggtgccagtgcaaatagagaaaaacaaaatattcaaatacagtcgtttgccgtgtaatgacattttggtcaacaatgaaccacatatatctataccatggtggtcccatagattataatactgtatttttgctgtaccttttctatgtttagatatgtttacatatgtaaatacttaccatctactctgttacaattgcctacagtattcagttcagtaacatactgtacaggtttataaggtttatggcctaggagcaataagttatactatatagcctatatgttagtagtatataccatctaggtttgtttaagtacactctatgatgtttccacaatgatgaaattgcctaaggatgcatttctcagattgtatccccatcatcaagtgatgcatgtctagtttaattataagtcttacctaggaaagggacttaaaggctatgagctctttcaggcaaaaaggccttcaaaattttggcactcattaagtaaagtaatgaaaataaggtttataattcccttatattaaaccctctgcaattatgtgaaactatctgtacttcaaatgccatgttcctataacataacaactcagggtgtcttacacaggacagtcattaaagagtttaaggtagattaaaataatctgcattagtagagaacaaattattttgcggtattataacaattcattgaacatgagaaaaagcaaacaaacacgcttgttaataaatgttacttaacagacatcacactgacatttcttagtgactgactgccatggaagctttctaataagtctaatttttcccacgctctgagtttataagatagcaatattgtagctttgggtgtttacctttgtttatttattgggcggagttttattgcgtgcctcctccagctgtgccaatctggtaagatcaaatggaatcctttagctattgtcactatcctaaatggaccgcatgcttcctttgtcccttgcattctctgattttcgctgggggttatctatcatggctgtacatccaagtctctaatctatctcctttctcatccgtttttcctgacttatttcccttttccctttgtctatttccctgtgagaagccaaaagactgtatagttcttagtagcggtagtagtgctatctagagttggcatccaacagcaccagtgttataatacactttctacaatcaagaaatgatttgatttccttgcctcagtagaaattttacaagttaacagtggttcacctgatataaaccataatatttctatcatatcatgaaagaattctaaaaaatctgttagactttcttctacaagtttgcctatttcctctgaatacagttaattcacctggcaacaaaggagattagctatttctttttgtatgcagacagaaagaagtgtgatctttctttgccaataaaaacttctagtaagtggtgatagacttcaaaacccttctttttatttgaaaatcatggttcagttatcaggaattccaaattcagaatctaagaacagtgatcctatatagtcttgtgattttgcacatgctagggattggtaagttgctgaagacttcttaaataagagaggaagcatttttcttttcacttgcaaagaaccaggaggtacattaaaagaggttttagagtaactagaatgtgtgataaactgttcactttctgttttaaaactgtccatgaggttccctttagagataggacagactacagagaacgtggtgtctcgtttctatgggttgaaattccacagaacaatgctttgcaaagagtcataccaccagttccttttcctgtgagatgcaaatactaaaaacagatatgggctggacaagattattttaaaaatagatagaaggcaataaaagctttggtgatattctagattacatatgaaatgtgtaaaagcgtaaaatgaaaagttctctactttttaaaagctgcatcaaaatttccttcctacactgtaatcgtgccccttaacccatctatgcctgaggttgcaatttctttgaatttctgcaatcagaccatggcgatgaccttgagcagtaggatataaataactcctccatgcttagcgttccaataatggaacactaggcataaatgggataaaacacaaattgctaggttcatgataaacagagcacatctgtaaacaaaataacttttaaaaaatatgcctacatatataattttattacttctagaaacacaagtgttattagacttaaagagagccagtgaattgaatcaacttattctgatatgaacctcaatgtgatctgattgcaggctgcaatgattaacacgttttaaaagaaatgggtccatactatactttccaactgcccacccttctgttcttcttatgctacagatttatggcagcctaacctccagccaacaagttagagaattgggtaagacatcattttggctttttaagaaaattatggataatcaaaaaacatgacacaaaagatttagtggctattatcagggtataaactaataactaaaggcatttatgtgttaggtaataatgatgcttagaaaattataaatatcaagatgctctttcaacaactatattccagatttaggaattttgtagaggatatggcataagagtgttaagaaatgtatacttttttgaaaataaaataaagtctgatttatttattatccaagttcctgtgttttctgggaaaaatgtattaatgagaggtagcattatttgatagttaatggagagtggaaatcatctgttacaggcccacatgctcacaagcaaaataatattctctcaatcctcaaatggaaatggggattataaaatgctataagactctgtcaacatttctgataaattccatgaaaattttgtgttacatattttaaaaattgtgtactatgattataacatagttgattattaaatatgtaatcctttctttcagattattcttcttccttaaatgtaaagggtatattattttcttgatttattcttttggataaatatcctgtacatagatgtctgaaatccagcccgtcagtttccctttaaattctagcatattttaaaggaccttaaaagatgactgtggagtactgcctgatttggaacttgcctctgtctcttacacactgtatgacgttgggcaagccacttaacttctcagtacttcagtttcatcatcagtcagaacagcacaataatagtaccctgctcctatggttactatgaggattagtgggtttcatactgtcaataataagttgcctttctgggtctttgaagtacttgaaatcaggttaattaaattaagcagagctttggtccctttgtttgacaagtaatctccaattttcatttccaggttctgatcccctaaaatcagtggaataaaaccttgtttgtgtaactgccatcttcctgccccaaagccaagattaatttacctgttggttttagttttcactaggtctctctttagctaggtgcttctaagggtaaaatatcaactattaaactatttgaggcaggagatgttgaaaggggaatttaattgttaagtcaatagcagtgtgccagcttagtctgcctttcagaaagatcaccatagtaataacgagaccaataaataaataaaaagtataaaatatacatctatgcagaatcttagaaccctttctctaacacataagtcattaaaggaagctctgaggtctgcctatgtgattcaacatttacacacatcatagttctatggaagaaattctcagttgagagctaccagctttcttcagatcggatcagatttttctatactccattataaacaacaaaaacaaaagcaaacaagtgaacaacaacaacaaaactgtagttgtggttcactccagtaatatatactaccaattcagtggttcttaactgggggacaattttgccacccccttccccaccaggggagaactggcaacatctggagacaattttgataatccaaactgaggggtgctccaatggggagaggtcagaaataccactaaacatcctacagtgcacagaacagacatctaccctgcatcccggcaaagaattatctactccaaagtatcatagtgccactgttgaaaaaccctgtgctaaactaacatctgagagccactggccttaaaccatcagccacatcaacacgtaagacactcagcctatgggatagtctaacagttaaagaagacaccttagagggaactacttcaaaaatatataaactgacaaatctggataccatactaaggaaaaaactggtaaaacaggtagttgtttgaaagcttcttatgcccattattataaaccaataattttagattactgaaccaaccagactaatattccctttgaattccaggaggtataaaaatatgaagtcatcgactatgcaacattatcctgctatggagacattctgaaatggtttataaaagcagtgaacacattaaaaaaaaaaaaactagcccaaatgagttatgcaaagttaaagtcattttttctaggaccagttttttttcctgtgcatagtattttccatatgtaccgcaaacattcatttgtgcagaacatagcaccacatttctaatacaactcctctctgaagacaaatcaggctaaagctaagagttgcagaaccatttctgtatgagtcatttttagcacaacataagccctagagtaaaatttattttctaaataagccacaattattctgcaaacatttaacctagcacctctcaactgttaaagaatgtcaattatatatgaaaggaagaacaaatataaaggaaatttgaaaatcaagaaaattttttctgagaaaagtttgtgagaattattatgaatacagctaaaattcaaatatgtgacattttatttttttaagggtttccctgtcaaagacaacacatatttttctaatgaaagaggatgcctgaagttgacattcataagagcatttggatactaccaatgtgaagttgtacagatttactcatttctgcaattaccctcttgtgtttgaattctactttggttagtggtagcaagcactaaactgtactgagggcttcgcaaaagttgactttatttctttacacttagaaccccaaaaatttacttcctaggaagatactagggaatcatatcttactgaggaggaaataagaggtggaataactggattagcctcacaaagaatgaaagctcagtaatttctgagttggcaatatttttcaccctccttttctccatttaaatttctagatttaccttcaaaacacttgcctttttctaccttaagggaagttctaggatcagggagatggagatagagaaggtagagatagttttaggttttcacagaagttcaattaaaaactgccaagtacctcctaccaagagaccaccactaaaatttatttctagaacaaggtgcagaaaaataaaaggtagaaagcaggaatgttctggtactgtaaaatatttggggaaaaagtctaatttctgttctcaaaatggttactatcttgctctagagaaaaacataaaccctcttaaaataactgaagaacaataagaaacagtataattaagtgtaaaaatgggtggtagaagcaaaatgctgtggggcacccatgtgtcttacatctttccaacacagagaaaagagacaatgggtcaaatgcagcctactctagtctctgatattagtttcattacacagctataatcccattacaaagaacttgaaggaactgttgacattttttgctgccctggagtttattgtctcaagtattgcttgaaataccagggtacatgcagagatgtctgctctaatggtatttgttgacctacattatgttagggttagcctgaataaatggagaggaacgctacatggaatcagttagttagattgtttgtaagtaggcgtgcattatttttaccatgttttattatttttaacctaaagactacgcatttaaagtagggtattatctgtaagtaatcttgttgttatatgaaacagtaatatttattaaaagtgcttttgtaaagcccaaaaaggggatctgcagaggcagatttactgcatatttaatggagcttaaacctcagggaccttcacttgcgcagccccccttccaaggtcctgtacttaactctgtaatcataattttgtattctttttcttcaagaggaccccccaaatagtttaagcttctggtaaaatcttgatctagcctaggtataaaataatcttgaagggatccaaactgatagttctaaaaggctgatgctgagaaagatacaaaatgtgcttttacaaggatatcatatcaattatattttccaaatgtatctctcttattgttgtcgctcccccttccctgccaataaataaatgccattttttttttttacctcactgttaaaaggttattagacccttttaaataagatcggtctgttcagtgactgggaataaccagagtgttaaaaaaaagatgaaaaattcagaggcagaagataatttccaagaatgaaaagatatcttagagagactcacaaaatgtttcactaaaacagcaataattattatccatacctaaggagtacatgcatttgagaaaaggaagggcatggaaagtctctcaatacaatttacagtagtacctactgaaaactgtgctgagtttacacagagtgtgggaatttttaccaccagtaacaccacgtgtctgtttttctggtttctgaaaaccccaaataaatcccacaagcgcctctaaactccaccatggaattctcacacttctgagtaagaagttcagaacagaataaaaactttggatgcagtatgtctgtctatagtttttcctataatgccttgtcccagtttttgaagaaaactgaataaaaattaattcaagaaaaaaaatgaatgaaattacctcaaatggaatattaaattgaaaaataatagtcaaattgctcataaccacttcctgttaattttttttctcttttagaaatggagtaagaatgcttcaaataaaaaacgtaaaacccatcccatcccataaagggcccactcacgtaaacaggaagcttattaaaagaacttttcttggtttcctggcaaaatccagcttttattttggtggcagcatctattaaggaggagactcattttgtgggcaggatgaaaaattaaacattgcaaatccatcaggtacttgctggattagagttagttgactgacttgttggctacagggaacaaggtagttctgaaaccaaggaacaagctgccaaggaacagtccagccctgcccaaaagatgatggtcttctccatccaggcagcacaaatcaactcgaggttccaagagggccagtagacgccagcctaccttactgtaaagtgtctcacatgcatatctaactgttctctcctttcctttacatttaaatcctgttgtattggcttctctgttttccctttcctggaagcgctgtagcgtaattaaaagagtatgagttttggaatttcaaaacttggtttatagtccagcctctgccaaatactgtgacatgttacctgcttgagccatcattttctgatatgtagattgggactaacaattcttccttaatcagctcaagtttcacaaaatatgggtaaacatcacgtgactcaaaatcaactgaggcaaaaattcagatgtcaatggccctttcttgacttattagaacctccatgagctagaaattcttggaatctgaattttaaactcactcccaagtgatttccatacacacagaagtttgagaaccacatcccaccttgtcttgtgtcaggattaaataaaaccatataggtgaaacttatctgtaaattgcatatcaagacatgcttagctgctctcaatagtatcattttccagatagcccaaagcaccaaagtaaggacagcgggccattttcccaagatctttcttccagcttttccctgccatgccaacagcattcttcatcttcaggtaggcagggcaggttcactgggggttggggtagagctcagcactgtgacacaggcagtacttccgtagaatttcatttatgtgactgtacctaccccacagggtgatataaggattaattcctatttggtaatttactgtgtgtaaaatgccttgagccccttggaggaaagtgctatataaatgtaaaataattattataataataataacctcgactatttaactgatcagtgaattagccagaagatttaggctgccaagggacaaggctgaaaccattataagtagaaacactttacatcatcatatctcaaactgttatcacgaaaaagggaaacaaagggtgaaaattaagataaatccatgttctcaactgatttaaatgacagaggatcactagtaatgattcatgaaagccaggaaatgcaaaaatgacagctgcattgtaattctaactcagccacatgtcctgaggttttgtacactttggtcttttatttgtagggaaaatatctcatcagtgcaacatctaaaatttagcattatgaaggcacttgactatgcttttgcttagttgaaatacgttcataatgtatcccctatttgtaggtaatgatttttctacctaaaaagcattgacattattctatgaagttccaggtaaattttgaatcggttgcttacaatctgcctccccacatacacaccctaagaatacactctaacaaaacaatggtgtatttctagatctaaatttaggaaaccaaaatatatagaagataccttttcttcccaggaagaaaatgctttggtatataaactcacatgagctcaaccgtcttcagctcttacattatttgttttatttatttattagattcatgaagattcttctaccaaaagctcaaggggctgaacccagaactttcatatattgaatgtgaatcacttcttaaaccacagaaaggaaaataaagggctatagaaatcttaatgggcaagctccagatgctcaaaagcaattgtttagttactctacttagttatgcatcattcaaaacactttctaacaatcgggcaagaaaggttcctttgtgaagaacaggctttggggtcttggacaagttttaattctagttgttttatagctcatacaaaatagttgtggtgcatatgtaaagaggtactgtacttacatgcaataaagtttgcagatgaatattttgaaaatcaaagaaaagaaaacaaggggaggaatgagcatgtggtaccttgctctatttttaattattaacttgtagcctcaaagatttccatttagtagaaacacatgtaaactacaatgaaggagtactagaaaataaagtcaattggtataactcaaattattttgtaaaatgtgaaattaagctttaacctgtctatgtggaagggtgatgaataaatgaatgaatgaagtaaaaaatcaaagatacagagttgtaactgattttctttgcatgaagtagtaaatattaatattagaaatatcttttgatttagataaaactggccttgggtatataatacacaacactgaaaaacatttcaaatgtggtatttgtttaaatatatacatacataaacacacacatacacacacaagtcaaaaatatgggtgttctggtatagttttctgccttcaaagggtctctggaaaaaacagaagaaaaggtatcctataaactgcttttgctgaggtctctagtagagagcaaatcgaggcaagtgctgcccaaaataatctctattacaaacatttaaaaaatctatctttcatatatatatatgaatatatattatatatattatatatatacacaatatttttaatttttaattttattttatttgctgtatagctaacagcatagccaatgccctgatcttctagccacactgtaatttcttgtccttgcatcacaaccccagctgtagtcatcaaagtggaaaaactgacagcattgtctgaaagacacagcttgggaaaattgctccttgtagctcccctgtcaatgaatattatcatatttttctcatggataaggttactgtgttttttttgctgggccgggggtggggaggcttctacatacttagctactaagcacattaccattccgtttgtggaatggactaaacgtgacaatgcgagctgtagggttagcattcccaacattctgttttaaagtttttgtgtgtatatcttcaaaaataatattcctttatgtattcagaagaagtaaaatcacaattatattttacttgacattactattttcttaaggaggctaacagaaaaatcaatgggtgggcataaagagaaagaaatcatatgaggctaccacacatattctgttactgaatttctttcacctaaatatacaatggaatgctctgaattgtatgttttcttttcccatcatattaaactaaagcaaagttcttgggctgaaagtagaaaaactgcactttagtgttctaatgatccacacctttcacatattcacttcgcttacaattctagatgctaactcaataagaaagaaagaaacaaattcagagtatttcagtcaccaacaacaacagcagtaacaataacaataatattaatatcagttaatatttatttaactcttagatatactagatgccattgtaatcacatgtattaactcgctaaatcttcacaactctaccagagagtactgttattactccgattttattggtgaggaaatagaggcacagagagatcagaaacttgcccaagatcacacagtcagtaagtagaggagtcaggattcaaacctaggaagccagactctgttacaggatgaatattttggttgctaaaggccccatcttccttacttctcctgatcctcttccccaactgatcagcttgcagcattcatttgatcttctcaacaaattacgtattcatttgcacaccgtccatttagaataacacagtagttaaaaacttaggctctggagtctaatatgagggtttactgccacatattggtagtgcttaacttttctgtgcctcagtttccttctgtataaagtagtaataataaaagcaatttcatgtatttgttgtgagggttaaatgagataatgtatgttggagctcaatggaaggtcaatgttctataaacattaagttcattattattgatttttatctcttaataaatagaatccctttttccaattagattgtttttcagaaaaattgtgaatatgaatcttttttgtctcgtgtaggggttcccaaatgttcagtatgttgaactcttagatgtcctaggtactactgaaatcacgtgtattaacattcataacaactctgtcaggtaatacttacatttacccataatattataaatgatataatataccaatgtctaaaatttagtgagaacttactcactggacaagtgcattatggcattatctcattctccctctaagcctctgaactaggggatttttttttttttttttttttggagatggagtgtcactctgtcgccaggctggagtgcagtggcacgatctgggctcactgcaatgtccgactccctggttcaagcgattctcctgcctcagcctcctgagtagctgggattacaggtgtgcaacaccacgcccagctaatttttgtatctttagtagagacggggtttcaccctgttggccaggatggtcttgatctcctgacctcgtgatgcctgcctcggcctcccaaagtgctgggattacaggtgtgagccactgtgcccagccaactaggggatttttataatctcaagtttatgcaggaggaaacagaagctcacctcggtcatcagctggtaaatgttcacaaatgtaaattcttaaccacaatgccatactacctgctaaaaaatgaatttaaggtagatctttagtaaatatatttggtcttgatgatgaatcaattgaattctttatttctgttaccagaaaccttgcacttaacaataaactaatgtggccttgaccagcagccgccagtccccaggcttcagacactggtacctgttaggaacttagctgtacgggaggagatgaacagtggacaagcaagcattactgcctgagctctgcctactgtcagatcagcagcagcattagattctcattggagcacaaaccctactgtgaactgtgtatgcgagggattgagtctgcacactccttatgagaatctaatgcctgatgatctgaggtggaacagtttcatcctgaaaccatccccacacctccagtccatggaaacattgtcttccatgaaactggtccctggtggcaaaaacgttggtggctgctggcccagacaatatcactcattctgttaactattgaaaagagatgactgtatgtcaggtacatgccaaatactggaaatttgaaaaatatatatatatacattgtgggtctaaaactgtatcattaaaagcagctaatgatttaatatcatttcatttactatcattttctgtttactcttacaaaaatcaaacttcttcctctccccttcctctctctgcctactctttcttattccttcttttaaatcaaagttttacagtattaaccttacaaagatttttgcccataagaaggttatatgttaaggcaaggaactgttttaattatatttactcttcattttgagtatatttctttttcatacctgacaaagacttttgaaatgactaaagaaaggcaaagcaatctgattctttataaaaaaatctttcatatgcaatcttttgtctgtagtattctcataatagcttagaaattttaaaagaaggttttagctggttttgttcttttcaaattggcagaatttgatttttttcctcttcacatttggattcactttaaaaatcaacaaacaagaaaataaaaacatattcaatttaaaaaatatgctctccattggtgccttggcatcatcaaccaatatcagcatcactctgaaaaccatttctattctgtttttaaaaaaaagagttttaaaatgcacacataaaatgcacttaaaattgatcctactgtattaaggagagagaaaatttaagggcaatggagagctttgctgtaaccaactcttcagtcaactataggatattgttaatactgccttcacctccacactgaagatataggtaccattttgactgtgcttttgaacaatatatagctaaagatttgaagtgagtaacttcaaagtcagtagttttcatgtatacgtcgcagaatcactgcatcttatgtatgactttaagttgtattaagctgataatttcaaaaagagagactttcaatgaaagaaaattcctgaaatttggtcattaaatggttcgagtacgtagaattacttacaatgtaatgccaaagaaaggtatattgtatttatccagaaagcacgagcataagaatgacctcagaaagttattataatttattacttcattaaagatacatttctagtccatctattatgtgctaggccttataatagacaacaaaaatgcaaagaacaacaaatgtgatctgaaaagtagtaaaggttagggaagatgggactagtaagagagaacagaagtaagaaaataaagtgattataattgtaactgccatgagctgagggcatatcatgcattgaggtaaggtcctaggtgcttaatatgaacaagccctgcaagacaggtatcataatctttgtctcacaggtggtgttgggaaaactggctagtcatatgcagaaaaatgaaactggaccccttccttacaccttatacaaaaattaattcaagatggattaaagacttaaatgtaagacctaaaaccataaaaaccctagaagaaaacctaggcaataccattcaggacacaggcatgggcaaagacttcatgactaaaacaccaaaggcaatggcaacaaaaacccaaaattgacaaatgggatctaattaaactaaagagctcctgcacagcaaaagaaactatcatcagagtaaacaggcaacctacaaaatgggagaaaatgtttgccatctatccatgtgacaaagggctaatatctagaatctacaaggaacttaaacaaatttacaagaataaaacaaataaccccatcaaaaagtgggcaaagatatgaacagacacgtctcaaaagaagataattatgcggccaaaaaacatatgaaaaaaacctcatcatcactggtcaatagagaaatgcaaatcaaaatcacaataagatactatctcacgccagttagaatggcaatcattaaaaagtcaggaaacaacagatgctggaaaggatggggagaaataggaatgcttttacactgtttgtgggaatgtaaatatagttcaatgattgtggaagatagtgtggtgattcctcaaggatctagaatcagaaataccatttgacccagcaatcccattactgggtatatacccaaaaaaattataaatcattctactataaagactcatgcacacatatgtttattgcagcactattcacaatgtcaaaaacttggaaccgacccaaatgcccatcaatgattgactggataaagaaaatgtagcacatatacacatggaatactatgcagccataaaaaaggatgacatcatgtcccttgcagggacatggatgaagctggaaaccatcattctcagcaaactaacacaggaacagaaaaccaaacaccacatgttctcactcatacatgggagctgaacaatgagaatacatgaacacagcgaggggaacattacacaccagggcctatctgggggtctacggctaggggagggatagcattaggacaaatacctaatgtagatgttgggttgatgggtgcagcaaaccaccatggcatgtgtatacctatgtaataaacctgtatattctgcacatgtaccccagaacttaaagtataacttaaaagtttttttaaaaaatatgtgataaaataaaaaaaagaattaaccacagtgccttgcctattcttctataacagtatctatttcactctattttattttgaagctatttatctccaagtttctttctagaatctaaacagttaacagcctgagggcattgaccttgactcttgtctaagttttacaaacaaacaaaccaaaaagcacactgcattgatatacttggccaagtaatgatgtccaaatgctacaatgtcacaaccagtgctcagtaactattagataaataagatagagtcattcactcaatcattcactcctgcatgtttcacttagtaatcttgtacgctcattgaataaattaaaagctgctttatgaaaatgttttctgttaatttgaataaaaacctttacacatcaactagatacaaaagagaaatctattgtttgacaatgatcgttactgaatcaaaaaacagtggggccatctgcagggtacagatcatgctagagtcagggaaaactggtgataaacttcagaaagccaagaaatataccagcttacaacttagcagcactgcctccacacagtcttcaggtatttattgactgtctcacactaatgcatgagtgcctgtggtaatggtaaaagtatataaatttacttgcccagagatactaattgttaaaacaaatacaacaatttaatggcaatgcaagagaagacagactaacatttacaaagctatttcttgtttaggcaagatagtagactctaaacatatattatctcatttaaattatcatttaaaaacccttagattgttagtatttacccattttaattaaaaacataactgagcgtataatttttttttttttttttttgagacggagtctcactccgtaacccagattgcagtgcagtggtgcgatcttggctcactgcaacctccgtctcccgggtttaagcgatccttctgccttagcctccaaagtagctgggactattaggcgtgtgccaccacgcccggttaatttttgtattgttagtagagttggggttttgccatgttggctaggctggtctcaaactcctgacttcaggtgatccacctcccttggcctcccaaagtgctgggattacaggcgtgagccaccacgcccagcctgtaaatcttgacaaaattcccagaggcaaaattattagaaggctgggagccaggattaaaaaacataaaatccttggcttttccatttatttcacattgcctcttcttagaatccacttctacaccaaagcagttaaaatcaatgtggatttgtattttaatagagggtttatggagtagtgggaaagatagcaaataataactatgtttattgaatactactgttcctaacattttgaacctatccaatcatttaatcctacaacaatcttttggaagtgagtgctattattattattgccactttgtaacagagaaactaagccaaaaagaagataaacatttgaaaagtcataaagctagttagccgctgtgcagctgaacttgacagcctatagcccacagagtttaaccatcatgctatattgcttcattaggttgaaaggttattaaatgaaatggcttaaacaaagttctaagcacatggcatggcacagagtaggtcttcattaaatgttagtttctgttttttctttaatctctaaaattctataataataatacctttattttcaaagtaattctgctttttaaagactttatgacatctgatttaaatttcacaaaaaaaggatggtgaatgtggaataaatcttcacaaaaatgacactgaagattatttaaaggcatagaatgttactcacaacacagatttaagagacaaaagtagaaacagtgttcacagtgttttaccaaaaacaaaaagggtatatatgcacaggaaaaaaaatgattagaaaggtatatccccaaagtttgaaaacaaattacttctagacgattgtggggattttaatcgtcctcttgtaatttatgctacgcacagaattctacaatgccttttgtatgctttctatactaagaaaaaataaaaaagaagagtagtactccttttttgagatcataatactgaggggggagaaaatcagtagaaatgtgtgagatttcaccctcagtgatagagctggaatagaattcgcactcttcatctctaacctactgtgttttatctgacccttattttctattcagtgcttaccataattgatgaattcaaaactaatctatgatgaaaacccctgaaagtgattagagagactgtgattgtaaatgtggtatcaatcactaacacaaaagtcccttataactcatcaggcttcttaagttgtttattcaaaccatttgtttctgagtccaaaccaataatatatgtgatagaccggattactttctctaattcttcactccctctctataatagaactttacatccataaactttaccatatgacttgaatgtaactctcagtagagtatgtgttaatgtgggagatgggatatatatctctgtctcttggctttgagcttggttaagtgacttgctttgactaatgaaatattagtaaacatgaaatgagcagagactttaggtattttctgcgggaacaaattctgtagttgtcaatagtttattctcctagattaaatgtttgataaacttttctaaaagaaggaatttttttttcagagagaaatatagctaacatggaatatcatgtccttttgtacttacctggagccaaagtaaactacttggaaaattaaggtaccttttgctggactattcctcatcctttagtttcttcagtccagactgggacattttggttaaaaaggagtaggcttgtgatgttaaggtgatcatcttggtcaccataccccagaaaaaatctttacatatccatgtcttagacactgaggtacagaaagagagttctgaactttccattccattgtcatttgtgttgtggagtcttattaatctgtctcatggaaggtgggaatcaggctatgaatggacaataattcatggggggcagtcaacagtagagaagaagttgctgcaaattgattaatacaaacaaaccaacctgagtacctggctcattttaggttccctccaaaggcttcagtacaggcagtaacttagaaggtaatctcagagggtaagataataataaggattgacaataataaggattggccaggatctctgagatttacacaaaatggctccagaggtagacattataaagaaatagaggctagaacatctctttttccagctctattcctcctttagttgagagtttccccagggcattaagccctgggggcttaatgtaagccccactctccccatcctagattttttgagatctcccagcattggaaaaggtcctggggcagaaggaaaagcatacttgaggtgggagtctgggttagcagagaacggcttcaggtgcagctgaagggaccatgacagcactgcctgacatctctgagggactatgacaggattctgacagccatatctgctacagaagcctgtaaagacttggggtggggggcagtggtgtataatatactgtgtagtctgatattgcatcctttaaagtatgatctggggaaggttaggctgcatcttctttattaaattatattccaaacaagttgtctcctctgactcctgcatgaagtcagactttgggacagtaaatcctacactgtccagctaagaaaaatgacatgttgttaataggcttaactgattctcttgctatgatggcaagatcagatttttagcagtgcttctgaaaatcctgacactcattcaccaattattttcttctaggagtctaatatgtattcatcttcccatatttcagggaagaaatagttgaacgactttagggagcttttcccaaaatgctgacgcatttttgcagcattttgccataatggggcctattgaaaatttttctgacattctgaattcatagcattaagatttgtggtgttgtttttgtatctggtttgtatttatttttgtttttattaaaatacaggagaaattgggacaggttaagagttgcacctaaatgtatgaagcttgaggtctttgaacataaatgagttagatatacagaaagttattaagacctttaagcattcgtaaacatttcatcattgctgacaatatctatttactttaggtaaccctgcctgagcagctcctgcattgctacaaggatgaaggtggggttatttaaaaatttaccaagctgtgaaagagttttctggagaaaactggtttggggactcagagcataaggataaacaatggatacttttatggttacaggagaggagttgataaacccctcattcctctaatgtaatgtataaaagaaaatattgtattcctggtcctcacaaatggggaggtggtagggtaggtaggttatatgaacacacatgtcttccctttgacaatgagtgggcaggcctttaaaaaaaagtctgaaaaaataaagagccctggggaccatttaggctctatcagtgagttctatcctgagatatcaaatccagttgcacagaatctaaatgtcaatatttacaaagctctttccatcttatatcccgcttcctttttcttttatgctctttctaccccttttccttcctccctattcccttgatcccctacatcattctgttttcccatttgctctcatttcctaacaacccccatccccattagtcagtccaaaatctgttcatcccgctataggcttcagtgatggaaaagaaagggccccaaacaaagccaccatccaagacaaggagctccagagggtggtgaattggtgattgaggtaaagcctggggactgagaatgttcaccgctctggaggttcttagcccgaaaagtgattaggcatcagcaggcttgatagctgtatcaagcctcatgatttcaaagctttcatgagctgacaaggacttgctaatttcaaactttctaaccaattacaatcacaaagaactcaggacaacaatcagtgagcaaaatgaaactgctggagtgaagcagccctcggcaggtttcactcttgtagctctgctacgcaatgtgcagctgggactctgcttcaataagtaaataaaaatacattataaaatacaaacatacacaatggatcccacttgctgtcttgttcccagtaaaggggtatgtaggaacgctgtcttgcattcattcagtccattaatttctgatggtgttaattaaaaacttttgatgctggtttgaatggaaaatacctcaaacagtgtttcctttattgaaacaccaagttccaagtcttggattattaggttaagctctgtcagtagtgagaccaacataaatgcttttcataccgtatgctttgacaaaagagaatagtaataataataaataaataaatgaaaaggaagaagaaataaagtgtttagactgaaaactcctttacttcaccaacctgtttttttaaggactaaactaaaaatccaggtccctgaatgtagaacatataattttaaaaaaatcttttttcaaatctttatagaacattcaaatcacccaatgttccaggacctgaattttttatattttaaaatgaagaaagctgcttaaaataagtgaatcagctgctaagtgatttctctctgtcttttcctctactctctctttaaaaagactggaaaatgcttaaaatggtatatgcaattgatatgtgcagcttaaggagcttaatataattactgaggactcagactttctatttaaaaataagatagggtagggtaacagaaactctgagtggtgagtattcatcccttgtgatggtgaggtgtgggaaatgtttccaaatgtttaatccactgagcaaggtaaagagtgcgaagcagttattcacagaatttggtgtccttctgaaaacctagggaagcctaggaaatccagagaacaactgaggaggatagtatgagagatgctgtgcaggaaacaagcaaataaaatatccatttcttcaatccaatgcttttgtgaagtattaagccaaccaccaaaacattctgattgatttttaagactcttctctaattttattttttaattactcttccctttgtgtattggggtctgaagccttgggcacccattctgagaggtcttgtaaatgtgtctcacatatgcccgtttctcttttgttttctaatatacctttctctatcatttttcatttcccaacctgtttattcacactgtctgcaatgtcatctgaatcctcgaaaaaccacaagactttctctttattccccctgaaggccttcatcactcttgttcttgttttgatctacatatctctaacgagaatgaagttctccataaaggctaagcagtttggcagaacttccttccttccctccctaaccgcaggctgtattgacctcaccctcttggatcagtttgctaaaatggcctccaaactttatgtgatatgatagtgaaccttcaacaacaacaacagcaataacaacaacaacaacaagagcaacaggataacttcagtgtaaggcatgtgagaaaaatacgcagagtaatagaactaaaactccatgagggaaatgggcctgagcaaaccacagcatgggtctttttgttaacaaaatgtatgatttttccccagagtacattgatagaggacatagcctacaaaggaccagtaaatgtaaattaactaacagatatgtagcaaatgaatgcatttaaagatgatttccagctgaaatgtttttttttttttttttctggagaccaagtttttgttaaacttaatccttactctctttcctttccagcagcagaaacatctggtcggttttagattccccttggatttccaacttcaaagggaattataaagaataacaaattcatgtaccggcactaaaaaaaaattagagcagcaggagagaatggtaaaattgtccttatttgactgctagtgacaggcgccacaggcagaactatgagaaaagacaaaggcaagatcaccagttgacaaccagagttcctgcaagagactgaatctttggctacatgcaaatatgcacagggcccttaacaatccatagggagatttacttgcttaaggaaaataaataggtaaataaataaaaggagttgaaaggtaaaaaaaaaaaaaaaaagaaagaaagaaatgagttcatgtttgcctgtcacatagtttgttgaaataataacaaataaaccaataaatgtttattgaaagaatgacctggaaataattttaaagatccacttaaccccttgggttttatttgatttaaagaaaattgtgagagttctgattctacaaagggctggataagtcatccaagaaataatacaggctcttaagagtccactaaacttggatctccaaagttcttaaaagtagtttctgtttctcctttggctccagatccttattatcaaaagatgtgacgagaaatcaaagtcttcttagtggccgggcgcggtgtctcacatctgtaatcccagtactttgggaggccaaggcaggtggatcacttgaggccaggagtttgagacaagcctggacaacatggtgaaaccctgtctctactaaaaatacaaaaattagctgggtatgatggcgcgcatctgtaatcccagctacttgggaggctaaggcacaagaatcacttgaaccggggggacggaggttgcagtgagccaagattgcaccactgcaatccagcctgggtgacaaaatgagactccatctcaaaacaacaacaaaacaacaacaacaaaaaaccaaactaactgttcagtacatgctcagtacttgggtgatgggatcatacataccccaaacctcagcatcacacaatatacccaggtaacaagcctgcacatgtatcctctgaatctaaaataaaagttgaaaaaaaaaaaaaagaaatttgtaactgtgtcaagttgtgtttgacaccactttatagaaatggatttattcttctcctctatcattttcttagcaaaactgaaacacacttctagagtgcaggtcttgatataatcagacatgagaaaatgagaacagttagagaaaatacaattttgccattgtaattacctcttacaaacagcctttcctctttcctgttttatgtgcaatgtgtacagcaacaacaataaaaataaacaaagacatgattaaccgatcaatttgtttctccaaagagagaaatagttaagggctaaagtgcctttcaataattaattataagagtctttaaacttagtattgagaggttacagatttccataccacaaatacattaggttgattcacagagtggccatcaaatacccagaaagcaaattacttttgaccgaaatgtatacatcaacagtacggttaggaatgttttcatagaggaggacagaacatacataaccagttctctatggagcctagcatagtgtcccatggaccaatccacataagataagaccatctacagagcatattcttcatatcacagactctaggtaagaagaaagtattctctaggtaagaggagaaaaataagtgaagatttctttcgttaacacttccaccatgaaaggaatgagctgactacagaaccattttcttgaatatttttgtcttgagtggggtttttatccttccttcaccactctaggtagagcagaatcaccaaagttctctcattacggtaatgtcataaatcccatcctatagcagttgtgcatgatcctgtgttatgcatccaataaagtttattcagaaaatatgtcagcttcattaaacagggatctgatgatctgaacaaaccacttatcttgcttttgtgacatgtattggtatccttaggtctaaaatgaaaatcttggttggtgggggtatctgccaaggattccctgcctcatgtaagcagaatcatctaaccacaattctgagcttaactgggggaaaggaggtggaaggtgtatcgtactagttcgttctaagaaatgtcttatagcttgaggatacgtgaggtcacaaatgtaacaacaactgaactagcaccaagagccaaagaggccaagcataaggaaacctgaagcaagagaaaaaggtgtacgcgtacatacaccaagaagcaaatgctatcattaataataattattgttattacagctattagaatgatgaggcattgatggttcacttgggtgaaatatataatacataagctagaaagaactgtgggtaaacttatggatctttttaaaaggcagtttatattctaggtttatgtgatatgagacacataatttaacaccacatataagaacaggatgctgaaaaaagtgaagaagacttgcagctttaaaatagtataatggctagttcctactggtcttttcttgtgacacctgccttagtcaagccatccgatatagttctaaccttttctgatattttaatgatgatgacaggcccagagtaaaggagacaaaataatcagaagattcagaggggaaaaagaaatggaaagaaaaaaaaagagtttgtattgtttataccatctaatctgacaaattttatatatgctctctgtttgctcaggatagtttattgctaatgttatgactttctcttttttttccatgtgctttgctctaccagttttggctgaaaatattttgtatatgtccatactgtaaaccctcatatttttctagagatttagtgtggtggggaaacttttttttcttccccaagggttaggcacatcaatattctagctactcacttttgaggccaatggaaaatgtgctcctaagattaaatagacctgagtaacacataaattcagtttatactgatgcagtatgttgcatagttacatcctgaatttctgatgcgtgtaatacacctgttggacaacacatcactactgaatagtcactgacctacaattcaaagacagtgagacagcacaagactacagatacaggttctctacagacagcctgatttgtacagagcattcctcatctgtggaactctgtgtgtaaaggatctaggctagccatgggaagctggctcatagagggttctaaatatttttagaataaactagagcaataatacaagcacagagagcaccctttgttatacaatgcataatttctttccccccaaacatgttgtttaaaaatgattcagatttttattatataattcccccttttacatatttctaaatgcctcacatacccatcacatgttttccatgtctgccaataatcttaattaaaaattataaacttttaaagccagtgttacatttgatttaagtagatttgccatatttatctggtattggttggctgtagccagactggagttctaagtaataaggggactatgctttcctttcacctcaggtaagaaattgtattcaacacatgcttaaacccaataataagtataattaatgctgtatagatctggcaggcaaattagcatcctaaatttgagtcaagtaaaaaaagtaccaaaagaaaatagttcccccaagaaacctagccaaatctgtgaaatatttctctaggcaaccaaattgccctgtggcttacagatgtgtctaagaatattaggcaactcactgatgagattttacaatcaactgttacatgttagaaaatatgatgtcaggatactatgaagaaaaatactactatatacaataataagaactatttatctgaatagtttttaacattaacgtgtaaaaaatatcctgatggatctgaaataatgatgtactaaatactacaatgtctggggtttgcttcaacataacatggtgatatagtgagaaaataacaggccatcagttagtcattgtgcaagctggtgatgagtacatgggagttcattatagtaatttgtttatattcatgaatttaagattttttatcataaaaaatttaaaaacatatactgatttgaacttttattcatttattatttgttgactgattcatttactgtttatgcaaggtattattgagatataaataataataataatgctcttattgggcatttaggttaaatgagctattcctcttcaggaatattatatatttattttaaatgtttataaggtctatgtaattacatatttcttaggttaaattttgaaagcaggacacaaaattatatagaaagtatgataacatcatgttttaaaaatatatcctcggggaaaatgagagtaaggaaatatatcaaatggttattaatgattggatttaaattatagaaataattactttaatttttcttcattttactcctatgtgtttttctaaattatttttaatgagcatgtatcattttaaaatgaaaataaatatttcttcattactggaaaagatatgttctccttccccaaggagcttttcatttactgaaacagagaaactgcaaacacacagcattgcccagatagtttaaatctccatacctagaagggaaatacacccacaggaaaagaaacgtcaatacagattttatctgatcatagaaacataaagagctttctctgtgttggacagcaatagggaagaaactggcttgtttgcaagccagcaaaagcgtgaaattcagtcctttttgtgatgagatcattttgtgataaatgcaaaaggagtgacaaattaaagtcaccaaataagcctttcccttgagctcctgaggcttactaatacgagtttcttttggggtagcatagcaagtaaagcgtgggagtggggagggaggcggagctacaatcccgaaggctcctggccttcactggtgagatggatatgctcagagagacagagatagatgtgcaacagaatcagaaacaacaacacagtgacaactatggattatgcacaatggatatggaaagtctctgttagaaaactatctttattaccccaagagattatttccctcagtttatgcacgttcatataaagcgaagtcaagagtgtaacttttaaaggtttggatgaatatgatgttcatgactaaacaggcctagatggagccaggcagaacacagttagatgccagggaagtcacccttttcctcctcctccctctccagtacagttgccagtgcatttcaatgcaggtcagcctctagcaaagtcagctgtttcaagctctgattggataatactttatctatacacccccagtcttgacctgcactcttctcccagtcatggaaatatcaagaattctagaaggccacaataccaatctttttgaaactttacaaactttacaaattttcactacaagacacctagaaaaatcttcaagcctatgcttacctgtagccctggtcttggtcctcttacttaactggtaaaagaggatagccttatttatgtctttgaagggtattttccttttttgcttgttggtaagtacaagagcaaccatgtctaattttaagattgatccaaatgaagcaaatgcatttcaaatttacagaataccatagaatactaatgggtagttcaaagtatcactaaatgtgtttggagggttttgagttttttcaaaacatacaatgttccacacaggaaacatcagtgccaacttcaccctatcactctttctgtccactcaggagtctcctttggaaatatatctctctggagggtcttccaaacaaatcctttgaatacttccatcttgtttagcagagtattctaaaatatttgtcaaaatctgtgataataggttctggagatcatgtttcttattcttctaaatgctggtatttcaaatgaacaaataggatattaaagatctgtcctttaccaatgtcaaaatatgttctgtcaaaatttagtattgctaaagtttagacccaaagactcaccacagcctttggatctcatattttctgaggttcatggaaagatatttgacttctttgcacctcaatattttggactgccatttagagataatgagagttacttaccagacagcaatgtcatgaggaatatcctgttagtaatgatgaaacattctgaaataaaaagagtacaggtaagtgctaggtatttattttaataaatgtatgataacatggtaatcatagaaaataacccatttattcctcactttgggatactgactaagtggtagtatataaaaagtaaaggatgtttccctttgggaatggaaatagaattgtgcactaagaaagtatcttttgtaactgcctgcatgtttaactttaaggtctctaaccagttgcaaccagttatgaatgacttgctgcccatttctgcaattcactgtaacttgtgttgagaaggttatgttttatggttaattatccatggtctgtttaaaaaaataaatcaaaccactgtaaaccactaggatttgcagctccatttgagctttactgtagttttgatcaaacattttgtacataaaaacaagctggtttctctttgtttttagttgtttgttatttgtgttataaatattgtggcaatggtgggagaataagctatggattatttaccctcggtttcatgagttgtgagttattggccttatcctcctttataagtataaataaatgtataatattatattccaagtcttgtaagacaaatggaacgagtgaactgaaaccttttagacccaaaatcttttatgcgaagtcatagaacaacaaaacaaaacccaaattaacatttaaaaagcttctactgtggagcaacaaagtctttaaatattatataatctgcatttaaaaaactgctcatctaacaggcagcagtctatcattctacaagcttttcaatgcctttaacattcagaagctacaggtggttttcccaaagatcactcagcacccccaatatcactaccacaatgaaagccttgaaaatggccagcatgattactttaagccaaaatggatttagaaaaatcaggaattcgtgtagctaaaagtaatgaaacactgtataaaagaagaaccctatagaattttttttatagttaccatcctaggacttatataaacaaaagaagtccaaaaacaattgtccagagaaaatgagaaaagccaagattcaaaggaccctgtggcagagtgcatgaggagcatactcgatagctagaatcataagtatctaacacatttgcatatgaaacttaatgaggatcaccaaagtagcttgccaaaaattatgtttgttaaatcagccaacagtctatgtagcacagacccctaaaaagaacctctaggaaagatgtaaaattgtcttctgaaatttgcttcttttataaaggcagaaaggataaaaaggcctttctcataaaatgaagtgattggtccactactacagtctgaagagttctgtatcagatttcttcttaccctttattacttgtatggcttactgcttacctgcatcagcagtctgcagggttggccatagcaggtcccttacgagttcactgaaacacggaaaatatttatgatggtactattatgtgccagacacaactggatggattctgcttgaaaaggtaagtcagtaactgaggttcttgttgccacattaaaagaaaaaatctatccctactgccaacagcaataagaagagaagctagggtgaaagagttgtcaaagacttatgaaaaattcgaaactgtttaaaattctccctagcttcttttcttgcatgtccaagtaacagaaagcttaggcctgccacctgtcttaagcctggatcccatattaaaaaaataaaaaaaaacagaaaaatgagaaacagctaatgtgttcccaaggccttggttacaacagaaaatgagagccgagaagtctacattggcacacatcgagatttgaaaggtcagtcctgccctagtatggttcagagaccgtgaaaacccaccaagatgaaaatggaagctattctgacaacaagaggcagggaaaaagttcaaagacttttcctctgcttcttttataacgagatactttcaactatttttgacaatcaataaaatgcaaatctccctcacttttgtgttctaagttttttttttttaaatttaaacaacccatttgaaaattagggtactcagaataacttcttgtatacagaactacacatttaaaaagctttgtgcagattgttaatcatattaaaattacatcataaacaatgcactttacatggtgcaaatgttttatgtttttttcttttgacaatcaggcacctacatgcaaaactgcatattggaatccaaactcaactataatacatgtagaggaacccttagaaaaatgcatgtgggaatatgatatcccagttagagactagaatattctgaccaattttcattatttctctgtaataaatttatctgagctatagatcctgttaagaaaataaagctaaatggaaaagtattgataaaatacattaaatatatatatactagcttagtcattattcatattaagatcagaaaagatttccgcaagtcatcacaaatacagagatgggataataccaataatctcgatcacccagttgttaaaacagagaacctcacatttgggcaataatagttttgatttttatcttgtgcaccagatttttccatacaaaggaattctaaattgcaatagttaacacataagacagtgttaaacaaattcataactttagtaaaattaaatgaaccaatttcttatggctttaatatccagaagtaaagtatgatcttaaagaatgatgctgatctgagatacaaggagatcaagcgcttcaatagttcctcctcacacactaatgatcgcatccatcctctcttccacccacctcccaccttttctggttgtattaaaaacaatcaaaactaccaccactgctgctacccttcacacacctgaacttaatttcttctaagagatgcctaacagtgcctagggctgtgctatcactttatatccattttatgaccgcttgagaggcagaaactaaaaaggaagaccaaaacaaaacaaaaaatccctccaacctcccttatcagacaaatgcctggttcccagaggacaccagtcagttaagcaaaaccaaatattacaacagggatgaaggacttataaattgcatacaaatctcactgtgctcccacttaaggtggaaagggagttactccaatgaaagaaaagggggagggggttgtgggaaggagcgaagggctacagaaagagcgagagaaaaagagagagagaaagagagagatttattgtacatttgagacattaagaaggcagtacagtgaaaccaaaggtgttccagggagaaatgtgacagaaagctctaaatgagaattacagaaactattccttcttaaataaaactgttgtttagatgatgaattctataggaagtctgaattaactgtctctgttgtagcatctagatgttttctctttcattaagactttggagtttgaatgtactttgttaaaaaaaaaaaaaaagaagaagaaagagaaaaaaagaaaaaaaaaaaagcattagagctttatatagctcccaaagtaaaaagcaagagaaagatgggtttatataactggcttttttacataaatattacatcaggatacatttcaagtgaaaacacacaaacacacacacacccgtcttccttatactctttctattttaaaattcatttcatactttaaatgttgttggtttttcacaaaataagtaaaaacgaagtcaaaacatctcaaaataagttgccttatattacctggaaaattaacccatcatacaggtcacgatgtctcatttaaagccagttaaggtgctgacaattatgggacattttgctgcagcctagggcaactagaaagggccatggatgttaactaactcccttttaaacagtctgagaaaagggaaaaaaaactgtaagtttccccatctgttatttccttttttttttctttttggctgtggaaaagtaaaattatgcaagagcttttgaatgtaaaggctgtgtgtgctttttccctttttgtctctgtgtaccggttaagtgatgttgcgtaactgagtacagagtaggcggttagcgtttactattgatttacactatgccatctaatgaattcagaacactaaaaagaaaggagcaggagagggagggaggaaaaagagaaagggagaaatagggagaggaaaaaataggaatgaaggagaggaagaaagagcttattcagagaaacagttctaatgactggaataggttcatttttattcctatagctctgacttttggttattgttcagctctcacaaaaaaatggtcttgagctggtgaccccaatattccaatcctatttctaataaggattactggcaggtgaatgcctgaaagttctaatgtgtcaaattacttgaaaccaatttcactatactgtcagactcctccatatgcatctatttatgattctctctatgcatttgtgaatctgtatctgtgatcaccatggatttggtcctactggcttacccaatcaaaaatattatttgaaatatatcacgggaatgtcatcagggtaaagagaaatacattctattttacccatctcctttaaaaatacataaagaacacatttagaactttaaatatatcactattttactttgaaaacagacatgctacaaattgtttggctgaacaaaacagcccaatataggataataaaagagaaataggcaaaatgaggaagaacgctaaattgaggaacaatattcataaagaaatttaaataatttcttatgtctatggagagccttttacttttgtttgggtggaatgcctgtagcattctcagtctttgaatgctgctcagtgcttcccatgccatataatgaattcccaaagcgtggaccagaaagaaagggtgaagttgtttctgctgctaggtacaggtccttcctgtacctgagtgccctcctatggctgagaacaaccactaaggtgagaaagagaaagagaagttctctttagtaatcagctgaaaagctgggcagggaacttgatttctccctcaatgtgtgtttgcaaatgatgactgggaaaaatcacaggaggttatccaaaggaaagaacaagagttggggtttctagtcatccagttgtcttctcttttcagccatctgagcttagaaaatattaaacagatgcgtactctgtccacttgtcaaagatgctttaatgacccatggtggtatgcacacagttgtatacctagcacttgccatggtgcttggcacattttctatactcagcaaatatttattgaaactgaaaaatgatgatgggagaaatatctctgtagaaagaatgcactagaaaggcctgaaaaaatatattccgatgttttacaagaaatcttaggctatattgctctatcattaatctgcacacaaaataatactgtaagagaaatatcaggcagttatttaggggtcagttgacttcagttccattttattaggaaaaagcttaacaaaaattataatactgataacatcagcaaagttttgtgttcatttccaccagcccttttgggctgtctttcatttcagtcttgggcacagaaaagtctattttaatttccatggacacattctaaagaaaaagtcatgggatatcaacgtaattcatcttttaaaaaatactgagacaaatgtagccatttagtaatggaagagaatatggctttttgttgaagggcaaggcaggtggagttttgattaggttacacaaatttaaattactagaaggacaccaagaatgtactgatttccattttcttggttaaacagtttttttttggaaaaaaaaaattctggtttagaaagtcagaaatgccatctttcagttaattggagaataagacctttagaaaaagaattgcaactacaatttctcaaaaattccagcgaagattcaacttaaagcatgtttagcaatagtagccatattcttttaaaaaatggggctaccatcttgttaattctgtaggactgagcatgtagatattagtcaaaaccttcaaaaagttttttatttctctctcttggtcatctatttaatgtaatcggattcagcaacttccttcaataagcattctggcaatatgtcaacaagatcattcatttcatgattcttaaaagtggatgagaacttacctgttcttcttcattttatatatgaagattctgagactcagaattaattttctcaaaagcatatattttgaggcagagctgggactagtatctaaagctcacagttcatttttttcacagcacagactaaatcaaagttgtataaattcaatcttattttaaatgccataggggaagatttcaaaggattcttttataagacaaggaattcttacattatgtaaaatgttcacctcaaagctatcttatacttttttttatcttaaatgtgagcctactgttcaaattgttgcttctccttttccttgtcttaatttttgactctttagagtctttgcctcctgtcctctcacttgtactctgtgtctagttcatatatggcccttcctgacttcatattcttccttctctctctcttttcatctttttatcaaacttttatttattcttgttcctcacagaaataatttccttgttaatgtgatatcctcagaaactacaaaggaagaaaaagtgtaaatttagtattattataataaataggcctttggtttatatttaaaacaaaactgcaataagatattgacaaacagagtaaactacagctataggcttccctatagaaagttacagctgtctagacctccatattatcaatatgaaaacttgggggctagcatttcaaagtatctcatcaaagacagagagcaaaggctcatgatctccagaccactcattttccactacatcaggacacctttcgtttcccttttctttctttccattctacattattgatatttgagactgattacggcacagcaggaggagattcagagaaatctccttggcttaatgtggtcaaactctctcaattccaaaaaaagtcagaaagacctgcacactaaaattgtagttacacagaaaaagaactctgaggaggttaaaagagtcctctgacatgagaaagtagtctctggatagcagggacattgctgccaaaatcattgtaattaagattgggtcattgtttccattataaaccttatgcttatggggtttgtaattcagttaaaatgatcagctgtaggctgaaatgcagccccaagtatcttagagtgggaggtgtttctcccctcctatttcttaaaaaagaaaacacatagcaactatttaataatttcaatgagagttgtattctgacccttcccctacaaagggtagttaatcaatgagcttaatctagagtgagccaaggtgagcaacatccactgtggaatgaagcacattaacctggcatatgaatgggcaataaaaggatttcctattatttcataaggtttaatgtacatcactccattccactgtattgatgtgaataggctttcagcaacaccgtgttgaaaaatctcccacttctgtttgttaactcattattgtaggaaacattacaattataggagacaggaatttctgatggtttccttagatttctttcctcataagctcattcccagggtcagtattagataatcaataatttctaaaatttcttgctcctatttctttagcattgtctacaatatctgatacctatagtgtaatgctatgtgccaccatgatgtagagggattggggaggaaatcatagctatatattaaaattaacaggccagaggaaactggtatttactgagtacatactacatgacatatattccattaatattatttcatttaatacaaacctgcagtgaagtagctgtggcccatgttttatagattagcaacatagttaaagagctgttagctaacctgcgtaaggaaacagagctaatttaaaaagttgcgaagtgaggtttgaatcaagatctgtttgactcccaggcccatatgtactgcaatgcaatgcaacaccaggaacagaatatgaaaccatctaactgaaaaaaaaaagtctccatgccaatgatgagagctacctcatgctccaagtaggaggtagaaagggtaaatgactcctaaaaagagattcttgctttgctcttggctctgataaatccctgtttattcatatgcaaatatccaaatgcatatttggaaaatgttttgtcttagataagaaaatgcacaatctcctagaaacctttaaatgagaccagacatttgaatgtttacaaaaattcctttgaagatttatattaggagaaagttttaaaacataatgcataaaaaaaaatcagatgattggctaggcatggtgactatcgtcaccatgggagtcgctttgggaggctgaggtgggtgcatggcttgagcccaggagtttgagaccagcctagacaacatggtggaaccccatctctacaaaacacagtgaaaaaaaaattagcaggcatggtggcacgtgcctatagtcccagctactctggaggctgaggctgaggctgaggattgattgagcccaggagaccgaggctgcagtgagccatgatcgtgctactgcactccagtctgagcgagagaacgagaccctgtctcaaaccctccacccccaaaaatcagatgattaatacaacattaacatttcaatctggatgtgtgtgtttgtgtgtgtgtgtctatgtgcatataaacctataaatatacacatacacagatgaatttttttgtctttgtcaaaatttctggtaattattataaagtatttgacaaaagctaaacagtaaatatgttacaccaggagaaaaggaaacaaagaacaagaaaagaggagtatgtgtatgtacatacttccctcagaaatctaatcctaaaacattttttaagctaaatgggacatagtgctttagtctaaattgtgtgtgtgtgtgtgtgtgtgtgtatgtaaagataaaggacttttactatgttattttggcaagtgattatttttctaaaatctttgctgaatcgttttatgtagatatactataatactcttgaataaataaatacttgttcaagttaaccttagagctcatcaggtaaataacagaatttaaaaaagaatctgtagtctgaaacactgtagagtatgccaactttacacattacattaagtattcgttcaaaataatttataaattgaaaagtatactccattttattcaaacaatgcaattttttaaatgaatcttacacaaatttgtgtgtgtgtgtgtgtgttagagagagtgtgtgtgtgatcctcaagaccactgagtcattctttaaaaatattttaaaatcataatttggtgaagaacttaacaacaaagtaactgaagccagatttgagagaagaagaatgaacagttcttcaggaagcaccaattcattccttaacattcaataagtctttattgcttcgcccttccctcctttttttcctctagtctaaactctgatttggagcagaagttaggaggaacacgtattctggtccctcttctctcatccctgtaaggaaaagcaatggtagactaatgacagaaaaagcaattgcaacaactttggcagttttgtggtactgggaaaaagcaggctttgtatttgtacatttcaaggaatttcttcaaattttagcttctttgaatgttcctacaacaagctgaaggggagataagatctgctagggaaatagatgaggtttagagagggaaaatggagggactactttttttttattcaaatagcattcaaacacatgagcaagatataacttgcaacattaaaaagtaaattagctagctaaaaataactcacaatacccttctcactaaaacaaaataaaataaagcaaaaactcacaaccaattattttgactggtaaaaacagacagtgatatgaaagtaacagatggaagcccagttttactcacacaacacactcactaaagacaattgcaagtgtccccatgacaataacttaacaatggtcactttagcctgagatatctcctttaggtgagtttccttaaagacttcagaggggcttgtagaaaatactgtagaacgaaaccaactcatttgtctatatgtagaaataggcaagagttgcaaatcacagcctgtggacgaaagggatccaggtgtcacatttgccaaatctttttgcaagactggaatagatattcttttcttatttattttttgttgtatggcagtatttttaggagtggtgacatttctgtacttttaaaaacacaacactacacagcacctaaaaactttcctaaatcaaataattaacagtaataaatcttcctgctaatttctcctcaaagttgaaagaaaggttattttcttacctcacactgagccttctgatatgacagtgtcattcagtcaataatttcaatgtcagttactgatttctaactcttttattacaaagacttcaagcaataatgaaatggtgctgatctgcttgctttcactctatataacgtctatatttatatgcttatgcttctatttggatctatatttatctgctttatctgcctacagtgcatctgtttctcatacacacagacatatatttatatatatacacacatactgtatatatatatataggttatatataaacacacatacccacaaaaatgtatgaatgtatgctagtgagcttacttcaacaaccatgcaggtgcataaatattcaggcacatgacaaatatacaaagaacataaatgaacatgtaaacatagttacacaggaaaaagaatatcttaacaacagccctgtctgccatacttggctgttggcctttgagacttatacactgttgaatgatatgtcatagactactctgagaagcagaaaaatcttctgaaggcaaaagtatatgactaaatcaagataatgaattctaactctctcattttcgcaatgaggagtctgagatactaaggtgaacagcaaagattttacagctttctggaggcagagctggaagttttacccaagtctctgcctgctagacaaatgctctttctactactatgctgaattgaaaggatgaaaacaattttttcaaacccaatatcattattttctaattgccactctttcccatttttcccttttcttgctgtgtgaaatgtaaacaaacaacattcactcagggtcaggcactgttctaaatattctatatgtactataccatttaatctgtaaaatatctctatatagtaggtattattattcaaaatcttagtttagtgaattaaataactcactcaaagctacacagctagtaaggaaaagggctgagctcccataatactcaagacccatgtttttctcacttaactatgatgccttccctaatacatatttgtatataatactaacccttccctcaccaccacagcctgatagtcttagaaatctaatatttgatctgtttcagaacacataacaagtttaaaggttctctcagcctgaggaaaaaaaataaagggaagtagagcaggtataagttacatccctagtatgcagcacatgccctatactagagaactgaaatatgcaaaattcccccccaaaattactccaatgatagtgtgatgtgatttaaagccttaataacttccagtctatgaacattttatgtcttttgcaaaggattatggcaaactgataatatagaatcagattggaaataagaccacaagaaggcaaagggaaaatagcaaaaggaagaaagacccacacccacttcttcttcctctcttggcacaacacttccaaaaacaaacacccattaaaaacaacaaacccagtatcaaaatttggtatttttttccccactcaagtgttagagacaaattcagaaaagaaactaagtctacgtatggtaggtagttttatacaaatctcttcagatagtaaccagttgtgagccatccgaacacggaggaattttacactttggccagctaacccagaacccagcactgggagatgtcatgtggatttgtgaaactccctggggcatactgcatccataagccaaagaacagaaattatactgatccatacatgcagctcttcatctgtgccatattgataattactcttcatttgtgaattaaatcctagttataaaaacaactttcagacatttgtcacaaatggcacattttacttaactctttcataacaccatctagccacggtctataggaaatgggagctaccatactcccatataggtcatgatattataggaagaatatgatgtagagaaagagagagagagagagagacagacttgagtttgaatcccaggttttccatttattaacaataaagctgtaggcacatcacttaaatgattctgaaacctcattttcatcacctgtggaataaagaataaaaccacctattttgcaggaacgttgtgaagattagagacatcccagcacaaagaccccctcataaaagggggcattaaatattaattattgtatatttaagaagtctatttgtgtgtgactttctcttgtattaatgatacataaatctgctgggagtaacagaagatgtgaggtactttttatgcttttttaatcaaagacaaactttttggtgatcacatgtgttccatgtaaaagtggaaataaaagcatatcacagtgtaacattttcagtggacgattttaaagcacttaataacccttgactttttgtgattgctggcactctcatttaacagttgggcaaaatggggttcagagatacatcctccaaatcagtaataataataaagaaatcaccagcaggggttagtagaaagtctgtttttaacatctaaatcccacagtgtccagctaaggaataactgctgcaaggtcacagatacaaaaggccacactttccccaaagctctttgagattattcactgaggccaaaacattaggtaatgctgtgtacatctgctgagataacaagggtgagtcagggttaggtcacggtttcaggttagaggggtggggtgaagagtggctttcagatcaaatgacgagagtagtttaatttaagcaaagaacaaaccatacagtattttaagtaagaggggaaaaaaagggggtgcaactacagccaagagaaggtgggtgggaatatagaccctgtgggggtcaaatgggtaactgtggctcaaagaggaaacccacccacattcacacacactgaaaagcgaacaaaaagcccagggtgcagcataaatcctgctatcccaataacacacacagatgttccaccattgttttcttttatgcacattttaattaagagatcagaatcaagcattaaaatgttattaaatggcttgtttacatttttgctatatgtcatttataatgcattttctaaatgtgtgtatatctattcggaaggactatttggaatttttacatcagtgctacaattgtcccactaactcacagtcatttttgctaaccaaatatgtgtcagaaatccttttcagtttaagcaactggacaggagctctcactctttaattctcagtcaagcaattccctacccccaatcacacctcctttaagcatgacaaagtccaccacagtacttcaagacaataggaaggcccaggtacactggcaacctttctgatttttcacaagagtcccagtttcaaatattctcccattgtgctcacaagaaaatagtcttcatatacatgcccgaccctttccctagaacagttttgaaaatgtcgggaactcaaagctaccacatgaaggaccctgacctatgagtgtcccctggaggggacacagtggaagaagcgggaactagtagatttttttttcctccccacaatccatcttctatttgcagtctacaacttatccctatttgcctgggcaggaatttgagttctctatattattctggagttaaaacaggtatgcctttcccgtctctcagattccacagatatcatgactgatgcacacaatccacctgcatatgtggatcacaagtatcctgtagtctgctggcaccatataacttaattacttttaaccacagggcattgtcctagaagcccactatttatattgtaccttatcaatcatggtacttggaattgcaaagtctcagaaagcaggaatcatatctcctccacgttcagttcaatgcctaatgcattgtgagtgttcagttaggacaagcaagagaggtaaggttttttctttctttttgttatttgtttgttatccaggataagcagaatgcttgtacagaacatgcataagaaagaaacgcaatctaatctcactgtcaatttatattctgtaaactgtctcatttgcagcataaatgactacaaaaatgttttggttactctaagtgttaaccttaaggtaagagttaaattaagtctgctataactggtggaccagaaaggactcagagaaaagcaacagcatggctttgaatcaaatcacttttggaagaaaactttaagatgttaccaccgaaaaaataaaactggcaaaatgctctggagggcatcttagcaatatgcatcaaaaatttaaaaaatatatgaagactgttgacccagaaatctcacctctaggaatgtatctaaaggaattactcaaagatctacacaaagatttagaagcaagaatgtttaccatggcattatttataattgtgaaagactggtaaccttgtctgacaatagagagttgattaaataaatgacagtacattcctagacttaaatactatgcagtttaagaaatcatattttagataccacttaattacatgaagaaatgtttttggaatactgttaagtgaaaaggcatataaccaacaatatatgtacaggaaaatatattgtttaagtaaatattgctaagttaaatattgttaacttaaatattgtttaagaagtgatagttgtgtacacacaaagtgcaaaaagaccagaaaacactagaagtgcttgtttctgggtagagaaattataaataatttttgtttatttgaacttttccataataaaagcacatttatttcatagtaaaatattacttaaaatattcatctataccaaccttccttctctaaaggcctaaaagtgaccctctgtaggcactcttttgtctctagaagtcttccttctcctgtttttatagatgtatgtgttgcattctaaaatcttaagtatttgggactatgtagttataaaagataccctaccaattaaacaaataaaaaatcttattaaatctgtggttttaatcttaggttcctgcttagaaaaaataccaatttctctttaagtcctatattttgctttcaattcagcctccatagtattaattagttatattatttaggcctgcagcagaacagtttcatagttcttctcattctcacagttctttgtaagagacaccacccctctcatggttcttactcacccctacacccacaattgaccataggtaattgtgcaagagaccacaaatagaaagaaaatgaaggaagccttaaaaggccaaggtagttccaagttataaaacagagaaaggctgaaaatttaggcagagatgtggagaaaatccgagccatgacacttaagaatgaactggagtaaagatccatgagcacctggtgcagggagagacaactctacctatcaatccagtacatgctactcacacaggactattaattctagtaaataaccacagctttaggaggggcaaatgttctggaataggctgcctgttgaaaatacaagtgctagggcctttccataacctataatcaggacttccagaagtaatatccaggcatcttcattgaaagctccaaatgtgattctgaattatactagaggtgagaaccaatgggctactggggaagttcaaatcccttagctctagccaacttttataaattcatctcccttaacttcacaaacatatacactctgctgatgctagaccggtgtccttgttctccatccttgctccgtcataaagagaaagctagtttatgtctttgtacaatctacttatgactttatatcttgaatgccctgactgctccttactacctgtttaaatcttcactaattccaacaatgggttagagtttcaccttcctatgaattcacattgatttttcctacacattaaactacagaatctgtgtcttcccctatttctactcttacatcaatatgaaacaataatttgtttgtcttacaactcaatatgatcataaaccatatgtgcccttagaaagtgttcacatggttttgttggtacctctttgcaatgtatatcagggaattttaaaaaatagcagactgaattgagaccagtacttgcatgttcatcatcatataatatgggacatgtatatttacctccaaacattctcagagttcattcttcgtaccctgtaggcttatgctgtaaagaaaatacatatgcagaaataaaaacagagtttgaatctccagtcctaatccttcctctgaactcctgtctcatgtatccaactgcctactacatctctttatttggaaaagaatttcaaattcaacattctccaatactaactcataatcatctctttcccaaatctgctcatttctccatatcccctatagctcccaactccatgggatattgccatttatccagtggctggggtgaaatgcctgaaattcatcacacctgatgtctctctcatgtaaaaccacattgagaccctcagcaacttttgtcagccctaccttcaagttatgcagagttgaaccacttttcatcccctccccactgccattgccctttgcataactgggctactatgataactactacatgctcttcctgtatcaccctgaccctgtagactgttctccacagtgtagccctggaactcttttaatatgtaaatgagatcatacatgcttaaaaaaatcctctatagctttctgtcagtctttatcatggcctgtgtgagctggtccctacttatctacatgatcattcttactttggtccacttgagccacacatttcttcttgctcttcctggaaaatttcaagttgttcctactccaaagtctttacaatatccatcccctttccctaaaatgttcttcctgctggtcaccacatgcttaggttcttctaataatttaaatatttgctcaaatatcttccactcggtgagacctttcctacttaccctatttcaaatagcactttctaaattatatatccctattttctacctccttattatgcattattttcttcctagatctgatcattatttaaaatgatttttttttgtttacataattattggctgtctctccttccactataaaataagtttcataggaaactttgtttaatttctcactatattcccagtaattagaacaatgtctgaaacattataggtacttgatagctattaaatgactgaatgaataagtagatgaataaagtgttccagtacttataaatctcatcccagtcacataaactttaaataggaaatctttattctgcatggtgcagcggcttctctggattgtcccagaggcctctattctttccatctgactgcacaggccagtctgggaaaccacctacatgcaatagctcacatgtcttataataaacttcttgggaggagtaagtcaaattagatagttaactaaaaatagtatctctgagtttataaaggagacgttttcccagcccaactggtcctggtaagttagactggcatcaaatgctgacatggcaatcttatgcttgatgaaccctcaatctggagaggagtgagctatacttttatactatttattttgtgaaagttccaagtatagttcatctttgtatccacaatgtcaagaacattgctgagcagagagtagagcttcaataaatgtttattaaacagatgaacaaactaatccatgaagcaaacaacattctaagtgctattcttctatgtctaagctttgacgatgcgctatataaaattcattcttgcaattttccttcatagattagactgaaaaactcatcgtgaaggaccatgtcttatccatcttgtatcccaagttcttagtacagtgctggatgtaaaaggaagaaaaactccaaagcaaaggatagagaagttagaagtcctggcagcgatcagtgagtattaaagaatgccagtatgacgtgattatcagatgttaggtgatgaaaatcatgccagctaacatatggatttctaccctgtttctgtataagacttgagctctaaatttagttcctgaacacaggggatcagagttgaaggtgattatttactatgaaactgctattttccacagtatacatgatcaaagtgctagaaacttaatgcatgaaaatctacacttctttactcaacctctcttacagttatataaaattctttagaaaattaatgttataaaaaagagttcaggccgggcgcggtggctcacacctgtaatcccagcactttgggaggctgaggcgggctgatcacctgaggtcgggagtttgagaccagtctgaccaacacagagaaacctcatctctactaaaaattaaaaaaaattagccgggtgtggtggcgcatgcctgtaatcccagctactcgggaagctgaggcaggagaatcccttgaacccgggaggcggaggttgtggtgagccgagatcgtgccattgcactccagcctgagcaacaagagtgaaactccatctcgaaaaaaaaaaaaaaaaagagttcagtttgttcactaaagggctcaatttgttcactacataaaaggatatagcagtttgttcacgaaatcaaagccttttcaaatataataagcaatagaagaggtgacaaaatatataatgtaactattaaatcagtatgccttacaagtatccatcatggttatagtactaattgccttggtttgtccaagactgaggagggatgtgagcttttccgtgttcaaacagagaaagctccaggctagtcaggacaagttggtcaccctaataatggtataacctgctaagctggttatcagctattccgatgtatctatatgtaggatctataggtacatgtagaatatatgatagataactaggcattactaggttataagatgattaagaattaatcagtctgtactagtataccatatgaagtgcaaatcccttgtttcattttctcttcatttcccctcgatgttggacttcttatgtttttatatcgtatgcttatattgattttattatagtcaaatacattaatttggggtgttaggacaatttcattttcttcagaagaaaaggaaaagtgagtagcagcaatgcagatgggtctcaattgacgcatgagctcatctgttttttacaactccaagtgtggtaattccccgtagaattaaaatttcctaacacagaaattaaaattttcctagctgaaaatgccggctttttacatatcccaaaactgaacacataaagattaaactccaaaagtaaggcaagatctacagaactatcccagccctaattctgccgagatatttattataagacaaactgagacagtcccctgtggtctccttaaggtcctgatggccccctcaaagcatcatctggctttaagagaactccaaaatagtaattggtctttgggcacagaatagccattggaatctggattagagtctgaaaaacactgcattttccaaagagattacaatgccaggctttgaacattgaagggtaatatcttctttctaagtatctctggtcagtctcagtaactagacctacttttgaggctccatttcttttatgtcttttaaatttaatgataaaaaagaaatatctaaatttataatatacacgaaacagtgaaattaggagaaaaaattctatttgatgtgtccatttttttaagctcccatgactaaaaagatcaacagttacctacatttgtaatatttatgcctcccaggctcagtgtaatgagtttcatctctgatcgaatttttataactgactttcacttacctgtgaaataggtaataggaagccttggtaggtgctttccctaaagaatcagatgcaaaagttagacctactgcaaacaatacagaggaaaaaaatgtcactctaatatactactactatatccgtctgctttttgcaggaaaggaaagctatcatcctagacagaaatactgaaataagtgaagtacagacaagtgattaatcaaaatctgaaaatcatagtcttcagctttttcttccatgaaaccatggtgtgtcctcttaactttggccaagtgcccagctaagagaattcttccatgagatgaacatgcttcagggcaaaaccttattctaactgatggttttaaaagcccaactctacattctgctcaaggctttggttacgtaggtaagccaaaacacaggagacatgacttcctccattaaactggctgaagcccaggttacactaattgagcctaaatagaaaacctctgcttttcaatccctttgttctcttggatgtcacagcttcctgctctattcgcttccttttatagtcttctctcaccaagcatttcaggaaaaaaaaaaaaaagctaaataaagatcacagcctgttccattgtgtccccttcttcttcatcatcttcttttccatgtgtgcaatgttgtggcacctattaactaccaatgttttcagaatgacattatacaaggtgcaggctgtaccactgtgccctaaaaatatcaacaactgcattagtctcacaataattaatggcaggcattatgcaaatgacaactttttcgctgcaaaataatgacatttcttcattttgagcagagttatgcaaaacaatgaatttaggatgataaatcacacaggagaattaagaaagccataacgttcctgcccaggcaggcagaaagatagacagaccaacaatttagaagacattgttttgttctcacaccactataaaaaatcatagccagtcggccattaatgtgtgtaggtttttttccttctcccctttaggcaacaatgcataaggggatgctaaattctagcaattggatcattacaagtcacaagcaaatttttctttattaaccttaataagtcattcactcagagactatagtcatcaagcaaataaaaagtatcacatgccattctgctacacattaactaattccttatgcaaacatcacaacatatagcaattactgccgctcaaaaaaacaaagtcattttcaatttattttattgcttttatacttggccatttcctgtagcacattatcgtttctttccctaacaacccgaggtggaatgaagaagaatttcggtagcaatgagccccttcctctagccacctttgtcatacctttttcccctccgggaggcttttaaggaaggttagggataaggtatgtgcacgctccttcacaggaaatgtgcatcaagctcagagaaatggtacattcagctcctattcttgcagcaaagagagtgtggggtaggcagtaagacccaagtctgtctcccacatttgctacaataacactgacagctttcctttattcagtaaaacaaggtaaaagtgtaggcttagacctgtccccaacaggtgaacgttaaagtcaatatatgcaacgttgacctgagagatatagtaatggttaatgagaattatgaggttacttcgtcttgcttcactcagcacataacttgtcccttccagaatgctgaatgaagagcaataataaatactggacactaccccacaacatgcacagtattaaataagatctttgtgtgtgtgtgtttttaattctataacatcctttatccaagactcccaggatgtgaaacaaatgctaaacaaagcttacacattgctaacagattcttttagcccattttacagactgacaaatggattctgagcaactagaggctttacacaaagttggactggaacaggtcagactatctttccaatgttctaacctctgaggcccgtggcctcttataatcatgagcattctttcctgctgataaacaattatgctgtaaacagcctgtacatgtcccttttcacacaacaggatgataatctctctccgttctcctaaatccacaatccattcccccctttttaaggtagaacatttccgaaatacacacgggaaaagctctgttttcagtttctcctcctgaaggtaataacattttgcagttctccttaaataaaatccagcccatgctggatcaataagaatgatgcccatttccctaatggcagccgattgccatttgctattcaaatcagactagataaattacagtacatgccagggaacaggccagtgaattaagacaggcctccagaggaccagcgatattattaatcttttaagacactatcatatttcttcttgacagtgtgcgtagactcacagacacactgcacccagattgaaatatcagctgctgaaaaaaatcaatagtgttagaaacacaataatttttggtctgcagggtctacactaagcaacacttgtacccctcctgtgccatctcttctcccacttcccctttgccatatttgcctcctacctttttgctcttcccttttcattctctggttttaaaagcttgtaagtccaaatgacaagatattatgagaaggtttccactgctaacactggccattgtggttacagcgttgatttttcatgggttgtttgaaatgcaattttactagtctggcaaaatgttttggcgtgggattgtttttcctatgaacttaatatagattttcaacccttatgcacttggttctgtattatgaagaaatgaaaatatttataggggtggccatacctgaaagttctgaggaaagtggaatgcacagaagggaaaataatggaaacctggcccagaaatgaaaaaaagtggggggtattcattgaagatccaggagaataaacaaaacaaaacaaaacaaaacaaaaggctacaggggaggtgtatgtagagcagaacatggtaggaagaatattctacttagattctgaaaacttgaagttgacctctgcctctgctgcctgcacactgtgtggttttgccagttacttacccttgcagagccttggtttccttttccattaaaacaaaacaatctaaccacctacctcatagcattcttgtgagggctaactaacaagatgtgtgtgttttctaaataataaaattgtgaatgatataaactaatttctactagagagaggtttatgaaatgtgtctgcttttttcctttttcatagatacagaataccataaaggaactttagacgttatcaataaataagcaaactgatagccacagaaaggttattgaggttcacattaccagtagctagtagaactttaagtagaccaagatctgttgaatctgagccagtcccttttacattttaccagatggattttaccttttccatgtctctttctactagagatttgaggctttgattcttgtccatgttgcttttccactggggaggcagataaacaaaatgccacataagaaaacaaaaacagaaacaaaacctaccatgtttgtgtatatttatatgctattcttttgatcccaagactccctccagttcaccccccattttgattcttcctttcataacaaaatgtattagaaaaattgtccgtattagttattaccgtatcttcactttctattcttttcttaatctattccaatcaggcttttatccgttccactctaccatatctactgttgccaaatgcaatggtcacattttaattttcatctgactcaacttcttgcaacaatttaacacggataaccgcttcttttcctcctcgaaactgtaatatcttttgggatacccctcttttcaactttctctactatcttacagggcacttaagcctatttaagcctcatcaaatttgaaatctgttactagcaattcattcttatttctgaattgggataaacacagtatatttggaaaaacagtggactgtcagatgttttgatggtctgattttatgactttgatatacaaaaaagagtagaaaatcttattcttggtttggcttgaagcttttttattccacatacctcatggcaaaatttatgaactacttttgaaaattcataagtgatcatttacctagatccacttaattgctccacccagtttcttcaaacacttgttctttgaggtctacatggcaagaagtaaatacgaaaaccatttccaagtgaactaaagtaacctgaatatgttttctgtgttaggttgttccccctacccacagcaaaagcatgaagacttcctttaagaatacaagatatattctaagtctaccagtactccatcttctgatgtcagatggagttaaagttcactttcatctcaagagaaaaaacagtcattcctgacttacaaacatgagtggagggaagtacctgaacacagggattgctttcctcacatctggctctaagatacaaccacgcgctgtgacatataaaaaggtcactgacacgagaaaatatcgcaagatattacaaggataatcaaagccaaaatatatccaaacccacttttggagagaatcccaataacttcttttgaatgtgataataaaaataacatgaataaagatcattttcttaagaaaaaaaaggaacgtttctatcacttgcctgccacttgccacttaggagtagactctggctcccttttccgcttaaattcttccacagagtcagcttgccagactcttaaccaaggtttttcttttatctagactataacaaatactccattttgggtcatgagaacatagtagcaaaattcccagagttaatactttaattatacacatatgtatttattattttgtatgtgtgtgagctgttccactaagttaaactttaaccatattaatccaggaaaaaaatccctgattatcaactaacaattttgtaaacagttatctcacaggttaaatattaactcgaaaaatttaactcaaaactccacacaagcagaaggagccaaaaggccaggaagaagaagtaaagattagctgctttaggaggaacacagccaggaaagtgagcattttggtagctggataatgtgtaggaagtccagggggttgtgcaggggggggaaatagaagcaagaagggagcctggaggacacctgctgcttatcataatatcaaaacataaaacaatgaggtgagaccttaaggaaaagaaaattcatggagatatgaatccattgataatggccacaggaattcaggtgcaataaaggtttgaacctcaatgatatggacatagctaaaagatccaacacaaagctagctggagcggactgcctgcctgccactgaatatcatgaggaacattctggggtccctcttccactagaaataatgggatgaaggctgctctgcctgtcctgtttctgtttcctaacaataaaacaaaactgaagtgtctccctccagtattgggttattaggggcaccgattgcaagttctaagcctttatctaactgtccatcaattctctccctgattaacagaaccatatcacgtaagaaaaagttggaaccagcagtagactaagtcagaaggcttttctgtaccggaattgctgaactacaaatattgttctctggttaggattttgactaaaaaatgtcaagaaaatccacatggccagagaattcgcacaatcttgatatctgaggtacagggtaaagctgatgtattttaatgctgttttaggaaggttagaaactgttaagattcttcctgtcagtatgtcaaatatcagatcagtcctgcttgctgatttttaaggaagtcattaaaaaaatcctcccagtgagtagctttcaaggaagactcccatttgcccggcagatctaaagaaataatgaggccaaataatgcaagtttctcaagagaggtgtaggattgaatgaaaaaagggaagatatagaaatgtaggagaaataattcttacatatataatatatataatgtatatatgtatatattgtgtataatatgtatatattgtttatattcaagaaatatgatatagcttatcatatattacttttgatatttttcttatacatctagtacatgaatacatgcttattggaaaagtacaagtacaaggtgtagtctctattatctaaatatattatttaaatatatatctaaatatattatctaaatatagatgacacctcgtacttgtaaagctttttgcagtttataaaatatttttgcataaaatatcttttgctttcctgacaaccacaaaaagtaaaaagggtgggttctataatttctgttctatagacatgcaagtattactctaccattgacgtaactggtgcagaataaacctgaacagaggaaatagaatccattagtagcctggttatccatatccacatgccaagtaagaaagcagcatgatgactgtggaaatgtaaaggcattataagagtgatttttggagaggattaaggagggagacatcaaaataattcaaaaggaagtttagaaaatcagtagaaataaagggctaaatttggagtaacttttttggaaaaaaagtgtttagaacaaggaaagaaacttccaattcagaccatgtattcatttggcatatactaattgtatatctatgtttgattttctttgatagatgctattgggtaaataatgatgtgtatggagacactgacctgtgcctgacatatttaatatctatttgttgggataatgcccagaaggaattattatgcaataaaattcagatattcagaataggggtttagagagaaaatcatcactgatatgtaggctgacaaaggaaagcttcagtatgatgaacaaatctagttatactttgaaaaacatgtaagatttgggaggtgataagacatttcaagttgtgtgaagggcatgagagaaagcatggaagcagaaaattgagatatgtatttgggagcagcaaataaacaagttagttggaattgtaataggaaacaatgctggaaagatgggttgagtgtggaatgcgaaacggggtccttgaataatgggctgagtagtccactttattctgtgaacacaagaggtctattaaaggcttgtaaagtaggacactggcatggtcacagtgatattctagtataaataattgggaatggtggacagaaaaaactgaaacagggagagcataaaggtaatgagagagaaagagagagagtgcgagcttgtgagagcaagagaatgagaagtgatccactgcaacaacccaggtactatgtgataaatatctgacttcggtagtgtcagcagaaatgtacaggaaataacatgttctagagacattgtggaggaaaaaataacaatatttactaaagttctactctgtgccaggcaccgaactatgtgctttatgtagattaacccattaatctccatgctaaccctaagaggtaagtaactttattgtttccattttacagataaggattaagcaactttttcaaggttatgcagttagtaagtggtgaagcctggattcaaacccaggcaatctgactccagagcctgttctcctaacccccacacttactgtttttcctaggtacaagggatcttttggtggattatatatgacaagatttgatataatttgatgactgactacatatgagcaataaattcgtgggattcttgggattctcaattctgagatttttgggttatattatgaataaaaagaaggaaataaagaagatcttcttgacttcacattgtacatttgttcctaatggtccaattgctttttggacttaaagtatcaatttacaataaaagccacagaagcaactgaaccaccaaaccggaaagctctttgaaaatgattcttctttctagtttcactaatgtatatctggagtatagcacagttcttcgcatataggggatgcccaacaataacatgatgaatgagtcaactggagaagtattaattgtaataagtgagaataagggagtggagggtgtaaaagtcaaaagagtatgacccagagtcagacaaatattggttcatatcctggctcagggccctttctaactacatgacatacagaaagttactttaaacattttgtgtaatatggggtaataattcataggaaagctagctaccttactggattcagtggttttatataaaggcaatgggtgtatgcaaacctagtaaggaatgctcccaaaggctgttacctctgacagaagaaaatctgcaacccctttctctttgtttaacttacaaaaccacatgaagacctaagaaaaaaaatctgccaaataaattccagttacaaaaggaaaataaattattttgaaagtaaaaactataatttcaactgaagaagagattttaattgcagggagatagatcagttgaatggtttaacttggacttgagaaatcagtagcagccagtgggatacatattaaagaaaaaaacaagtttaattacccttaagattttatacagcttggctcttccctcccacacctagtctgcttccatcaggtcagactccttttcaatcacactctcttccatccttttctcagttgctgtcatgacaagccaatgagagaatgacataccgatgaaaacaaggtttgagtaattactgcactgtggctggttgttgtctgggcatcattttatttcttccaatcaaacaggtccttggacttcacagctctgtttcaggtgggggtgatgctgattatattatgacattatagcaaagacaggcagatcagatgaagtgaatttcactcagtaattaaactgcagtttctttcgtctaaagtccagggcaggattaatcgaaacgtagctctttatcattcctattaatgctgggatttgaagagtgagctctgatttgatagctagccctgaatctggctgactggtgtccccaaatctgtctaacttgcaaaaataatatcagatcaagatacatttgcaaggttatacccttcccttttattttacttttttttttgataaggaaatgcaaatagattcaaatatgctgccatttccactaccttgttttctattacaaaaatgtctgtgaaaaaaatcaggtccttccaaaccccacagcattttacaaatggttttccataattccacttaacaccatgctctaatggcttctaattttgtgacttttcattatctgagactcaatatgaatatttggatggcccaagcgacagcttttcagaggctcaaaggttctacttttattttaaaggactcattctgggacttatatagagattttgtttcattcaatcactcttgtaatgcatatgatatcaccaaattctttaacaagtatgagttggatcactgattctcaatcctgggtgtccatagaaggacctgtgaagctctgtaaaaaatcagcctccagcctccactccaggccacactcacagatcggaatctctaggttttagacacaagattttatatattcttgaactccataagtgatttgaatgtgcagctagagttgaggaccagagtcagccacacagtgtattagctgtatttgcaaaatatttattaaaacaagccattgttcagagaaattagcctcacattattgtgagagatctctcaataaaataataaaaagcttattccagtagcctttgcatagaaaaagatatacttgggtttctttccttcttttcttttttttttcttagacggagtctcactcttttgcccaggcaggactgcagtggcgctatcttggctcactacaagctccgcctcccgggttcacgccattctccttcctcagcctcccgagtagctgggactacaggcgcccaccaccgagcccggctaatttttttttttgtatttttagtagagacggggtttcaccgtgttagccaggatggtctcgatctcctgacctcatgatccgcccacctcggcctcccaaagtgctgggattacaggtgtgagccaccgctcggcctcccaaagatatacttgggtttcttaagggaagtagaggaaaaggaagactgtaaaaacagacaggtaactgttgatggggcttccattgttctctctgataacattgaaggtgatggtttactgattgagctcatcacatggtaacactatagctaccaaccatataatttaagatgacagttgactaacatcatagaatctcagagtttggacataaacttggaattagctgtcatctattttaaccccttctctattcagctgcctttttagaaagagaggcagaatttagaagactttatttcaaattctgttttcagttctgtttcagagtttaagaatacacgttctagggtcaaactgaattcaactactagttgggtggcctagatatttacttctctaagccttaattatcccttctttaaaatgcggcccagaatatgtatctcaaagagctatttaggttttatattaattaatttagataattaactagaatgcctggcacacaaaagtatcagaactcaataaattaagtctattgaaggaaattgcaatagtcacttttaaggttgtcactgagactctatgcttaacaactatcagtttggtgactcacagatcagttttctggaagatttgatttgccaaagaaaaagagagtgagtccaaataggaatggctttcacatttaattgagccataaaataaaatacattttattaaataaattttataaaatacaattttattttaatgatcacctggaaatgatcattaaaaatgcaaatttctgggctccaatcccagagattctgattcagtttgtaggagtggagtctaggaaccatccaggtgattctgactcagggtcaagggtcttcactttaataaagacagttataaaggaatataaattagccaagcatttatcccccaaataactacagtgtggcttgacctggaagagaccatgctttctattccttaagtcagaattcagttagatgagtttaaaccatgtgcaaatacaaaatgtttatagagtatatttatgcacacagagttaaaaaatctatttctcttcaattaaatatgccttctcaacaattatcatttagccactaacattatcttcatctcttttcatcactactgggtacatgtaagtatacagacaagggtcagatttgctatcgactcatccattttcttcttacaaaataataaacaggtttcataaaattggtaaattccttgaataaacaaaagcagctatttcctcctctaaatgcattgtagaataaagtattttcaaaacgcattaatcgaaattgataatgaaagtcaatatataattgtgagttgaatattttaaatgcaattgattacttcgctaaaatgaatatactcaacttacacatggagactgttctggatctaaggagaaatttaaacattttcattcccaatcagcgaaatcccagaaatgtgtttagagtttctaatacaatataccaacaaatgtgcattaactctctatattctaaaagttattgtgtaacaaataacaggagaattatggtctctaattgcagttgaacataaaattgagctggggagaaaataaggcatcaacatgagaaaagtttttcagcattatacaacaatataggctagtggccaagtgtaaggctgaaggagaatctttttagtacatactgtgtgaggcagggtaagctaccgaagatctgcaaaagtcaggcacagtaactcactgagggggttgtggtgaccacagtgggtactgaataaatgtaacctattatttattataatagttgacagtttattttagtaacacaagatatatcacagataagactatgtaaccggtaaaaggtgaatggtacaggcactgagagttacagggagccaaaactgagagaatgctggcatgactggtaagggttttgtgaggaagagacatttgaatggataatgcaggagagagaggatttggctagacagaggaacaaagatcattttagacagggtggggtgttttgatatgaatcgcaggtcaaagttaaaaagtgtttaacgactgttaaaaaaaacagtttaggatgaagccataaagataaatttgaagtagaacaacagagggttctggattccaaaaatcacttgtagtttctggtagaatttttaattgtcaaaatattttctcagtggaattcaatatctctttagatcagtggttctcaaattttagtatgcatcagaattacctgaagtgcttgttcaaatacaaattgctgtgttccacctcaaagtttcttattcagtaggggaaagtgaggcctaagaatctgcatttctaacatattcctaggtaatgctaatgctgctggtcacttggagaaccactgctttagaagacagtgagataggccgggcgcggtggctcatgcctgtaatcccagcactttgggaggccaaggtgggcggatcacgaggtcaggaaatcatgatcatcctggctaacatggtgaaaccccgtctctactaaaaatacaaaaatttagccaggcatggtggcaggcacctgtagtccccgctgctcaggaggctgaggcaggataattgcttgaacctgggaggcagaggttatagtgagccgagattgtgccactgcactccagcctgggcaagagagagagactccatcacaaaaaaaaaaaaaaaaaaaaaaaaaaaagtcagtgagataagagaagagttggatgaagagtttcatggataagaaagagttggacgactatttcctaaagtcaccatataatggaatagccctctttatttcctataaaatttcaccctccctttcataccaacacatagagaaacctacatgaagattacctagggatcaaaattcttctttggctttctaatccctctattgggttcaggtccttaactgtgggaatgaagaggcccatgatcaaaaggagcccaggcccaccaacctggaaacttgaagacaacttaatcactattaaggatattcaagaattcaaaataacagacccaagagactaaagaaagaaggtggaatttttattccaaaaagcctctgtcagtttcatgttgaacattttgtacttgggctgcacttaactgcctgccccttaatccacaaactaatatcatctcaccttggttcacctttttcttttcttcaaaaggcagtcagaagcaagcaggggcaatgagaactttctacctaggcatgggccactgtttaagcatctccaccttctgcttcaaaatctttctccaaaacaaacttccactatgtggtaactatactgtaagaaatcatttaaaaggcagaaagaggaaatgaaatgctctgagagactattttctcatgcataacttcgagggcagtatctcacaagtcagtactttatttttgatggcagacaaaaaacatgttgtgtttgaagattcatgtagaaatctttgtgaaaaaaggtcaaaattggatttaaaatgttcaaaactccaaaaatctctaaagaacaggagcttgtttattttctagcaatttatctttccttaaaataagaagctatataattacaaagtataattaataataataacaataattaccacaaatacaacagaaataatgatagtaagcaccatgggcccagatccccatagttacaaaggataagaatttgtctcagtatatttgagaacagacagcagcccaataatacaggaaaaaaaaattggaaaggaaataatctttcttgtgctccctggaaaataccacagaaaaatagacaatcaaatttaatacctgttgttaaatatcttcattgtacagattaggtcaggcaatttaaatagacaacaacatgaggcctctaatgtctcttaggaaacagtttcaatgtaaattcctaggaggtcccaattcaatttctagttaagcatccccatccactcgtaacactcataagaaggagaaatgcatttgtatggtgttttacagtttataaattattctcacaaacgtgttatttgattgtctcaaaaatcctgtggggtaggtaagtagagaaagtattaatagtatacccattagaaggtgaaagaattaaggatcagagaaaaaggacataaattaatctttattaaatatccacattgggtcaaactgtgcagacctggaaagaagtccaaataaagttttacataacatggataggcttggagaatttgttaactgcccaaagtaaaaaaatggaagagctagaacttgaatgcagataatgcagctcaagatgtaatggtctttccatcagaccatagactaaactctcagttgtaaccatcgtctagttacagtaactgcccctctcaagaggaggctatttcattgccaagaaataaaaccgtgaatagtggtcaggttttctgtttttagttagactgaaagaaagcacatactccttgagaagacgtgcatctttttaacatgacttagtctgtcaagagaataagagagagaatgtgttatttcattcatgtagaatactgacttttaaaagtcactcaatttctctaatgatcagtgatgttgagctttttctcttaggtttgttggctgcatgtatgtcttcttttgagaagtgtcttttcatgtcctcaggggagggcagtgtgggggcagagagaatcaagaaaaatagataatgcatgcggagcttaatacctaggtgacaggttgataggtgcagcaaaccaccatggcacatgtttacctctgtaacaaacctgcacatcctgcacatgtgcccaagaacttaaaattaaaaaaataaaaaataaaaaaactgactccagctacccatggacacaagagacaacacggtcccatttgtcaccaaaatagacaacacagtcccatttttcactaacatactctttgcaagaaagataaactaaaagactatccaacattaatagctagattctggcatagtctcagcttaaactattagtttctaaataagaggcaatacatatgcatagtaaaatagagaataacagcaatggatgtattaacaaaatgcattttccattaattgttatgaattaaaaagtctcgaagctatagatcgagactttgaaacttctggaacaaattaacctatctctttttatttttactttatgcatgcatttacttgtgtagttggtgttgctatgttttcttaaatttgtttttaagataattatattctccctctacttttatacatatatcttctgaggcatttaaaggtttgacaaagcagtgtcttctcacaagagacagaggtttcacttagaagccatcttgggaatttgggctgcagaaatcaagggaggtctagtacgtaagtaaatattagtgcaataatattaaatttttgaatactaaaggaaaacatttattgaaagaaaattgctttatatccttaacaactaccttgctatcgaggatttttagagaattgcagaatttcagagttgatgctatatgtaggattttcttttcttttaattttttttttagagacagggtttcactctgtcacccaagctggagtgcggtggcatgaccatagctcactacagcctcaaactcctgggctcaaacaatcctcccatcttagcctcatgagtagctgggatcacacatccggctaattttttttttttttttttttttgtatagacagggttttgcttgggggcccaagcttgtctcaaactcctgtcttcaagtgatcctccctccttggcctcccaaggtgctgggattacaggtgtgagctactgtgtctggccccaaagattttatttttataatgacagaatatcagtgttagcagagtccattaaaattatatatgacaatcatctgtttaacccatttatgccaaatgttgcaattttgtgtgtgtgtgtgtgtgtatgtgtgaaaaatcagaacttggtgatgaccttgagcaacaggatatacataactgccacaagcttagcattccaatagtggaacactaggcataaatgggttatggcttcagtatcctgcaaaatatccctgtaaggtagctgtctatgcttaaacaccttggtcttaggaaactaggatttgtggatattaggcaatgttatgggctgattgtgtcccctaaaatacatagggtgaagccctaagctcctaccaactgtatttggagataaggcctttgaagaagtaattaaggtttaatgaggtcataaggttggcactctaatccactaggactggcgtccttataaggacaggaagagacatcagaggttctcttgagctcacaaagaaaaggctgtgtaaggacacagcagcagaaggctatctgcagccaaagacagaggcctcaggaaaaaccaaacctgatgacacctcagtattggacttctagcctccagagttgtgagaaaccaatttctgtttgctagtccacccaccttgtggtattttgttatggtaggcctacagactgatatggtgcctgtatcagtgcctatatggtgcctatctcatcacaacctgtaaggaaggaattacttaaagccaatttataggtatagaaacagactatggaacattcaagaaatgtcccaagagacaaggattcaataagtggcataactgagatttaatctaggtctatcttccatattattttttaccctcctattttttacctttgaacacagaaggctgctacaaagttagtgtttcatattgacttgagtattttattcttgtaggtttcatcactggctgatggtctatttgttggagtaacagaaagcaacataatttatcttttagatgactgtcattcatatacttgaagatagttattacattccttcctcctgaatttcctgttaatcccggttcccttaaccattgctcatatcacatgtttcagttccctaccattctggccacttatacctgaagatgttcctatctatttaaatttcttgtactgggttggaaagtcatatctctgctacgtcattcatgactagtctttttaaaatataaaggcaatatcttgcatttatccatttagaaaatttcatctgttagatgtagcccataattccagtctttcaatgtctttggaattcgattacttcattcaacaacttttctatgtatctggactcatgtcatctgcaaatctaatgaatatgttttcattccagttattgaaaaaaacttgtgaccaagataaggccgaaaatatccttgcaatatgccacaggaatcccctatattatgatattgagccatttgtttgtacctaatagtgtggtcaatcaaccagttactaatccagctgtacctacattagttactaatccagctgtacctagattagtaactaacccggctgtacctagattagtaactaacccggctgtacctagattagtaactaacccggctgtacctagattagtaactaatccggctgtgcctagattagtaactaatccggctgtgcctagattagtaactaatccggctgtgcctagtttagtaactaatccggctgtgcctagattagtaactaatccggctgtgcctagattagttactaatccggctgtgcctagattagttactaatctggctgtgcctagattagttactaatctgtctatatatctaacccaggagatatcagatcacatattgtagacatcattttactgaagccattctattgtctagcaagcaccacttctttcagtggatcatgatacattgttttatactttattgctttaataatccattctagactgttgctcaggactaacagcaagtagttgcatcatcataaattgcctttctatactttctgtaaatcagaagatttccacatctctagttatctaacattgtttctcttctcctcaaacatggatggtagtaattgactatctcattgacaaatcctctcatgagtatatggttctctatccctatttttaggctcttctccttttcctttttttcctgttatcttccaaggaaagagtcactcatgtttaatcatgaacggtatgttggtcagagatagacctgcaaactggaacaactgagaagatttatacaaagtgttgtcctagagtccctgactgtgcccgtagaggaaaatgtactatgattaggtgaggctttgctctcatctccacacagggctctgcatggcttttctatttcacttctggcagtactcctggggaaggctacatccttttcctattcattctgggtgacttcctttgccaaagattcaagacagctttgtatttttcagtctttaactgagaaaggttgtgatatataatgcctttattttcccatgaagactttctctgaggcatgcacatagccacgacctttacctaatcaagaaaagttgcttgggcagtgggggatggggatgcaggttggactttaaatgcacaaatcagttctaataaaaacactgagattcaggtgcctgaggttagaaatactggagggaattcaattacactaattaatatttaagaagggctagagatcacacactgaatgtgggaaactaggccagtcagacatgagcatatggggagggcaagatcaacagataaaagtaacaaacaaatcatacataaatgctccaacaggaatgaaatagagaatataaaataaatgttccaacagacactgaagaggaggtaaatggtctaccagacataaaagcaaaatgttccaacatacacaagacattttattggtttaatgtaaacacatatattataaaaatgatttttccacataagttagtaggaaatgttacccatttatagaaacagacttacgggttctatgaattcacagcatactatatttgctctcatttcctcactggctcatcatgcaggagtctcaataaggcttgactttcataacaggtagttctccaatgcctaagcctacctggatacccaacgcctgacagaaggctgaaaagctgcagagtgtgcctgcttctgcacaagtttttctagttccggttgctctaatgtgatttggttggtgtcacagctaataccacattctctatttgatctgatttttcatctgtggcccagacagttgattctgatttttggtcattcttttatagacttgaaagttttctagagaaggcactagtggtgccaggactatcttgcttccttctgtcctgtctacactagcatttaattacacttttctacctcttttctacctctatgccctctcaccctccttcatcttgggagcttccaaaactagaagccaagagaattaactaggttgctttataaaaattgtatatatgtagggtaaacatgacattttgatatacattggattgcttttgctatcaacggcatcatgtagaggtagtagtagaagcatggaagggtagaagaaaggactgagactgatatttggactcctctttcaagttttctgatgtacacatagagtaactagatggcctggactgtctatgtacaatacggaattttaggctcctggaggaaacaaaccaaaacaaaaataaaaacaaagtccttttccttcagtagctttagctttagaagaataaatgattcacatataccaaaacccacaagatacggtatccccaaaaagttaaattgtctcttacctaatagaggatcagaaaaagaaaagatagttatttcctaaaaattgtttgaaccaaatttgtggttttcaaactatgcttcatggtccccagacttacaaagagatgattacaaaaagattatcaaatagatataaataaataaaaaaataaatacatatataatatgtagtaaatacatatatatcaatttgcaattgtgataaaaatgacatgcaaatttaaatgtattatataaatttaaaaaacactggagaccaatgtgttattacaagttaattatgtacaataagaataagcagctttcatgcaggcctctaattaaggctctcagattggaatacaagctgttgaaaaaaactgttacaatatgcaactacttatcagtctcatgatttttttgataccatatagtatagtacagaaagtcttcacttattgccatccataggttcttggaaactgtgattttaagtgaaacaacatataatgaaagcaattttaccatagactaattgatataaataagagttaagttcttatggcaaattttgggtcacagaaacatcatcaagtttctaaataaagatcaaaacacttttgatattaaacattgaaataaatgtgagctgtacatgcatttaagaaagattaataaaagcaagaaataaatgtgagctgtacatacatttaagaaagattaataaaagtaagataattatttaatcaataattccagttcagggtcatgagtggatggagcctatctcagcagctcagggactggtaaggtgggaaccaagcctagacaggatgccattctatcttagggggcactcacacacagccacattcactcagacacacccatgagcctaacacgcacatctttgggatgtgggagaaaacccactacccagagaaaacttatgcagatatggggagaaagtgccaactctacacacacagtggctcactgggaatagttcttttttttttttcccatcagcgttatgacaccatgttatttgagtatctgctatattccccatacaaaaatacattgatttttgagccaatacaataatccaatgctgagtttttattcctttgtatatttgccattatattcttattgaatgactttataatattcaatatgataaataatctgaatttgaaaatgagtttatctcaataaaatattactcattattccatatgttaagtttctaataagatttagtttgaaaagaggattctgcttgtttaaaagaaatatgaaaaatgtctggatcaaataatatatatgtatcctgcaactcaaggcagtatgaatctcatatggctccaggctgctcagtttctgaatttatcaacttgctggcttagaccactgtatacagcagatgcattgggcccaaactagattttatatatgggccactattccttcaggcttaagaacagtatttttatactgaggaatagcttatttatcatgaaaccatcatacatcaaaagaagtcacgttgccttaaacttatccagtacatgaaatttatcaccctcaaagttctagattatcagaatttaatatattagtttaaaatataaccagttgataaccaagaaataagtcaatggaaacctctttaattatctaagcagctcatcttgtttataataattgtataacttacagatacatactcatttatttttcaatcaaaatatattatattgaaagacttcagaagatttttttcttaatattaaccaacattacttatagttaggaacagagtgagccaaaaaggattctcaccactacagagaataaaactagcaaacctggggaaagatccattttccaaaacctgaactacactctatgatggtaacgtttcaagtatttataacacttaagtataagtcaagagttgattgaatgaggcctttcatgatgtttatgtagagtagtcaaaccagaattatttatgtatttgtttatttttaaaggctgtcatttgaaagttatcacagtataaaggtaaaggatacaccggagtttccattctagctccacattcctggctgtgtgaccttggataatttagttaaactaaacttcagttttcacttctgtaaaatgaaggaaatagtagaggttctattgtcatgaatttctagcaagaaatcaatgaataaatgaaatgatgaatgaatgttgcttagcatgttgcctggcacataaaaagctctcagtaaatattaactgtaattaaaaaatatctaaaagccggttgctttcttttggttatttttttaatatgacttgattttattcataacttactgactatattttcttcccttctggaatgatgttctattgaggtttctttttcttttattccagaatgttctctgagcaatctcttcatttctgcctcattcatcagataggattgtaggcgttcattttggtagttctgcatttggttttctgtcactgcttatgctgttttcttgttctaactcagtggtttaaaaagtaaaattcaagtaaggactaaacataagagaatttactgggactaatggttatcaaaattgggcataaagggatgttattaaaaataaatcacacagagggagaacagctgatgacagcagctgtgaaatggatgtacatggtgggaatcagtgagccccaaagaaacaaacaaaaaacactggagggccatgaaacttacatgatttacaagggaaacccaagctttatgaacagcctctgaagactacagaggccaagcaagtcacttctggatgaaaatttggataagacagcaatactgaaaggagttatgttccctgatcaaatgggagctacagataagaaaagaatgagaaataaaatgaaaatctttaccgagtttgatttctttattgtataacctgcactgaggggacaccatctctgggtataccactatagatacacttaccaaatgcttagtgattattgcaatagttagaagagaatatattttaagagccaaagttacaaatctatggacaagatgaattaatattagaacccatgttgagatatatagggcccaagtagtctatgacacaaaagtttgtgtttttatttaaatagaactctaaagacttagttgtttgaaatatatttaatgtagagaaacatttttttgaaaatttggtttactgtaaagatgaatggagatgtctaactttttgccttttttttctagatatggacccacctctctattttcaagagcattaaattcagttaaaaactaaaaacaaaaatactgccaagggattgagacggtaaagtaacatcatgcctgatagaataaactatcaagacagcatgaacaaacccaactgaaatggaacaagcaagcttaacacaagtcaaagaagctctctagagtgttaaaatgaaaatacaactaaacagaaccaaaactgctattcatgggaatagcaaatgaagaattttcttcagaatctacacggataacttctatgagattattcaaaatgtggaaatttttttcagaatttttgtttccaaatggaatttaatacatttcatgaaacaaatgaaattttatcagaaataaaacatttaaattaccaaaagcctagcctccttaggaaggctgttttaggaagacatgggtagaaatattttcatcaaagccctgatcatcttccctttttgaggtgaaatcactctactctgctggaaacctacatttagttatttataaaccagtattaaatgtatattgtttcaaatctctatgtaggaaaaatatcccacattcattcccattttactatgaactgtataaacttccaaaatcatcatgaaaagaaaaacatcaccctttctgctaattaagtgttcttgctttttttctagtaatgggtatttgaaaaataacaatatgcaagagtatgatcttacagtgaatatagccactaggtcaatatgataatttaatgtgagactttaaaattgagctttccttttatgctactattctctaaataacttctttatttgctatgattaaaatatcttttcatcaaatttgatataaatatactagatatggtaaatatatttatcatttaaaataacaattgaattgtacaataagcactatatcattgcccaatttttattttgataaaatctttttaagtgatatcatttcatgttaggctttttgtgctgcttaatattataattaataattcatatttttgtctttctcctctctgacaacttttatttttaatcggtgggcatgtgccaaattggtttgttatttatttataatgtaaaatgacaagggaattgaatatgtgaaataagatagattttctttcatatgacaaaaatttcttagtaatggggatgcttcttgcttacccttatagattcaagggttttagagaggttaggtcaaatgtcacacttctcatataacaacatgtggtaagtgcattaaatagactgttcattttttaaaaattcattttagttttgtgaagacatctgggcacatgcataaaaaacaggacaaaacaatatcaaaatttgtaaaagactccctattccgataaatcctatagtgtcaattaagtaaaaattctgaccaaacagatgtatttgtattctttcctaaaaactaaaacaggcaaacgtaataggaataaacagagaacgtttcaaagatacagaatttccattgaaaaaatcaaatgttctgtctgtaggactttatagaacattaaataatcttttcagtactgtccataaccagaaaccacataagctggatgctagactattgactagttatgacaaaaaattcacagtttgatctcaagggcatcagcgatcctgggctcaggtgatcctcccgccttggcctcccaaagtgttgggattacaggtgtgagccatcatgcctggccatcgtgccaacgtattgaagtggaaagaactaatgctgagcagagaatgggccatacctgggtggttttaagaggtgctgctataatgaaaaatcacaggctcacccaagaactaccgtggaatcagaacctctagggatatggccctagaatctgaattttaagccagttcctgaggtgcaattcagtttgagaactacagtcttaaggcaaaacctttctatcataccagagcttccaattgtcaggccctttgaatccaccctttgtgtcaaaccttagataattcaagagacataacaaacgtgatcatgttacatgcttcctcacagatttcagtgtctcccatttcttctattagtttaaaaaacatagtccaccatcacagggccctgtttaagccagctcctcctctgtggctctgcctttgtggtcaacctgtgcaaaactttgaggctgtgacatcacttagtcagtctccaacatttggaacaagagaactttttctaacaatttgatcccaattcctattttaagcttgagcattatgaaggctgtatctgtatataatattgaacacttcaaaacaattttagatcttaattattttgttattaaaatgttgggggtgtttaagttgacattgagtcagatgtaggaactgatatacagtgaagttaaatcctttagggtaaactcattcagtggtagaggctgaactacagagcctaggcattctgacattccaccactgtgcttatcagcttgctccttgagcaaaccttttcctgcctttatgagaatatgcccattttatgggctctgtatctatgagatattttacctatgcttatgtacacatggtgtttatctttcaaagctggactatggaaaagcctaattttacaaacatgttagtaaaagattatgtaatctgaggtgattacgtttaaaatggcaatgataatgatgttaattccagtcctgtgaggtactgtttctgatctggaaagagcagttttcttttttaacagcttattttgtattttcataatccattttaaggtttggtattaatatagacatgagaaataaaatataactgttgccatgccaaatgtatatcaaaaagttgctaatagccatgactgctatttggttaactgtatttcactatttaaataaaatgatggaaaatggtgtgtctaggatctcattcataataatgaaagacaatagaaactattagcataggtatgatgctaatgaatggtaaattttcaatagagatccatcgaccagattgtttgaaaaatgtttcctgtgggtacgaaaaatgcacacaaacaaacacatgcatcaaaatgtccataattaagtttttagggaaaaataacaatatatgttggttaaggactttcacttaaatggcattatagatctttcagaaatgagagttgatttatacttcagtattttggttcccaaaggttgggacagtgggtggtagaggagaagtagagtaaatggaaggtatacatgtatgtgtgtgcatatgggcaactttaagcaccttgaatttaatgaacaaaaaatgtcattattctgtgtttatatatttttgtgtgaaacaagtacctttctctatcactggagtttacatggattttctcatgatatcttttgagaatctctttaaacactaaaatacatttttccaaatgaaaactcccataattctgctttattaatatctgaatgaatatttccattgatttgtccagaagaaggaactgagtactgtttagagagcaatctttttcatgataattggcagcaatgtttccctgctatcagaaagaaaactatagaaatacgaaactttagataaacatggagataaaaataatattatggagtccaactggtatctttgaggtgaggacaggctgagatggactccttggcttccttctgtccaaaaatttcctgtttccctatttcctacggttaccaccatggaacatgttaaaatctcagtagggactctgtttcaacttttcctgtcaaaacacagtgaaaaagcttaatggaaaaaaatgtccttcctatctccatgccaggcacagtgtaagatccacaaacttaaaagccaggaaaatattcttttatgtgccccaaagctgggcaagtgacctagtactacaaaaattcccaaataggcatgtgacctgactaatgtgtgctgtgagatgagtcaagaaaaatggaaccatctgtacttttattggacagtcaaataatttctttctgtccacccaaaaacataatttctatgttaagagtgatacaaggagacttttagaaagtctaatttttaaaatcagagatattaaaatatatgaaaagtataacctattaaacactggtggagataagcaaataggcttatgaaatcattattgctttaaaaatttgttacctactcattgtgtactaaggcttctctacgacatacagaagaggccggtgcggtggctcacgcctgtaatcccagcatttcgagaggctgaggcaggtggatcatgaggtcaggagttcaagaccagcctggccaagatggggaaaccccgtctctactgaaaatacaaaaaaaaaaaaaattagctgggcatggtggtgggcacctgtaatcccagctactctggaggctgaggcagagaactgcttgaaccttggaggcggaggttgcagcaagccaagattgccccactgcactccagcctgggtgacagagcaagactgtaaaaaaaaaaaaaaagaaaagaaaaaaagacatacagaaggaaatcagggaaaatgggaaaatgaagggaattaacaaattgcaataatctttaagaagtagagtatgaacaattttccttttctaggatgaaagctaccaacaactgaactcttagagtgagtgatggcagaaaaaaatagcaatcaagaataggggcatgttagtttttagacatgtttacaaaactctgccttttatttcttaaacccataggtcaaccacccatcatacctacattaccccatatgacaagtggatttgttgtatgtttcaagtttttaatcttggtgggaagggggagggcagagaagtatttattggtaaaatatcataataaaggttgagcctgtcaatgattgtacctaacaataataaatatgtgtaggaagtaagaacggcaaaaatgaagccgggtaggatactgtggatatggtgacagacaagtatctatacgaaatcctgagatatttgtcctccatttcataaattaaagtgccccctcttttgctttacagataaggaaactgaggtgcattataatagcaacagcagctgatgtgtagtagatccataccacaagccaggtacgatgtcaaacatttaaatgtatcatttaatttaattttcatagatctcctacaagacaagtgctattattttcattttacatacgagaaaactaaagctgacagagattaaataacttgtccaaggttgcatagtaactaagtgaaagagccaagatatgaactcagatctgtctgatttcaaaacccaggcccttaaacactaggccagtggttttttaaccctgattgcacattagaagcacctggcaagcttttaaaacctactgatactcagaccctaccccagaacaattaaatcagaatttcttgtacctgggccctgatgtgggtgtttgtttcaaagcctttctgggtgactgtaacatatagcttgggtaaagaagaattgttgggtgtctcccatggaggtcagtatatctgtgccaatatgtgaggtagtacaagactcaagtgtcctcagtctgtctgcagtggtttttcccttgccccatcatgttcactttgacatcttttttttattatgatttttggagaagtaatatacaagtgacaatttttttacaaagcattgtcacagcagaacatggtcataagtccatcaaagagaaacctgttcatatctatgtacaggctatgatgaatgaatacaaagaagactatgtttattactctcatccccaaagggaagtataaagctggccttaaaagctgttcataccaaagctaatcactaaaatttggaatggcttcctcctctcctttcacaaatgcaatagggtagccactggatctaaggggaaaagatccaattaccactctttacaatgctttttcacttaggatctcaagacgactgacagtcattcaaaacataaaagtaaagtgaaaatatctctagtagaagtgaaaagaaaatgtctgtagtaggaagaaggcctaaatttgtgtctatactctgccactttactgcaatgacttgaggccaaaagtaaagtgacagagtatagacacaaatttactgccatgacttgagccttgatttccttttctatatgtacttaagccatatcatccttagggcagtgatccaaaaaatgtggtccccatcagcatcatgtggaaacatatcagaagtgaaattatcagtccctaccctagactctgaatcagaaacttggtgaaggggcagtaatctgtgtcttaccaaacattgcaaataattctgaccacctccagctgactctgatgtatccacctccatggggttgttgtctaagaataaaaggagatggtccataaaattgttattttttttactatctactgaaatcagaaatttcaaaattctctcacagagatattttagagaaataatgttacagcctacattagttagataataacctcatttctgaatttcactttgaatgtgtagacgaggcacaagtcaaccagaggttatgcaattagcttggagtcaaagagaaagcaaggagtagagctgagaaggaaaccccagtgtgaacttgatttttattcaatcaaactgttaaggtaccaaccacgcactttcatctataatcacaatgaaccttttaataaacatgtttctatcctcttagcttaaaaaatataacagtagctttttggattttaaaacagattgacttctatacttctgggctaaaggcagctcaagagtcaataagaatcacaagctttccacagtgagaagaaagtgcaattgcccagtcctctctatctatgaagtgcagacagtattcctcttcctcacctcacactttcgattattgcaatggtggaaaccatgataaataaaagcgcttatctagtggtttggttttcactaaaattacagacttctgtaacattatttggataccataaaacacaaaccaaattttaggagatgctttagggtgttttttcccctgccctcctgtcggaagccctctatctttttactgtaatttatctgatatagctaccaagatgcttgatacttttacatgcaagggtgctgaaaaacaaagagcgagggaatgggttgttaatgaaattctctgattgtaaaaagcactctggaatgatcaggtggtaaataataataagaggaaataacataaagtgcttaggtgctacagcgatagtcaccatataaatgcagaagagatcagacatgaatagaatttgcattttatgcagctgctgtgtgtgtatatagaatatacagtagctaatttttcaataatgctggtaaaatattgttcaaaatctattcttgctgtcttctcactttaaaaggcattatatagaaaaacacccatctgtcctagtgcaatggtgaatgtgtgcaaagagcctagaaaaagagcctctttgcatacgtgaaaaaaaagaactcaaataaaaggagataatgaagaagagacaatagtaacactattagaacagctatgcagacaagcacaaaggtgatctttgaaaaacatcagggataaataactctgttaatgtgtggcagagaaactacagttaagacatacagtaatataccaaaaatatagacatgcttttattttgtctactgggctattgtgatagtgatggttgtttttgaatagaaaggaagaagagagtgggaagtaggatttcgttgtttgttgttactgttgctgctcagtttagaacaacaacatcaactacacaccagacccgtccaacagttccacaaacaatgcttaccatgaatctgccctcaattttcttgttgttattttcccttaatacttattgataacccaatgcccattcattagatatgctaaatcctcgtccatggttactctcctttggaagagactgagaagatgctaagagggagttcctcttacacataagggaagagtctgtttaggaatctgagaaagcagaggccaggataaagagaccactagtcaatcaatactaagcaccgaagactgaatcacccaaagatacaattatctcccttcctttgttctgtctcttagtcaaataaaggattgtttgtagaaccttttctgttcctgatctctaaaaagcaggactggacttgcacatccaactataattcaaaatatctcacacttccaacttgaaagaagacataaactgtttcaaagaaactcagagagagcaaatgcatattcacaaaacttacacttattcctagaataggaaaatggagagagaactaaccacataagaaagggctaatcataataataatagtaataatgatgatatcaatcaatactttggattctagagaatgatttatcacaaaaattcacctgtattaagggagactccaggacaaggaggtcattaagctacatttccatcttcaggattcagccaaactcagactctccggaaagctgtaaatgctctcagaacagactttagtaatgagattggaatgaacactgggcctatggcgtaaaagcatctccctgccccttgttctaaaagttaactattaaaccatgtgcggttcatcctgatttggtttactcaattctagaaacaaggacatgctgatcagattgccctgggcaattgaatacctactgaagcctttgggaagacagtgttcttcccaccacccctacttaaaaggcttctgttaccagactatcaattctgtgttactggtgaaggatagaaagtatcttcttttgaaggacaagtttttcactcactgagttttctgctttgggtatatactcaacatgttaagtgcttaatcttttttcccccattcccctttttctactgtagtgtgttttgtttgtttgttttttgtttttgtttttttttaattatttgaagagtcacttgtctggatgcttcgttctagtagaatttggctgatttttttcccaacaccttttagtggaatgcagtaacagatgcatggagggagaattggtcttaacagtatttttaggtttcatctgtgtcagagagagatctcttccctttattgatttcttgcatacactatccacactacagcttgaaacagctacaacagtgtttgaaaaattggttgttcctcactgttcaaaccatttttcaaaacagtcgttacaagcttcattttactttctgttataaggagggttttgtttgggttggtttcattttccttgtggcgtcatgctagcagagaaacacagtcaggaatatagcttttaaatgtggtatgattgggattataaccatatcagaatctatattgaaaatttattagattgagccatgtgcagttaaaaagaaagaagtcagaagtcttcgatatttttcacaaacatgaacaccatctcatgcaaacgttaaaattcaccaaacaaatgataccccactgttggaaagatattttctcatgtcaacaactcaggaaggagtggggagggaatgggacatatacatgtaaaatttttctctatatttttgataataactctctgtgaatatgttttactacctaggtaatgcttatatttgtaaaaacatatagttatatcagaaagtcaattttgaataaacctgagaatggcaaactataatttttaaaatactaaccttttagaactgttcattttcacttttatttccaggactcactatcttaaagagaagaataaaagttgaagatccttgggattaacagaaagggtggaaatagccaaatgtattcatatttttggccaggcgcagtggcttatgcctgtagtcccagcactttgagaggctgaggcaggcagatcacctaaggtcaggagctcgagaccagcctggccaacatggtgaaaccctctctctactaaaaatataaaaaattagccaggcatggtggtacacacctgtaatcccagttcgggaggctgaggcaggagaattgcttgaacccaggagatggaggttgcagtgagcaaagactgagccactacactccagcctgggtgacagagcaagattctgtctcaataaaataaaataaaatgacgttcatatttttaaaatacagcaatattcatttgtttaaaaaacaagattgaggccgggcgcggtggctcacgcctgtaatcccagcactttgggaggccgaggcgggcggatcacgaggtcaggagatcgagaccatcctggctaacacggtgaaaccccgtctctactaaaaatacaaaaaattagccgggcgaggtggcgggcgcctgtagtcccagctactcgggaggctgaggcaggagaatggcgtgaaccccagggggcggagcctgcagtgagccgagattgcgccactgcactccagcctgggcgacagcgagactccgtctcaaaaaaaaaaaaaaaaaaaaaaaaaaaaaaaaaaccaagattgagagcacagttatatagtgacttttgatacatacacaataaaacttattgaattttcaaaaagtgagaaaaaaactactctgctttaaatttaaagtaataaataataatgaagacatatcaacattggtaactgtcagagtgagaaaaggaaattgaacattcaatgtgaccagaggaagggtgaacatgggagatactgcccaggaaaagtgctcatgatgagtaattcaaagacccagaatcttaacataaattttttatagttttcttttcaagggactatttgaaaaaagatggttctggggtttttgttgtagcttctttctttctttctttctttctttctttctttctttctttctttctttctttcttctttctttctttcttttctctctctctctctctctctctctctttctttcttttggctttgttgtagcttcctctttctctctctctctttctctttctttctagctaaaatttcactctaaattccaggaaattttcacgagatccttttagaggttctgacacaaataaagtaaaagtaaacctgttgtggcaaagttactaactagtctacactaactctcagtccttgctcaaagcaaaataatggagtttggggtgcaatctggtgaactcaatggtccaactgcataaaggcaaagaggaaagccaggcttgggcacttctgtagaaaatgaagattactggtttgaaggccagtcttctcactgcttcactgtatgtggtgactattgttaaattagatatccctattctgatgaaaaggcaatgtgctatttttggggtatacatgtttcaagctgtaaactgcaaagtgctgtataaaagtaaagtggtgttaatgcctcataagataaacatatagattgatgatggaggcatttaaaatgctttaattgcccactttaataaagcactaaataattataataaaaacaattcttcagaaaacttggtgggaaaaaggcctacaggatatgtttgttaagaataattagattttagttttggaggaaaaggtaggacaagtcacaggaggcactcgatgagaagtcaggaatgcctagtacataagccacacatattaagttgtagtttcttcaaaactgacaataacatgtcctccaaaaccaaagggaaaatcaaaggatgttgcctatacttatgtaccttttgctactggagatctagtcaatctatagccttggattcatagttctataacatgacaacatagcaaaatctcaccaacactttgttttaaagaaattggcagctgggtgcggtggctcaagcctgtaatccatgaactttgggaggccaaggtgggcggatcacaaggtcaggaatttgagaccagcctggccaacatagtgaaaccccgtcgctactaaaaatacaaaaaagtagctgggtgtggcggtggatacctgtaatcctggctacttgggaggcagaggcaagagaatcacttgaacccaggaggcggagcttgcagtgagccgagatcgcaccattgcactccaacccaggcaacagtccgtgactccatcaaagaaagaaagaaagaaaaggaaggaaggaaggaaggaaggaaggaaggaaggaaggaaggaaggaaggaataaattggctatgcctccaagtgaattatactataaacttctttcccattaccaataatgtaaatatataaccaggcacaagcatgtggaaatggagaaaggatgaacgttagtcttagaaactttggtttgtatcccatttccaccttttaacaagtcatttagcctctctaggtcaagattttcttacctattaaatgaagataatggtacccatctcacaaaattgttttaagaattaaatgtaaaatgcttggcacagagaggtcactcaatacatggcagccaaatcaccacatgcagtaaaacccagataaaatatattcagccaggactgttgctctgtgagtaggtctggtatccatgctacaaaatctattaagcctaaataatttggtcattttagcaatactctttagagattttttaatgacatttcccaaaggtcaagctagcttatggttatgtggaactgctgcatttataagagagtttagtgggttcataaaataagtcttgctccccaaatccggatcataaagaccttctatcataaaggataagagtgacatttaaaaaaccagtttttaaaaaatgatggtagcaaataaatgcagatgatcaggatgacagcaagtaccaagtcaaagcaacacggagaagaaataggccctagcctgcaggttacactttaaacactgaggagaaatgggagagtaaagagcaacactgagcctcatcggactgtaggtgaaaaaagattcaaaatctgactctaaagcaataggtaaagaaatattttaaaatgcttatctgtaggaagaaaagcagtaaagcagaattcctaggaattgagaaacacttaggaagaaaatgcttaagtagtacgatccaaggtgaggctagctgcagaaaatacaaatatttatgggttaaatcaggactgaggaaaatataaagccaaatatgggcagctctgagggggaaaaaataggcagcttggtactcaactgtcatcacaattcatttgtgtttcacgtcccactgtttgtgacattaacagaattttgaatttagcaatggactatttttgtattgtgaatctctgcagccattttccatatgtagctaccactgtaactagcaataacagccttttgagctttaaaatgcttccaattaataagattcaaaataggggtcacctaagagttttccaagttaattccctttgtctactctttgaagcagagtggtattcctgctattcatttgcattgaggccaaattatttgaccatttcagtaagatatccttaggtagcttttgcttttattgtcattttccaaaggattaagttagttttagatttttgaactgcattttcatttaactaaaataactaaagcaatctttttatgagggtatttaaatagatcaaatttataccaagttcctactgtgtgtcaaacattagcaaagcaatttaaaatgttattatttatatatcaatacatacaaatcatatgtgttatatattaatgagcttatagccattatacacaggacttttatgtgttattattgttgtggttatttctgttgttcgcaggtatcagttatcaagtacctattatgttccaagaactctaccaaggactatacacactcaccatgtaatgaagatattattggtttattttccatttgaagatttagtcacaaaaagtaacttgtccatgagcatataatttgtgcattctcttaaaatcacttaaacttccacgtaacacctggattgacgtatgctttttcttacaaaatatacttcaattcaataaagattctttagtcacctactatgtggcacctgctaggatagttatctttgtttgctattatgctaaatcacagatctgaccattagaatctcttccttcctgaaaataccctctttaggtaaaactgtatttcttatcattttccatcactgattgaataaagaaaggtggcactatctggaaaacataagagcgttggatttacaagtttcttttaataaaacaaaccaagttaatcacaaattgttgcaacaaaatatgtgacatgaagggcatttaaggcacatttagacattatttctatctagaaacagaaatttagtccacataatgtcatttatctactgagctaaatcgtattacaattttcatctataaaatccagattcttaatgtgtgttggaaagataatatctctgacccgctctcagtaagaaatgtgttttgaattgttttgttagtaataataatggagttgtactggacaaaatatattttcagcaagtttctctggtaataaaaataactataatagtagtaataatactagtaatcaccaataaataatagatagcatttattgaactctactatgtgccaggtactgtgattagcactttacatgtattatcttattaatttctcaaaatattacatgaggtaagtaccgtaaatccaatttaacagaaaagcacattgagatatagaaatccaataatttggtaaagatcacacagatagaaaagaggtacaagtcaggattggaacccaaggaatctgactctcgtatctatctactctaggtgggggatatagcaggtgctatggtgtttgttcaagagaatactccatttgtgttgttttatctaccttattagggttggggcccatttggtctgtaagccaaatctgaagacagctgaaatgagttaaggtttgaattagtgctattcacactatctgccaattaaaatgctcccttctgagaagctgtagccagttggcataaccttaggacataatacatgctcaaaaaagtatctgatgaatgttaacaatggtttctctaagtggtgattttactttctttaaaaaatactttttcctattgtctgaaatattttcaacatgggcacattacttaggtgatcaaggggaaattcaggactttacttaaaaaatgtttttgttttgttttacaattaggttgttagtctcagttaaaacataactcctgctgggaagcctttcctgttgctgtactctctgaccttttgaaggacagtactccttactctgtctgcctcagaaccttatgaaggccacatactattgttaattatcagtcttctctgctttatgtgaagtcccttgaagattgaccccattacttatctacctcttagagctctaagcatcttgagtgcctaccactcagttcaatgaaaaaacccagaacacacatacaccagaacaagcacaaaagatgaaaaagaattattttagggttgacaatgcacactcttggtatttgcagatgacttgtttctccccttacattatgtgcaggtccccatggaaagaagtttcccacaagaagtgtcttgaatttactggtctcttctctggaggattttacaaatgcatcaaggaatacacacacacacacatacatacacattatgaaataatatgaggataattagaagtaatggggaacacaggaggcaatttctaaaaaatgaagcatattttttatatatataatgtatatatgtatacctgtatataatgtatatatgtatacctgtatatataatgtatatatgtatacctgtatatataatgtatatatgtatacctgtatatataatgtatatatgtatacattatatataatgtatatataatgtatatacacatacatgtatgtatatatatacacacacgtatatatatatatatatatacacacacacttttttttttgagacagagtttcgctttgttccccaggctggagtgcaatggagcgatctcagctcactgcaacctccgcctcccgagttcaagcgattctcctgcttcagccacccaagtagctttgattacaggcatgtgctaccacgcccagctaattttgcatttttaatagagacggggttttgccatgatggccaggctggtctcaaactcctgacctcaggtgatctgcccgccttggccttccaaagtgctgagattacaggcgtgagctaccacacccagccacatttatattttatattaagtaattttgttcctttcctaccccattataatataaacttcatgaaagtagaaactttattttattcactacagtatccctagtccataaaagaaggcatggcattacatcctcaataaatatatgtcgaaaagaaggaaaaaggtatagatgtttccactgtatttcttatatttttctggaaacaaaggggaaaggtgttcccaaaaggtttccaggaaaacttcaatcaccaatgaaactgcaagctcttgtcatgttcctcagaccactacctaattaattcctttatgtgcaatacatcctttctagcctgttgatactcaatttctggcgctgctgtaacttgtggagcaaagagtgccacgtgagaggtgcttgggccccttcatactgtgcctcacctgcgaactggggaggccactgccatttaggctccagcatcttttacaggccagctgagccaccagaagggaaggggagaaagagacatgcaagttctcagaatgtctggtatattcactcacacacatttctcttctcttctcaaaaaggatcctggcaacaaatcactgattaatgatgagagaaatggaatcaggaggaccccatgataccctctcatcctagttttgggagataaaatctcccactgtggggaggaggaagaccctacagggttttcttatgttttgcagcttccaaattgtagtagggtcctattctataaaattgctaccaacaactgtatacttagtgatataataccatatggaaccttgagttttacttaaagagtagattatgtggcaattcatagttatcctagtatggataagaaaatatcctagtaataacataattattctagttatgagtttttttcagacaagaaactcttttattcatctttttatctctagtgcccagactcaacatatgactttgtatatagtagttcttaataaatgatagcttaaaaattaaataatatttttaaaatggtgagatatggcttaaaggggttcaaacaaattcagagttttgtctaatctaggtgtttctagatttatgagcaggcaatcacatattattgagtatgtattagtgttttagttagtgttaatacagtataataaaccctcattgattgttgtagagaaatcctactattttacactcatatactagaaatgtttaaagtcacaattttaaaatagtggacttcaaactttattatgcacaactaacctgggcagtttcctaaactgcagatccaggctacattctcagagcttctgatttagaaattctggaatggggttcaggaatctccattttaacaggtgctctagataatcctgatataggtaatccctaggtaatcctgatacagttggtccttggactacttaccatggactaggctacaaggtaatataataataaatctatacagttcaccttttcaatacgaagagaagagactagcctattaaatgtgacttaactatcaaaattacccgtgaaaagaataggcaatttgctaagacttctcaaaatgaaccaagggaggacataagggcgagaaatattaaatttcaagccagaaatgactctttttaaaacttcaaagagactgacaatctgcttaaagtaaaagtggaagaagaatggcagcagtacagaagtgttttatgaacaatttaggaaagcaacattgattcaagaggtttatttgataacatgttttaatggttattataaaagtgaatgccttctaatctttgatttgctgctaaaatatatatgtatttatttacatgaaattttttttttaaattccccccttaactccctactttccacacatttttagcttgccaacattactgcgttaatggtgtcctttttttctctctctagaaacacatgccctgggattaaaaggggattactttggtctacttccacatccatgtcccagggaaggtactgcttctgcttccgacctgacctttaggtatctgcagccttcaattctttacagtgggagttgctttagcattgatttcttggaaaactaagagctgttttcaaaagccattttcaagacaaataatgaaaattattttcttatgcttatggatgttacaaactgtgtaacaagcttttctctttaactttgctgcaagaaagtttaaaggcaactgtatagcacttcactgaatatagttttatgctgacctcacttctaactccatttttatatcctttcctttattgttttatttttcttacctatttctaattcatgtattttgctgcaatcatgtatttatgtttattttttcattgtcagccattttaattcccttattggtgcaataaatagtaaataagacaaataaacaaaacaaaaacatatgtatgtatgtgtatttggtatttacatcgcatgtactcaaaataaaaaataaaaactaaccacctaaaataattgacatatttcattattctttgggctatagattcacttgactgcagcacttccatttagggagatataaaattaaaataccaccatgaaaaaatccatatgaaatttgacataggtattttcagccccaggtcattaattcagttctgactgacatctttcagttctgttttaaaatttttgtgttcagtctttcgattacacacacaaaaaagttttggcttaatcagcctaataaagtgtatatttctgaaaacatttttatgtaaacaaatatagaagtatacatgatacatacacatacattttttacttagagtcttcaaaccaaatatttcagtcctttgcttccagtattattttcttttaagtaaatacttttcattaagcaacaaagagtgatagtcatctcaacaccaaaaacttgtattcaggctaagtttagtctactttgcatattttcctctgagaatgatccagccagtctcagtctgattctagtaaaactcaggtaatgtggaagaactctaattgagtattagacattttaacaattatattcatattgatatgtccttatacgaccactctaggtgaaatattactatgcttgggacttaaatatgatttttgttcttttattaatttctgaatctcatatccttccagataccaaaggaatacagtaccacctgggaataatgtcaattttcactttaaaaaaatattttgttgcttttcccctcagcatgggcaaccaatagctgattcatactttcattacatcacagttggattacagaagggctctttagtctggcctccgcatgtctcttgcaactcatttgtagacagcccagaaactagcagctggacttcatttttgttccagcagtcaccattttatagtgtttctctaagtcactgtgagtttcactgatgacaagtctaaaactccacaggtattcatatttagtgggttaaatcagagagaaaggattatgcttaactttctataggttcatgtcactcaactatactttgccattcacttaccatacgtcaaaaaggtggaataatactattcttacatagaggactaataagatatacttagcaaaagtaggtggttgcaaaacatttttttaaaaatcagagtgctgtatttttaaaatcttgcatagaactctggttcaatttttgagtccttccaatttctcataactctgtggtattcataataaagcaggcagatggttaagtctctgaacatatgctttaaatgccccctttgctatttctaaataatggaccaaattttgccctcaaatagtcacaggaaactttaaggaggctgcctcttgaaatctgaggacagaatgtgatccagtgggaattaaacctttaaaaaatatattttctaaactttcttatgagctctattccctataccaagacaaattacattttttaataaaataggatatagtaagagaaaaatcctaaccaatacaatattacttggctcaaggaatagattagaaggcaacatatgttttatttatttatattttaaaattctgattttctaaaacatgagagtcatctgattaatttctgtgtgattaccagattttccatttttattattattcctattactagtatcatgtagatgttatattgttaaaacatcttgcaattattaattagttaatttagtttaaattatgattatgcctttgttttaaatcaatgtttttcatagttattaaaagccaaaagcactatttttccagtcacttactttcatttcaaaaacagtttgttgtcgatgaaagcgcattttccaggttatcacagaatatgcaattcatctgcaatggatatatatattctggtaatgttgctcacataacctagctgtacttgtaagagtatctctgtttcttaatgtctatattttatacatggaattaaccttcatttgcacactcatatttctatgtatttaaatttattcctgaaagacctctgaactagtctctcctgtcttacgatgtccacaaaacttagcagtctgattaacattacagataaaaagaccacacaattgacaataaggacactttagttattatagacgtctgaagtttaagtattccaaaactataatgtccctttagaaattctcaataaggattagcttggtcctaatgaaaacagtgtttacttttaaaaataaatgcaatagttgtacccaaatatgttcgaaacactgtatgacgtgtcataatcaacaatgttgaaaataactaaagatctttaaatcaagtgataattttacacatatatccacaaatatctgaacaaaatttataattactattgggacaaaacattaacatattcttctgctaataaagacaaacaactttgagaaaatcctctctcattctcacgtctctaactttcacaataaatgcagcactgaaactaaatttccaactcagaaatacgctgagctccaataaacaagttgattttaaaaactcaccagactaacagttatgctttttcccttatctttcctttgctttcccttgttctttcactttccatgcacacacaatcacacttacctgcacaagtctgaaacatcagtctatgtattttttttgaaatgtactctgtaccgatgcatttttctgtgtttctttctaaccctcgagaatgttaagaatttaggaagagagccacagcttaagagtgcaattatttgccagtaaatactcaatttgcttgtcctgtgatttttcttctaacttgcatattcaataatccgtccctgactgcgtcacgagcacaaaaagtcttttctccaaaggagaagactttcgccaatcaaccttcagccatgccagggcacagcttgtcagggtgatttgttagctttaattaataattcctcacactggccattttcacaaataatgcagtgaggctgggaggctagattgctat

SEQ ID NO: 611 - DNA, 421179 bp, Homo sapiens; identical to SEQ ID NO: 610

SEQ ID NO: 612 - DNA, 809182 bp, Homo sapiens
ttttttttgcaaagattgttggaaataatccttctcttgtacctagaaacataggtgcaaatttctgatatctttgttttatctgcattcctgcctttcatgaaagtccctcttgattgtgctgaggctgtggctcagcgaagacactgaataaatacgatagccactgttgcttgttgcttgtccaagtcttcctggcttctgctgcaagagggggatatggagaaggtgggccagggtgtgtggacccgggcagaatctggggaagaagcctgccattcgtctttctttcccacaccaccgaacccactgcccttcccacccccacagcccttttatgaaatcagacaacgtggtaggtggaaaacagcagggcctttcctctgggttttcaaccagaagtgatattccacagttttaactggttactgtgaagtccaagcggccagaattgtgaaaatgtccactgaaacactgcaagcggtgtacttaaagacagtaggccttttagattttgttatatattttttgtagtgctcttcacaagtggaaattttttttttttttttacttttttttaaaagatttttttgtaaagaagggttgtatttagaggccagtagctagagatccaaccagtggacctcttgaagcactaccaggccttaaggccaccatccgagggagactgggaaaactattattcacccaagcctccggaaatgtaatgtaccagcaggcaaaaaacagttcttcatgtagtacaaaatgaaacgaaacaaaaacaaaaacagaaagtaaaaatgaaaccaaaacatttcttaaattctagtgccatagcttttttgtttgtttgttttttgttgttgttttgttttgttcataagaaagagagaaagatactacttatccgtcagacacatgcatcctcatgtggtcgttgaactgctcgatttggtcaaactttgctgggcagacggagcagacgtaagtggtcccctccgtgcaggccaccacgcctggggggccagcgcgggcacctgggggtgtgcctgcagggggggtcccattgctggcactgtgcagggccacgtgtcgctccaggagggtcttgtgagagaacttctttttgcagatgtagcactcgtaggacttctctccccggtggaggcgcatgtgcacgttgagggagctcttctgggtgaagcgcttgttgcagatactacactggtatgccctcactcctgtgtgtgtcaccatgtgcttgataaggtaatcctttaaggagaaggagcgccaacagatgctgcattggtggggcttctcacctgttgatgtaggaagagacagcaagcaggacagagcgagacatagcaagggatagagaatgaaggacaggaaaaacaagacaacaaaaaagaaaaataaaacaattaaaaaataaaatttgattgcttaatggatcatcctcgtttggaaaaatccaggccctcctagcctctcatgtgcagagaaattttgctttatggtgatgccaggacagttttgttttccatttccctgtgccataaaacggctttcttggaaagctaccagatattccccactaaaagtcttcaaggtcactccgtggaaaagggagggctacttttgaagggggtcactttcagtgtcctgattaggggatttagtgtttcccattaacattatcaaacaaatagaagaaataagagagaagaaagatcgttggagacatggggtgctctagaatccttgagaactaaggatattggtcactatagcttggttccttggggtaagtccccacttctagtagtctaagaaatacacctatgtgttgattgtgagtttggaaaatatttgccaacacaggaatacgttattttgaagagctatactttcaagtttatctattttagacagaaatctttctaaaatataacttaagggttaattgcctgttctctattgactgtagtgagctgcagattggcctcatcgggtgtagaggctgagtaggcggtgggcaacatgatgatatcagactcaaatgatcctattcaaatctgggcaccaacacactacactccactctgacaaatcaccaaatgcctctgaggtatacagtcctacttacctcattgtgctggtgttgacataaaatacatatgaaatcactttgcagaccaccaagagcagtgtgggaatacatgcatggtattcttattacaaggatacctcccacccccattaaatgcttccatatgccttttgaactcttgggtcaatttttaaaatagttttcctgcgtcctcctttgctctcagcctgttggcggaaacccttgtttttcctcagtttactgctttggtttggcttagaaaccaaatgatcaagtttgttacaaacagtaaggtaaataataatactcagtgcatgaggtattcttaaagtccatgggtccgtgacatctctttaagatgattacttaaagacttgttttctttgtgctgtttgttctcagctctgctcctgacaggtgagatgaactgcgtgtttggtccatctctaccacctcattcctgactgcccagtgtaggccctcacctcagagaaaaaagtccttccatgatccaaactaaaactgaaagcctctgaaactccttaggataatatttcaacatttggactatgcatcaaggtaagaagtcttttaaaatttgagctaacttccacttaaaatatatgccttgactgtttttcattttttcccattatgaaataggagagctttgatgtattatggtaatagcagcaatgaaaacaatcaccatgtattgagtgcttactatgaagcaaggttggtattaagtgctgactatgtagcagggttggtattaagtgctgtatgttcatgatccattttattaaactttctctcatcaggaatttgttgttattgtgttttcaaacataaacagatatgttttgaagcacactgaccagacagtatgctgcgtaagatcacatggttagaagataattttacttttagattaaaacaggaaaggttagggaagcctcattgctaataatctcaatttgctgaagacttcagtctatgcatagtgtttacattggtaccttttttttttttgaagtaagagattccctaagagagacagtcatgcatgtttttagctgaaacatttctgtcagctgtaaacatgcctggaagtcagctggtctttgctatcctcatgctttcagacgatttatagaggctatgataggctggccaactatcatttaaaacatgtccacctgtcaccttttatgggaagcgtgccttaaattccagatggtattttggctgctaagaagttgaaacttcacctatgttaaaatgctctgctgtttgaaactttcaccttctgtgtgtttttcctcgaggcaaggtcactgatgaagactttattttcacactcttctaatctgtctataaattgattcctcatagttgtcatgtttctctctatagcatatataggtatgttgtttgtgtgcatgtagtattggttctaccattaattatccatgtgaccctgggctttttaagtgttttcatttctctgggtttatttcattttctgtatgtgaagagttggaccaggcagttgcacatggtcctttgtggatttagtggtcctgagtccgtggtggactgcaacccctgaggactctagtcctggccttgtcagtgaatgacccaagggcaacctacttagtcactgaatgcattaacagtctcacattttaaataagacaaagtatcctgttcccttccctgccacagaacaatggtatgttacttaataaagagaaatgtttgcaaagaacttgggagctccttaaaggaaggtgctctctataattattaaggtgctgtgatggtgaagtgtaggtatttcagaaactgtcttactaaatggggtatattttcagattagtgaggtgctcacaactttcatttctgtatgaatttgaaacgcagtcactcagcaggaatgaatgattgtgttttaagaaaattttttttcccactattttcttgcatattacttacagcaatcccaaaatggttttagacattatgcataaaatggatgaggtctgtcgattgttgctctccaagtaaagaaacaaaaagtgaagataaatggtcagagatggttttccaggtttaagcctatggtcaggaatggcaagtctgatttgtcagaaggggacacaaagtaaaaagtggataattgaattataacatcaaggggaaggtcatataagttccttcactttaaatgatccattttgggcctatacagatgtaggagtcagatatgaattccatttccttggctgagtgacttgggcatgtcatttaacctctataagcctcagtttccttatctataacttgagaataatatagtaagtacctgtctcgtgaaggcgttttgaaaattgaagagataaagcacttagtacagagcatgtggtcattttaagaaaaattaaactgttccattcatcacaaaggaaccaaggataaatgaaaccaactgcaaaatgacttgcatggcatatggaagtcaatcctgaatttttaaaaaattatttcagataatcagtaaaacaagtgattatattgcagctatgtaattcagagttaaaggtatcgtctactctctcaattacatatgcgaatggcaagaagtggtatatggataaaatgtcagcacagagcacagacagaggatttcctaggaaacccgtgactgagcactggaggcacagaaaccaaacagcaagggaagaaactgagggggaggcagtgccctttactgccttgccaagggtgttgggcgtggtaaaagtatacgtttttctcaatttttcaatgcctgctcatcaccttcttctcaaggaccagctctgacacttaactctaccatgactgaaaagtgaaaaaaaaaaaaaaaggaagaaagatcctgcttaggttagaagatgcagagggttctgcctgaagctcacaaagttcaagtaaaagccatcctaatgggtaaagacaccccaattttgaataggaacctcttgcactgggggctcagcaagaacccacttattctactgatttttttcccctcattttaaccaaggcttctcctgagctgtgaaaaagacaatgaatgctgttatcaggagatttttcagaagcactgttcctacctgactctcctgttctctctgcctccccatcatctgccctagtacaatgccctcctctttcgtgagtacagtgatgggtcaaaaaaccaagacagggtgcttgatgagacagcaggcagcaaggaaggaggagaaagaggagaaggtgggtagcagaaggtggccactggtgaggaaagcagaaggaacacttgaaagtccaggtcctctgaatggggaacatcaagacacgaccagaaaatggggaaggttccatattaacaatggaagtacattcagatggaatcatatggagcttttactggctgcagagtctagtctccgtcaagagacgtctgtttaaaagggggcccacacggctgggcaccgtggctcacgcctgtaatccctgtaacttgggaggctgaggcaggtggatcacctgaggtcaggaggccgagaccggcctgaccaacatggtgaaaccacatctctactaaaaatacaaaaaattagctgggcatggtggtgggcgcctgtaatcccagctactcaggaggctgaggcaggagaatcacttgaacccgggaggtggaggttgaagtgagcagagatggcaccactgcactccagcctgggcaacagagtgagactccatctcaaaaaaaaaatggggggcccacacacctgagatatcagcggtgtgattgcctgccagcctttctgttcattccctgggatgtgatcctgttgccagcttggactgtgaggctaagagggactgcctattgggaacatgctgcattcacaaaatatctgtggcttcagtgacaactaagatattttagttttaagcagaactttggagagtttcatccatgctacttgacttttcttaaaattttgtgaatagagtggatattaacatccccagaaaatagcatctccaagtagagagttgtactaacatcttgaaggtcatctaagaagtcagtagcacctgagagtataatactagcccaaccagattatcttcctctcccttgttaacaactccttgttctctggattatgctgcaaaatgtatgatgctactataacacatattaatggctttgatagttttacagcattcataattaagtgttttcacataaattatgttattcaattcaaagagcaatcatgtaaagtaagtactacagatctgaaaaactgaggcttaggtcagttacagaacttagccaaagtgactcagccagaaagtggtaatatcatggccttctcactccaagccttatacttgttactttacacccactggcttgatataattaatagtccaagctccatatgaggattaacacattatcttcatatgactattatggcccaatcaccaacattgttatgctactattgttactatgtctatttacactgaattcatggctgaaatagctgaacttctcaaagtaataagcaaaattaccgtatgtgcagaggataccaatgggctaaaaacagtcaccagtgaacgggctgttgataatatgattcagaaaacgccaaaatatttatctcttgtgggtaaaaaaaaaacacgaaagtgtgaacacagatatgtgtacaatatattctatagcaaataaaaaaagagaaaaaacaaagaaatttaaaactcttgctgtgaaaagaatgtatctgtgtataagtcccttgaattaaattctcctggaaagcgtgttcacattttaaaattttcttttatttattttatttcaatagtttttggagatcaggtggttttcggtgaatgtgcacattgaccaaatgaatgggcatgtgaaagtgtgatatacatgtatatatacgtgtgtgaaatgtatgtctctgtgtgtgtgtgtttccgctctcacagagtttacattctaaagggaaggtgtaaagataatacatgatgatatgaataatacaagtcagtcctgctaaataccagaagggatacatttgccatgtgacctatgtaatttggaagactcaacttacctcatatgtgagtgattagtttctgtgatataatttatccactacaaaatcaagctttgatccataattttgatttactttttctaaacagattcttattagtggaattttaaaaaatgttatgtaacaaaagcaacctgatgccattcttctaattacccaggctcacctctctagggaattgattctcaacttcagcatgaaccagggcttgttacacagatttctaggctccattgcctgagtttctgatttaggatgtctggggtgggggtgaagggtgggggaacataatttgcatgctgctagtgtagggatcacactgctccagggttatctttgaatttgccctattgcttgccttccacatccatgttgacaccaaggcttatccttcttgtattctctgtctttccctttcatttccattcctttatttgacttctgcttttttctcttgatgaagggggtagaggggagcactgctttcttccctgacaggatggtttgtattatctttgtttttttctctctaattctgttgctttcaaacatgcccttaactcttagtttcctttctcacaacttttatgaagctgcagtaagtgaatgaaagaaactcctagagataaggaagtcctccgtggtttgtttagcagtggataaagagtggttaggtgagcaattttcttttactgttataaaaattgttaagaaataaaaaaattcttgttatgaagaatattcaagagcaatctaaggagtataaaggagtttcagagtttaaattccaaagaggaaggacacatgtcaagcatgtattattcagagacaggaaatagagcaaagaaactaagtgtctcctgggtagtaggggcgaaaagtaataatgatgaggatttttaatttttctaattaagtaacactttgcctcttctgaaaagctctcacatgcatcatacgtttacatcaaaaggcagaaaaaatcatttttattttaaactcaaagaaatagacagttgtgaaattaactgatttgttgaaggacacacaggcatttagaggaaacaaaactggatccaaatcatctaattacagtacaatcgtctttcatttatgcctctactttaaatttttgggttataatcactatgaaatatgctttacaactaaagcttccttgattcttaaaggtagagcttagctccaaagccaatatgatggactacttctttgtctcaaacagattttttttttttttttttttgatacagagtcctgctatgttgcccggggtggagtgcagtggtgtgatctccgctcactgtaacctctgccttctgggctcaagtgatcttcccatttcagcgtcccaagtagctggaactataggcatgcagcaccatgcctggttaatttttatagtttttgtagagctggggtcttgccaagttgtccaggctggtctcaaactcctcggctcaagtgatccacccacctttacctcccaaagtcctgggattacaggcgtgagccaccatgcctggccccaaacactttctttcatgaatgtggatcattaacatagagcagtacaagattttaattggaatatgaatcttataatttattctcttcaggtttttttttttttttttttttttttttttttttaagagataggtacccaggttggcctcgaaactcctgggctcaagtgatcttcccgcctcagcctcctgagtatctgggactattggtgtgtaccatcacacacaatttatatctgcagttgttgaaagcaactaccatctatattaaactttggagttactgaattgctaagacagttactctgcaggtctattggtttgcatagcagctgtaatggagagaactcaaatttctttttaactttgtcaagctattctttttttttaggactctttttggttagagtatgggtgggaacacagagtccaactctactcttacaagtatccccgtgctttctagaatctttttatactaacatttggactttttgctttgaatttttatcacttccactgggctcttggaaagttttgaggctccatttttttatgttttccctagaaattgaaaagaactttgtttggaaatgcgagctacaatgaacccaggtcttgaattatttccacatgttccggctgtcttgctttttgaaatctagaccaattgttctaaaactttgttaggttaggggatccttcagttagacaatagtcttgaaagactgataggatttccaaactgccactgccaaataattctggaatgaaagggaagagcattacttcttttaaattaggtgcctgattgatatatgcacattattattttcagatggggctatattatacacaccattacaataacattcataatttactgaggatgttcataatttactagaaaactgaagtccacattttaagcataactcagatttataaaatgactctacctatagcttttgcatctgtgtctgagtgcacaaatcctttgctggttttcttatgtccaaatctagttatctcggttaaccacagaatccttcagtgaatccattggagaaatgtatttatacatcacgaagatactttttggtagtacattgaaaattttatgttgcaaatttaaagacttattttattatgtgatctaacagaatgtgtgaattttacatctgataggtctacttgaagagatgtacagaggggagagcagatatgtttatggatccaagaccagcaaagtcaactttggttaaggagatactttcacagatggtccttcctgcacccctcccccatgttccttaatttaatggcttataaatcagctatccaggggaggaaaggatataaactatgtgacagcactctataaatcataagatgctacaaaataaaaacattactatttgattaattcacctaataatggtgatatccataccatatggaaaatttcttgtgatttacctctggttattagtacattcacatttatcccaagtaaacaaagcaactcaccactacccaagtttcttcataaattcagtagtgagtcactctgtttatttggaagtgtgaatactgtgatctttaaaaactgattctcataaaagtacatacattaatttacataatgtcctgacttacattaccctgcaaagaaggcaaagttcatcttaagcaacgttctgtttcagttgtacaattccatgtttgatgccttgcctctatctctgttgctttccttcccttcagtccccaatctaaacttcactgttttatgtcttctctcttggattcctactagctgatctgagaaacaaggttgttttgagaaactaatttgttttcatgtatcagaattcgagtatgtaacttttccctggtaaattatttgtcatttaataagggtattctgaggccaggcacagtggctcatgcctgtaatctcataactttgggaggctgaggcaggcagatggcttgagctcaggagtttgagaccatcttaggcaacatggtaagaccctgtctctacaaaaaataaaaaagttaaatgagcgtggtggcatgtgcctgtagacccagctacttgggaggctgaagtgggaggattgcttcagtccgggaggttgaggctgcagtgagccgagatcatgctactgcactccagcctgggcgacagagtgagaccctgtctcaaaaaaaaaaaaaaaaaaaagaatttcaaatataatgatcatcactgttataggtattcttaggtccaagagaatctaggtgacatcacaatcgcttatgtgctcacttatatggaggcacatccatggaatgcccaattctatgggaattccatatctctgtaccactatggagctatgaaaaaggattggctgagagatcagaagatcttagctctggaatcatagaatccagggatgaaacatgatcttgcccatcttgatgactgaatcctgtgtacaaaatccctaaaaatgttcatccattctctccttgaatgcgtctaattacagaaactcactccatttaaaggcagtctatctgatattagagcagatctgattgttaacaaaatttttcttttattttgtggaaaggatctcctgatagcatccaatcattggtctagttccaccttttggagccaaactatacaaactgaatgtctcctcctcttaaccatcttaataatagctaccacttatagagcacttattatatgcttggaagtactctaaagacttcacatgtattaatttattctcaaaacagcactataaggaaggcgtatcacgattattctcattttatacacaaggaaactgaagtatagacaagttaagtaatttttccaaggcgacaaggtttagtagtagctaagcctgaatttacacccaggccatctggctgggtgtaagagctcaagctcttcctgactacagtatgctgcctctgaaacacaaatacttgaatatggcttatataatgacctgagtcttctcttctgcagtctggacatccctaggacatcccttctccataaagggttcctgtgacggtgtctcttggtggcagggtgctttgttcttatgatgggaggaacacagttggggtttctagaagaggcttgtggtggggtctgtttaaaatctgaaagatgatcccaaaccttcccttctacctgctctcttaccttgccttcccacagccccctcagcccctgctgccaggcctccaggtggggtgacactcacctgtgtgtacgaacatgtgcttgacgtagttctgtttggcggtgaaagtcttgttgcagagagtgcactcataaggctttttttcgccttgcccactggctgtgctgtggcctgcggatgaggccaggggctgtggcgctggcagctgtgcagtaaaggtcgacagaccgggctgggacactgtcacaaactgggtctgctggcctgccaggggctgtggcaggctgaagaggaaaggcttggggccactgcccgcgggctgggtagtgaagagggctggcaggtaggtgttgccagctgtgccaatgacctgcgtgttgctggtcaaggtcagaggcatcctcaggttgctggtgagggtttctgtctggcgtaagtagagctgggtacttggcaatggctgcccgatggacgtgttgaccgaaggctgttgtaggacgctcttgtcggagctgttgctgacagtgataacagtgctgtccatctccacttcattgcttctctccggagaggaagcacctgtttctagctggtttgtctgcggaccaccctcagcgggggcttctgcagcctgctcgggttgggtgggttcagcctggctgtcccgcgccgccccaggcccaaactgctgctccaccgagtcaggctcggtgcctatggaggagctgacgcccgagtcgaagctttcacctttgggctcactctcggtgccctcggcctggtctgtgtcttccgtgcactcctcggattcgttgcgttccaggatctgcaccctttgctgcccgtagtagtcgtaatcgtcctccatctcctgcttgatgtggatgttgcccactagggtctggatgcgcacaggccggggctgcttgcggcagtgcgtggtctcgggggtggtggacaggtagcgctccatctgctgcgagcgctcatggatgcgtgtgatccagctggggtcttccatgtggtggtcgcggggcaggccgagcgcagtctcgtggtggctgaccactgcgccgctgtaaaaagagcgctcgccgctgccattctgcatggagcacgcgtagagtgccgagtagatcctgtccacgctgtgctgtgggtggctctgcaggtagcccgactccgtgtcgctgctctggcctgacgtgcctgactcgggagtgccccgcggcgtgtcctggcccgagtcctggatccccgggaacacatcgcccacgttctgtgacacgatgcgcgtgcactcgtcgatgactgttttgatctgcaggatgctggcggccgtgaggatctgcagagcttccgactgcgagacccgtagcacgccgctgtacatgaagtcaatgagcttttgcactgactgcactgacaccaccgacgggatctcgatgtcgctgtagccaagcagcagtttgtcctggaagaaggggctgccggctgccagcacgcagcggtgtgcgcgcagcatgctcccgtggatgcgcaccgttacgtcacagaagtggccacggttgcgctgctcgttgagggtctcgagcacggaattgctgaagttgtgaaggttgatgctgtgaatgcgctcggtcatccccttgcaactgatgtcacctgcagcatgtcaacgcagacacaaaacagggcatgggtcagatctagctggttgcattcctaacacctaggtttcaggtgagtaatgctcatggctcctagaagcactgcccttacatacgcaagtggggagatggacaggctgcggcatacaagctgtaggtacgatgacctgagggaaaaggaccttgaattttgctccaattccggcctttagtgccgcagccattttgggtatccatattaactccccagagcttcggctgaggtagagtggcctaataaccagatgatttgtttgcctgctattcctacagcttcagcaaagaactgaaaggcaaatggaagacttgttcttatggaacactaaacctccactttatttttatttatgtatttatttactttgccttcactttagacaggcctaagcccagattctttgggaaagtttacatttcccccaacttatcaaagtcccttattttattcatacacagtgaccatattcatagttaacaaataaacccccttcctattaagtcatatggcatattatcaaaacccacaccatgtatgcaaaaattattggaaaattcaacccagactaagatatctaccaaacagtcatgatcatgctttccggatgatggatgggctacagaaagcaatctgctagctaaaggggcactccatggctgctttctgtatctactcattcttcttgtcatctctgacaacctgtttgagcactttctagggtggttgcatgtgatatggaaggttttctgaattttctgaggcttaatgaaggaggaatgttaaaaaggtcagagatggcagttctgacccaggagactacagtacattggtgatcatatttattatgcaaacagggcactttcaagagtgaaagagagcattgttaataattaggccaggatagcaggagtaagccagaagtgggatatatgatctccttgggtaatagggtgctttatgtacttgccacagggaagtattaaacagctcccaggaggaaggcaacagctatgtggaggctgcggatagcctgacccagcgccaccctataacgtaggctgttatggcaagggatactattgataagatttggattcagaatgagaaagaaaacaggtggctacagcagtagatcttagggcttttctatttttctagctcatctctcagatggctctagagaatccccctccaaataattcttcaatcagattccccattcttgcctttacaactgaacaatcagcttgggaaagtgaaataagtgggctttcaaaaccaaatggcccaagcactgattgttggcctggacccaaatctctctgtcttgtgagaagccacctgagaggtaacagcctgcagataggaagaaggcctacctcctcaaactctttccgctctaccttgcgatagaagacttgttcaggaaactctgagttcaatgagcgtttctaccttgcttcactcaatcaccctcacatggtatgagcttaacttaataaatgttcaataatacaatttgcactaatttgtataagagcattctttctcgttctgactctatcaggtctgttatgtgcctaaaatattgtattaggctacagattccatcgtttttacttatataagacaagttctctttgccagattaaagaattaaggtaaatcccctgtaaccatgtgaacacaaaatatggccccaaaagaaggcacaaataacccaggaagggctgttcaggagctcaatcagcagcagaccaaatttcaagttcttgctgagttcgccatacatacataccatgatagtaatcacaagataacattttttaggggttacagttctaactgctttctgtatatgatttcatttaatcttacagcaaccatgggaagtagatgatattattcccattttacagatgaggaaactgaggccagagaaactaagaaacttgctcaagtacacacaggcaattgctggtagactggcatttaaacccaggcagtctggctctagagttcaccctcttaactgcttcattatattgcatagtttgccctttactgaggtctggcccttagggatccacggctctgttgtaaagctgtgtgaaaggctttgtccactactacctccagctacttctatacctatccgtgatttagtgtggcttttatgtttttaggctgtgatgctttgacatagcctcagttgtgtaacttaaaggacttatttttttagatgtcacagtgcaagaagtaagacaactaactggcactatggtttaggattttctatatacaattttactataaccaaggtctctttcatttaagtaaaacaataagcagtaaaactggttgtgtctgtgatcatctctgtgtaggatggatttattacaacatttttttctacacaagtgaaaacactctttaaacatacatttgctcataacattagttacaacaataacactagagatgtcatatatgacagttttctttcagataattctgggaagtagccctatcacaattatcacaataattagtatccatgtagtgtttgactgtgtatacaacttttttacatgtaacatctcatttattccttacaacaatcctatgtgtgttctgaacaggtttttttttgttttgttttgtttgttttttttttttttgacagagtcttgctctgttgcccaggctggagtgcagtggcacaatctcagctcactgcaaccttcaactcctgggtttaagcgattcttgtgcctcagcctctcgagtagctgggattacaggcatgcaccaccacacctggctaatttttgtatttttagtagatgagttttcaccatgttggccaggctggtctcaaactcctgacctcaggtgatctgcccgcctcggcctcccaaagtgctgggattacaggcatgagccactgtgcccagcccttcaggacaagtcttattattgctatttcatataagagaaagtcgaggctctcaaaatgtctaaatgacttgcccaaagttttgcacagtagcacatggcagtgttgggattagaaactatgcctcttaaagctttttccactgcataacagtggatcactgaggaatggaacttgaagtgcccaaagatcgagagttatcttaattctcagcagagaaaaaagaaagacactgaaagtaatgatgaaggttgctttagagataagaaatgaacacagataatcacacacacacacacaattccatgagaaaaatccaaactgtttgaccagattggattgcaaattttgttcatctaaacaatcaagttatctactgaatagtctgagttaagactcttgcgataatattgccaccaacttcattaaaaaccacagagacaaacctaaacctgcacacgtacacaacctgatctgacatgcctggttgaattttatacacacaattcttaaatatctccctgagtacactggccccacactgcagtgaacagccatgaaaagctgaatcgtttttgctgatatgagtacagatgcgaagggggaccctgcctccccattcaagcatgcctcattcctccagcacacaatgctgaggcaattcctttcccaggctttcttttatttttaacactaatacagtgggaaaaagtttctgccacagcaaggcaaagtccaggcttttgtgagcatgtccttttcatccaatgggcattaatgtatagattccaatggaataaatctgaaatactctactgtagaagatttgtcccccattgaaaacaaatcttgattagatggttattcagggagtgtataggaaggaatggtgtgaaaatgctaactctattctttcttagattggcactgaataggcatttgggctattcaagaaaaaaaaaacacacacacacacacccaaaccccaaccctatcaactgtacaaaaccacaaaactttacatagattatgtgatcatgtgtatttggggattcttccccacccaaaataaaaaatgcacagtgttatgaacacaaaactgatggcaaaatgaaatagtgataaaaatagttctctgtgttttaaaataataacttacctcctttttactagagtaaaaatacagagtcagcttgtgatggcattccctcaaaacatggaaggaattgcagtaatgaaagtcatcatgtattctaagagactgttctgcgagagcacaacacagacggggctaaagcaggggtgagtaccgaagggaaaatctgcctgtggggaattggggatagagggcctgactctctgttttgcaggaacgttgctcctgcctgtcccttaagctgcaggggtccagggataggacttagcatgagaataaaaagctgcctgctcacaagagaaaatgagcaagaaaggaaacagcaggcaatacaatctcttttaattaggtgtgaaatccagttctttctcaatcaggagagcaaaaggatatataaaatgagactagtgcaagggtaagatgctacagagggggatggggatttgaagtctctggacttggaaggaaacatcagctctcaaatgaaaaccaatataaatttcggtccagttaataagcctaagtcaagtggcagggccagaaagcccttgagctttcaatttggggcaccagatgaggttagtgggtcttgcacatgaaacagggtgcagcttgccaagttagtcacactaggaaagagccagtcatctctggagaaaggggggatgtattttggtgactgagcccccttattctccaaaccccctgcctggggtaagacttcagttacatgtactttacctcctcatatatgccaagggagtcctgctgaatccctgcactataggaggtatagtagtttcttgctaacaggttccatccacagcaaatgactctgcaccaccccactctctctttctatctcattagtatcatcacagtcttgggaggtggctgggagcactggagaaatcacacatgcaagtggaaggcagcaagcagacaagatctctttctcctatcttggctctatatacctagcatatcccagctgctattacctctgtagtgagactagggagggtcatcagcctatgggagggcgagctgtacagttttacttacccattcttgggtgaaaaggggggtgttttgggccatctcccaataaaggttctcctctatcttccagattgtctaagcccagtgtggaggaaccatcaaggatttcagcacgtttttttagccattggtaacagaattcttcacataaaacatatatcaattgttgaaatttgcagaaatttgacttcgaacttgcagaaatttgactttcaaacatgtttgcaggaatggctacctatgaaagttggggactagctggatgtgcttttttagtcactacttattattttatctagacaaagattaaaaattactaacttgtttacagtatttacaacaccattctatttatgatcccaatactgtaattgggtatgcctttaatattacctgaatttttattcattcatagaacatttctagagaatacttaaaagtatttaaaggtccttggttttatgtttgggttttggggggtatgtatagtttttataaatggacatgtttatacttttataggaataaggtcagtggctttcatcaaaatctcaaaggggtctgtgttttccccaaattaagagctgtggattgagattcaggcatccctctttaaaatacttgtaactactttccataatcaaagcttctaaaactgatgcaaactttgtgattgcattactctgatgcataaggtctgttgaactgatattttccatttacttaagttgagctgatactattttgtatgagaaagcaaacaatcttggccaaaatgagaaaagttacttttcagaagagaaatattttttaaaaagattgaaagggaagagagaaatgtaggtaactactaatattagcagaaatctggattatgacagacatatagtttacaactgttgaagctaactattatttagcaaactttgttttactcagagtaagtcccttttgacagttaagacaaatccacagaagaattagaaaacaccctttaacatcttttgactgttaaaaattagatattgtggtataatttgaataaaaaataaatataaactcaatatacacatctaatcagccaaaaaaatagtttacttgcaagatctatagcacttgtaatggggagactgcctttctttctattttcctccttccctttcttcctttttgctgtcataccacgaagttttactaagtttgaagtatggggaacaaagaggcaaaattgagaactagaaaaacatttgctctgtgattttcaggcccatccccaaatcttgacttatcttccattcctgacttctttttcctctcttcactccaccaaaaaataagagctttatactttatctaaggctgagaatagatttacagtactagtgggattttacaggtccaaaggagaaagtaattccagaaaagtctttttacttggccttagaggtctcacagtctcccttggttagcccaggcctttggcttgcctgattttatgttaagtctgctgttctctctaagaaaggatgagggcatgcctatccatattgtaaaactgtaaatacaactgacttatgaatgaagctgctttgggggtcacttgaattttcaccaattcattagtgaaacatttactgagaataccccagtataaatggaaccataaggatacaaaggatcttaaatctaaatcaatagaagaaatttatccataaggatctttgatattggaaacatatattaatcaatcaacttctcccagacctcagtgctcaggaaaagctgtgttttgcttttctttgtggagcctgtgaatatcataactgatcatgtttccctcttggctctgttcactagggagctcagaataaaaatttaggcccccttttagcaactatgtaggacctcatggtatgcttttctatgtaaaattttcaccagcctcattatattatccattctttattttacctctactctgatttctttttttttgtagttatatagaaatacatttcctacatatttattaacaattgaatattaatttaagctacctcaaatcccttacttatgaggtgagggcataatcaatcaatcaacaagtaattgagcatccactttatgaaaccaattccaaccataagttaaaacttcagtcttgagtattatcacactatatgctttatgaattttttatactttgagcatctgattccaatgaggtaaactgttgaaatttactttacagtacagtttgtgaaaattaagttttactctgtgaataaagaattggatagataattccagacaacattctgaaagacacttacgccgtcattccaaagttgaaatgaaatgagggggagaagacttgctgggactaaggaaaaaagtcaatgaaatctgaggttgatgcctttaaatcctcttatattgtaaaccttttgagacaccttttaggagtttcattttttctctctctaaagcgctttccttacaaatttagctactgccctattgtaaccttttcctttgttcactaaatctggggaacaaaaatacagagatgctacatccgtgggtggtatacaaaaatgaaccaaaggatctacttaaattcacaaatttgtgctgtttgaacttggctttgaatagaccttaaagaaggatctgtatattcaattgtacagttaataagttaggtcttttgttttgcttaagaagcaatcacaaatttaaaaattgagtatatgaaaaccagcatcttcttacttgataatctgttcttgtggtctctacataatcatatacttattttatagaaaaaacagatttataaattcagtgagttcaaagattcagtataactctcaggtatggcatttctttaaagaatatcatcacacactgatgaattatagttaggtaagaaactgattttttgactttgggaaaacttttctctggacttaaacgagtgagaaaacagaactcaatagtgtcattaaaaaaaaaaaaagctttctggcaaaaaatatcattgagttcccaattcatagaacttcctttagtcctctgttgctgtgctgttctgaaactgcttttgaagcaggtcttcaaattcatgctcaaatgttctcttcccttgggtctttctaacaaataaaaaaaagttgcttccaatgagaccgctgtttttcaagagtatctctgtttgttggtaggaggggaatgcaagattttctttttttttttttttttgagacggagtcttgttctgtcccctaggctggagtgcagtggcgcgatctccagctcactgcaacctctgcctcctgggttcaagtgattctcctgcctcagcctcctgagtagctgggattacaagcgtgctaccaaactcggctaatttttttttttttttggtatttttagtagagacggttttcactaagttggtcaggctggtctcgaactccttaccttgtgatctgcccaccttggcctcccaaagtgctgggattacaggcgtgagccactgtgcccggccaatttctctatggacttgagccatgatagataagttcactgaggagtaaagaccttctatcccaaagcaacagggaaaagccaaggaaaaaagtaaatctgttttgttggatgactggttaaaatggaagcactgagatgatttgtgtgggctaggttaagagagtagctgaaattcatctgcgcacctagggtatagaaccaggcacgggaaatcattaaaaaaaagaataggacctaagttcctttttggctcatactgagatgaagaataagtgctgtcagatagaactcaaaaccttgggaggttctggtaaataagtaaagtagaaggcatactttataattattttaatcacaagtaggcattttatctttatgatattctttatatagtcttttgtataatatttattatattatttacatattgtcaaaaaagacattgagctatagaagtctcctatagctatagctaacattcaaattatctgatttcacttcactgatttggttggatttgattttctctaaaataaaatctctgtgctaatccaaaaggttggccattttgctttcctgtgtgtggattacattcatttttacttctcttctgctgaattttccgcagttctgaagttattgtggtttctctcctcaccaattcttatcatccccatgaaccttattcaaactttttccttttctgtgaagccttctgtgattactagagttcacttttcttggtttccactggttggtgaggtaataaactaagacattcatttttggcttgttctcactgaattagaaaactttcttaatgagaaggtatctcccctttcctccacctgtaggaatgaatggccaggtttttgtatactttataggctcctttgcctcagggagttgtggtttcagagcccattaagccctaaagaataaaccataaaacaaagagttttctttcctaatgtctgttctctaaaatgaattattaacccagaatgggtaaggagagtgaggctgattgatgctttggagttagagaattggatagcattactggagagaaaaacaatccactttccctcaaatgcagaaggtagcaaggtctctacttgcatacagctccagttggggtaattgcttggcacacttctggaggctggacataaaaaggcaccactttgagaggaacagtgatcatctgggggctgggccaatggtcaacagcaaggaccactgtggagggcatctgtaaacccagctagtgcagtagtgctggcagtcagaaggacgaggctcaatggcatctttgtggggtggtcaagcaatgtcaatgttggagaccatcatggactaaggacttagatttaatgagtcttgtaccaatctagggatgagaagggagccccaaaacttgtctgtatttcttgcgaatttggtgacaggggcctcaggtttaattttctttagaaaaatacgggaatttttttgtacctgaatgttgaggagtgttggggaagttcacctgaacttcctatacatgtagcacctaagttagttcttaccaatatattattgtttcttttttcatttgtgtctgtcttatctctctaagactcaaagcctcccaaaggctagtatcttgtcttgttataaccacaactacaatgacaactacaaatatgtaactggatccctcattgtgcccagcatgtttctttataatgtgtgggttctatgtgagtgcttgtttggtcagctcttcgctacacttcacaaacaagtgggaacctcagggcgcacatttactctgagatatgtctatgtgatatggtcctgacagggcttttttgcccctgaagttctgtgtaatgctcttcttcttgtcctttatttccctacctacccacagttctattttcaatagaatttaaagtccaagcaattgttttatgtgttcactgagttgcccacaaactctgctcattcatttatgatttctgatacatgccatgctgtctctgtctccctgattccatttccccagagagacagctcactgggtccccctgtcaacagaggattcagtggaacccaaagctaagccatactttgtaataaaaaataagaagagatgaccaatctatgatgtgatagaaaaatgatcaggccaaactccgatcacttttgcctatgttagggaagctaacctgcttggtaacagatgttacagaaatatctatcaatcagcattgataacagggtatttatatgtacattaacagtagtgtcaaggattgtttagaatattttctcttggtggccactgggtgtcctcatttacaaagtaaatatgcaatatttagtgaaggtcactggagagaataaaagacactagttttctctttggcccttcacatactggggataaatttattgctgaactcacaagcaggttatatattagtacagtttaaaaaccttcaggtcaaactgttaaaagtttataaccaagagtaacttattcagggtccagacatgaattttaaaggctgtttcctcaacagaggggactgtgatcagctattagaatgatcccttattcatttgaaaattggcatgggattttgactatctgccgagagagccagcagagaggagcagagaaggtcttaatttattcttgaaagaaaagagaacaccaaatatctctatgggatatttgttagattctgtttttatctcaccttttctgaaaactaattaaaaataataatgagaagataaaatatgtcctttgcctaggaaacctgaaataatgtgaaaaacattacaatgagctgggtcagtatactgattatcaatcatttcacatttgaagacaaagaattaaactattcctttatggacctgttatcccacctgtaaaacaaaggtgtgtatgcttcacagggatgttgtagggacaaatagaatatgaggcacacaaggttcctaggaagagaaactgtacatgagatagatttagggcattactagtattctaattgaggctgagtcacagttgtatatgacttgttcctgctggaagacagtagtcaaggccagagctcacacagccaacaaatatgttctgatttgctgctctcagacactgagtctgacacactgctcagcaatcacttactgctccctaaagtggtattttgcatttctaggattgtcattgtctctaaatttatacttatatacatcgctgatgaggttcttcccttgcaaaaagaaatttcagccttcctccaattcaagatacaggcctactattgaatacataacagtacatggccttcaaatgtcatgcctagccaattagctaatcctttcccaaaataaacttcactgtaatattttttttttcactagcatacatccccagcttaattactattctctggcatgttatttcagtacataaattatcaatatgattttgtgtcaaaaccaacaatttgaccaggcatgttggctcacacctgcaatcccagcactttgggaggctgaggtaggtggatcacttgagtttaggagtttgagaccagcctagccaacatggtgaaacctcgtctcttctaaaaatacaaaattagctgggcatggtggcgcatgcctataattcgagctactcaggaggctaaggcaggagaataatttgaaccctggaggcggaggttgcagtgagctgagatcatgccactgcactccagcctaggcaacagagtgagactctgtctcaaacaaacaaacaaacatcccccaacaatttatgcaaacaacatcagggaagctaggaagctctatgagctattctctgccgttcagatatgttcgattgtcttactagctgagcttaacagccttttctgtttttaaaggaccaccatgcatgcctctagtacagcaatctctaacacttaatcaacagttacgtctacagcaatacacaatagccaggtcactttcaccctgagattatactaaaggctcacaatatgctcagagtgtatggaaaagtgtctcatttcttctaaagatccttaaattccttgcttttatagtattatccaactgattaattagtagattcatttttcaactactgtagccccaaagatacatatcggcagagccctcctgattgtattttacccttggccttttctccttttagtttcctcagtttgcacctgtaatttcacttttagaacttctctaggctcggtggctaaacaccacacagcacaggctttatctgatgtgccggcgcctggtgtggtctaagacacactggtgttttgttcttgaagtacaggattgatgttctgaaacctaggctctaacacaaaggagatcattagctcattttaagtgtctcttttcttccctcccagcctcctcctacccaccccaatacttccttagtcctaagcactggcagcagatggcaaccatattccaaagctgagtatacataaaatagtgccatggagaacagagtggcttcaaagttagcctttctattcaagtgggatggcggggacttctggaggagtgaactcatctctcattcatttaatcctctattcattcagccaggaatttgttttcctacacatccatctactgtccagccagttgagggagggtgggcatgaagcatctctcttgagggcccttccagcaggagggcactaagatttctatgccaagctcttgtttccctgggccagctctgcctgctgctgatcaaatcatgccattcctgtaagaggagcttgggaacacagtgtgtagggggtggatttctcaagaactatctccttgctagactgacagtcacatgctgtattccctagacaaagattagacccaggaaaaagatgaaacaaggaggaggatgtggggttgcagaaaactgtgcaggatgttacagtaacgggaggtgggagtgggaaaacctttcctttttgttgtttcaaggtttgctagagcttttgcctaatcatctgtttgagcatcttgaaaataagtatctatttccatggtatctatcaaaaacaggcaccagattatactacaaagttgacctgccatattgctattagaattaaaacatgtagcagcttacattcaaaagaaagcttttctgtttccccagcatgaaaagcagagggtatttgtgatacactttgttttgtaggtctgctgaatgaaaaaaataatcgggtaaaaaattagtacctatattttcacaaatgggcataatgcttacaaatgcactacatcattattttagcttcattctccccacaacattcatttattcattcaacaaacatttgctgagcacctactcctaatttgtgtaagcactttgctgggtgctagggattcagcagtggacaaggtaaacaagattccgccctcctgaattctgtcacctggccaaaataaacatttaacaagtacgctgctagaattttacttgagaaaaaggaataattcatcttacctagtatttcttctgaatctttcttaaacatatttcttgaaggtccagactcctttaactaagaagttctatcttaaatctctctctttccattgttatattcattcctttcttggttacaatgtggagagttcagattgcaactgctatcatttctggggggaatgggggtgggactgtaaccctgagaatccttgcttttcaaactacacatatattttctctgtaaatattgtaccatctaatttgcgtctttggattttgttgattagccatcaacatgtgatttaaggaatactgcatatgagatgcagaaatcatgactcagtaagttattattttaaagctctattttgggatttatacagacttgtgtacagtctagtttggctttcaatctaatctgcaactattactaggaggcttttagatcaagttccatacccatgtgtctctggaattctacagtgagaagcaaaagtgctcaggagttaagagaagcagacgtccgaaattatctccatgcattaccaaaaaccgtgggcaccacggcacggggaaaacttaccaggtacaatgagccagtgactgttactgaatttcttaagattacacttttcccaactactgcagactgcttcagaatagaagaaggtaagtaagcagggtgattacaagcaatcctcctcggaagtgaaactcactcttctaagtttacctctgttttgaattatttcagacaactctcatgccatcaagccgacggactttcaaaaaaataaaagatgcatttctttacttgtaagtatttgtctttgcaaagggctctctgatatggtagcacagaagtttgcacattctaaggatctgatgttttgccctcttcgggtatcccggctggaaggagctacggtgaaagggcacctaaggtgaatggacagattgtagatgggtgcacacaggaaaatgtacagctcctacaatgtattctgaggtaagagagcacacaagtccattccctataatttgaaaatctctcttctttttttattttttagagacaggatctcactctgtcacccagggtggaatgcagtgggatgatcatggctcactgaagccttaacttcctgggctcaggtgatcctcccacctcaaattcccaagtagctggactacaagtgcacaccactatgccccgctaactgttttgtagagatggggtttcactatgttgctgaggctggtctcaaactcctgggctcaagtgataaatccacactggcctcccaaagtgttgggattacaggcgtgagccaccatgcccagcgtgaaaatctcttattgactagaatgcacttgaagacaaaaaggaacttaacaggttaacactagaatgtaatgctataatattaataacactctaacccttccctataccaagaagacaacattcagagagatttgaaacttctttcagccccagtttccttatctgtaaatggggtgttttgtaataagattatgcatattagtcctctttcatttttaggaaaaaaaaacatacaaatgggggaataaaagaaggcaaagagataatggagaaacttcccagtctattcaggcctgaatccaagaagggacaagaagaagggcactggcttttcctcgaagtgaaggatgtaactgtcttacacacaatctcctcccatagatctagggcttttcagcctcagtcgttctcagggggaaaggatggggacctgcaacaactttcacttaggctgcatcaattttagttcatattaataattttcaagcacttaaaactgtagccgacactcaaattcacggagcgctggctgtttttctggtgctgctttaagggctttacatgtagtgttccatcgaatccttctaataaccctatgagatgcatactatttttattctcattatgcaattatgcacatgaggaaatggaaacatagggaggttaattaaaggcacataaaatgcattcataggctgaagttcatgttaaaaagagcaaataagtagaccatgggggtgagaaaatattttctgaatattggaaaacaacacatagccccagtcttagtccattagcaacatgttcaagaaatagctttagcagtctgttatcatacctgcccccaccctgaaggcatatcggagggacccgagaggacatcaggagccattctgcattgggatgttcacagggacctctcctcattgcttctaagttcactcttgggtgccaggtttgagggtgcagattctgattaggatatgtcctggggaagtggctttttccttctgttagttctctgaccctaatgtaacaaaatctttaaacctgtgtcccagaacaacacgcaggaaagaatatgaacctctaaaagaaaggcccagtaatggtaccagtagagtccaaggcctccaggtcaagaactcctgctctggagcagggctggaagtgggggcacgctttgcctgtatcactgcccagtgaaaccaggcctgctttgcagtgcctgttagcatgtcaacccaggattacttaggccacttcaggaatcccaggatctagtcacccatctgggacctttaggtcaggaagaaaatggaatgggctagatttatgaaaattggaaaaaatccagtcaggtgtacctataaagacctacagtatttccctgagaaaatgacatgtatcctttaccctggggttaacttctaaaagttttagtttagaatttgcatgtgtcttttccattagacacagagttatcttttgtagttcaaacttatatgcacctttctttcattgtctcctttacatctaaatacctggttaagatatgaggcaaagagataatcagtgattatatagggaagaacgtgattacagtaaaaaattgaaggacaaagttaattcagttactgctttttgaaattctttgtagtattctacatgccacaccaagcttttttaaaaattctgtactctttggtctaatatcttggtataaaactgataacataaccaagctaaaactagtgaggataaataagtaggaggaaactcatttttagaattggagaggaaaggaaaaaactcctcaaggtcaattttgacatcaactataaattcatttggccttgtgaaattataaagactcatgttcaacattgttccatgtggttgtttatataattttcagtagtgacaaaataatctccttatttagttttacaggtaatttaatagtagaacaaagtatcgtttgattcagttggttccagatcaccatcctacagtagaagtatatcagatacttttgtgtacaggtgggattggcctttggaatgtcttggaccatcacagaaagcagcatactttaagtaaacaaattgaaaccctccctacaaataatgaatttgaggatgtcccatgacaatgaaggtggccttgagaacaacacataggtttgttattagtaattacagagctacctgaattgggcatatcatgaaagaagtacacagaacatggcttttaaagaattatgctttgtcatttcaaaaacaattgtttttaaaaattgttttaaaaattgttaagatgatttaaatgttcaaagtgtatgacacctatcctctgcttagtgttcagaggttactgagggtaaggaactgagttaatatttgtgaagtaataatacttgtaaaacattatttctcataaaaaataatagaaagcaatgttgagaagaagtagagaaagaaccagtataatataattactgcctcactgggcttgggtagtgccttcaaattcctttcacatatatttaccattccaattgccctgtgaaatggaagatctaattccttctcactttgcctatttaattgcagagtctcccttaacactggtttttctcagtctataatgggctaggaactcttgtatcataaaaatattcattactccacttttgagttacccattcattatttctttttaaaacattaaacttgtactttgtaatagttgctttcccatttatcctatgtttgctcctgaacccctctttatggtcttttttgtgacacatctgattctgttttcttgacaacaatcaggaggctagtaatcccaaaacctaaggtaatcttttcctaggtctctccctcgttggtgtctgtggcacctgatactgactgctgatccttcctctccctgatggtctctctgcactatcctggtttttctcctatcccttagaactctcttttcttttcctctatttattcattcttcattctctttcttatcactcatgtaaatatttcccaaggttttgctttccttttttctctcaacaaagacttctttgaagtttactcccatatttatggcttatagtgctcttggccaaagtgtttgctagtcctaatctcacgcattcctgctgtgccccaggaccctgtttgtaactcagtgttagttgtctccactgggaacacctgtggtagctcatactcggcactatataaaatggaattcaatttgattcctttaaatgcttttcatctttacttgataccttggagttatctttgataactgcctttgttgtaactaacactcagctcccagagctgtctaccctcatccacaaaatctgttgcacctggatcctccccattcctcctattaccgcccccttcaggtcaccaatagtgtgaaatactgacagtgctgtctggaccctctccttcctccagttgctccttctcacatccaggctgccaaattagatcttctcaaaatcttgctcatggtaggccctacttaacacccttccacagctctgcaacagaggtgcaaacccctcatacctagtcctgatgcctcatttccagtctttcaaaagagctcaaatggagccatgtctaataaacctacctagatattactgttaactggattaaaatatactttacaaactttctaaattctcagatactggtgatgtgaggatacatattgttttaagattcttggtggtggggtctgtttttctccacctttgtgtcctcatggaactcactgtagtgacaggcacaaaagatatattctatacatacttgctgagtgagtgaatcaatgctccggtgggtctctgtgtatggggacatatctttaaccacgctgcatggaagttgtttgtgaatgttatttgatcttctctacaagactctaagtctctgagcctagggctccagtttataaaactgcgtcctgcacaatacttagcctgtggtcctccacattgaaagcatccactatattgatggatgaatagtcctgactcctttctgttcagagaacattaagtttgtccagaagcagacttagtaacaagcagcataaatggtgggagaaagggcagggttctgtttctgactctgtcattcattatgctgggaaactttcgttataacacttgtgttatttgggcctcagttttctcatgtgtacaataatgggtatagaccaggtaacctttaatcttgcactgctgataaaaagttagaactggcacacattcctcagagagaacaaatgattcagaggcagaagaaaagcaaaaaagaaagcaaaaaaaaaaaaagggattctgctgatgaagtaataaggtatgtgattatggtacctagtgtgaggtgactggtggaaagatccgacttgaaatttccttaaagcaagaagtccttaaagaatcctcatgcttgctctcaatcaatcctaaatgatccaactctaagggcagtagtgcatgtggcctcttttattttaagtaaggatgtgagaagtcttgacagatatggagaagcactaattttatataatgaaatctgccatgaacagaggaagcacacatgaaactgtcactagcagctgtagataagaattaaagatgtattcctgcatgggatgagatggcaagatgaagaacagaaccgtgaaaatcagcattgggccctaacaattacatgtggataatcatatctatgcactgtttgggagagcaatatgacacagtgtaacttgagccaatgggcattgagaccagacttgccaagggacctgggaggattttataagaggacagactgttagagtcgggaagggccacaaatccatgacaaagttccagcatgacacctgtaggtgactctggctccatgaatgaacttttctcaacaattagttattctgagccaggtgtggtggctcatgcctgtaatcccagcactttgggaggccgaggcagacggattgcttgagctcaggattcgagaccagcctgggcaacatgatcaaatctcacctctaaaatacaaacaaacaaaaaaccccccaaaaaactagctggctgtggtggcacaagtctatgttcccagctactcaggaggctgggtgggaggattgcttgagcccaggaggcagaggtggcagtgagctgagattgcactgctgtactccagcctgggcaacagagccagaccctgtttaaacaaaaaagaaaaataaaaagaaaatttattttgtgatttactgatcaaaatcatcactaggtccttcagaatactttctttttttttcctgagatgcagtcttgctctgtcactaggctagagtgcagtggtgcaatctcggctcactgcaacctccgcctcctgggttcaagcgattctcctacctcagcctcccaagtagctgggactagaggcacgtgccaccatgcccagctaatttttctatttttagtagagacagggtttcaccatttggccaggatggtctcgatctcttgacctcatgatctggccgccttggtctcccaaagtgcggggattacaggcgtgagccactgcgccttgccccctcagaatactttcttactttgactggctgtgtggaaggaagggttcttttgcctattagaaaataagtagatgtcttgctttattatatatttggaaagcaaatgtctctgaaatggatataggattcagctcagctgaattataacaatagacaatgttacccaaatacaaatcttcccatgattaaaatgaggcaaagtataagaaggcctcagtgtcataactgaactgttctgttttctgaaaactctgcgctctgtttgtgcctctatggttttgcttctttctattccttctgcctggaatgccattacttctgccttctactttacaaatgcccactcctttatgatccagtttaatttcatttttggtgtggagctctttccacttcaagaggctctttcctcgggggctctgtagcattttgtgcatactggaacactttaattctgcatttatatttaccccgttatgttccaaagtgtggggatggggtcttattcctatcttcgtccctaatcttagctgaggacttggtgcagaatgagggatctgataacatttgatcaatgactgaattaatgactaaatgaatgaatgaataagaacgactaccagaaattactgcattaagtgactatggaagaaacccagttaaattggtgttgtagggaaataataagttttataaaaagagggccaatttaaaaaatagaggtagattaagatacaaagtttcaagacctgtgcttttttaaaataagtgtgtccccaaatgcacaaagtggaaactctaggaaattagagcaaataaaaaaaacgaactggccttccaatgtataagtgctggactaagcactaaaatctctaaataaagggtataaaaggtaacgaaaaaattccaaagagattatatatcaattaactaagaggcagaaaggtgactttttaaaacgggaaagactatctttaatgacaggaaatccacatttaacagatgaggggcttacttggcaatgaaatgacagaaaaacagtttaaatgaaaagataaatatataattccttacagaacatagaataaagcagaatgcagaacactgggggcaacgagagcacttagttgtaccaaagacactctattactgcttaactgatacggaatttattagaaaattaataacaagccattggatagtaactgtctgtggttgttattccattccattttggctatattttctctgcaaattagtgtgaccctaaaatgttttcaggattgtccaacttgtcctaaattccataaataaactctttcagaggatgctgttttttgccatgtctctattacggttcttcacagatggaccatttttgtccttccaaagtctaagaataactctttcagttatcaagacataccaaaatccagttcagctgctcctgtgggattccagttagtttagacacatctgctgagatacatgcatttgaatccaaatgaagcttttgtttgattatacattttgaacatttatggaggttttctggggccaaaatgtttttcattttttggcacaccaaacagagatcttcagttataaacactgccttctgagcacctccaacagaaatccaatcttttcatgtgaacaggtgcctcaggaagtttttggaaggttttacactgaatcagctttccgattggaaactttctgaacatgcagtcaaatttgccaaagagaccttcaaacttgcttgagcagttttcactcatacagacatacattcacacatacagacagcccaagtaaaagcaaatcagagccctgtaaaactgaagtatttttcttaaaggttaaatatcatatgcaaccaaactgaacaaaaagaaatacacaacaggagacagaatgaacggatagcacgaggttcttcattgagcgtgtctgccttaaagccttacctagagtttaagctatacatcctttcagtaaagttttttatttcatctggtttcaaatatatactcaagcattcgcatttttaaacacggcaccatagagtattgctactaacgcctttcaatcacaaacccgttcaaacagttattttgaaacactgccttctctaacacaaatgggtaaaccagatttaaatgtaaaggaagaaaaaaaattactctttaagtcaggggttctttagcaaagccctcatcttacctgattccctataacttttactttccagtttgaatacagcatagactaaaaagttgttatagagtaaaataactttttaagccttaagcctataagtttttacagagtaaaatcactcccccagtgggcatgcctgcaattcaaggggaaatctgctttcaagttgttctaatggccccgaaccagatgctctaagatggccagaaacctttgtctacacccacttagcagatttctggctcgttatcagggactaaaaggtttattcacagaaatgaataatttccttcgaaatatcccttaccctatttacatgcttgcatattccttccattttgttttccccctacagctttactaagggaattaattatctggaagaacaggaacatacagtaagtacatctgagttacaggatgagacacagtatgtcatctattaggcctggctaagaccagcagctgatgctaaatgggaaggaacatgcaccaaatgttttttaatcacaaagttagtaattaattgctctttaaaatacattttatgcttctttctgtctgtgtacatgaaatgcacatttattacatgccaaaaattacaacattatggtttaaatgtgactggcacggaagtccggaaatcagagttaatgttcccacagcaactttaattctgtccgtgtgcacatgtagagctataatagtcttccgttccaggataatacgtatagatggttttgggagggaagctaaagacccatatcctcaactgtagttacaggaaaaaaatcaaaggataaaagctgtgctcctttccacatacgtggataaaaacaatgtccccacacccagtgttgtgtaatcagggaatgaaagaatctgctgtgatgccagcactcaaggggacagtttctgttgctgtgggaacctgaactttgcatttcctgactttggggtaattaaaatgtcagccttaatgtggcattaatggagtttgccataaaaatcttctgttttgttctctaaaaaattgcttaaaagttcaaaatgagccaagtgtactaaaaattttaatcacacagacttgggcgggtgaagcaaatggttgggagggggaggccaaggaaggtggatggcaagagttggaaaaggaagagcccattggcctctgtgagtgtccagccccagcagaatgatgctacctacggagctaaagttaaacccacccacacaacagtttggaaatgtgtaaaggttcaatgaaaaataaataaaaactgttcatgcgtaagtgcatcttggcaaagacacaaaaaatgagacagtctgatgaggccggtataaaacatgggaaggtaagtcaccatggatatcagcttccaacaaaagaaagacatcagaataggtggatctacagcagaagtagggaggacggccacagggaggaaaatcacttctttcaatgggagccttatttgggggaaaacaaaatggaagaaatatgcaagtaaaagttctggtcgcgtctatcacatgtatatgactgtgatgtgctacagcttgatagctgtcaagaaaggtttttcatatggagagcttcgtctgctttactgacttggtttagtcctgcttaagcatttaaagggagcacttggctcagctcatactcagcttgcttagtgagtaactgctctatcaaacacctagggtgttttttacccttcagattccataactcatcttaatgccttccattatcaccatgtgaatttgcttaccattagatttttagcaatggtgaagaggtggtaagctagggggtaatgggggaatattgctaaaaggaaattgtgttagtaggcgcactgcaaagcaacatacattttagcagcaatattaacctcatcatctcacaaaagaaagcatatctcaactatatttcttcttgttttgaataccactgggatcttttgccgaatttgaagaggctcaggaggttaaacagccaactgagaatttagggggtcagacttgtcatctttgctgtaaaacacagcctgtgtccttcatatgcaaaaaagatggtggcttacccacccatgtcagttcatatgcagagctgacttttcttttgtggcgatgctttatccatcatgttttacaacccagtcaccaatatgagtagttgcacattttcaagatgcctgttcagagccaggaatgccgtctttgggctcagaacagagaattccaataagaaatgctctcacaatgagagcaaatccataaacacccctcggtacccaaatgagttaaccacaagcgagtcttccatctacctgggtgtcaattttctcagttttctcatctgtaaattgggaaggatcatactgacaggatatgggcattaaatcatgactaagaataattttgctaaacacatgacaaataaaaaggtgctataaaaattcaagcacttgtgaaagcttggaacaacacacactggtggaatgtttctgaagttaaagagactaacaagtcaagggcactatttttaaatgccccaaatctgttagttctaaataggaactgaatattttaccttaaagaaattaggcttttaaattaatctatggtaagaatgacatttgaaagtaaaaaaaaaaaaatcctcttgaatgcaagaagagcatccaaaaattttaacagcttaaaataaacctttttcctgtcttctctcaagcaatctccaaatggacagatttctgtgaatctttcctaaaaacaattttcttctaagtgtaggctcaaatcaggacaaactacaatccaaatatatttggagaaaagtataatcaatttaaacaacaggttggaacagagaagacttacacatcttaatggcaaaatcaaagtgactgtctaaaaacagctggagatcaggtttctcctcctggtttgtttttccaactgagctcacatccactggcttccccagggccaccaaggagatgtatggtgacaccatactcacgctgttcctgaaacttacttcatgccaatgctaaggcctggccagaggatgcttatgataaagcacaataagtgaagcccaatgctttttctattcacaaaacattcatttttgctgtaacagaagatttctagcctaaggcaattctatgtaatccatacccataaggtgtggcagaaagctgggtaatgaagacctgcatgtagaaactccaggcccttcaccacaggaacgggctattttcctggtgggaagggacagtgtgcacatgcctatgggcactgtgccactctactttccaattctttctgtcattactattacactgaagattgccaggcaagaaggtccaaggatgtgactattaggacggtcctcagaacacagtccctgcttctgccccctggtttctctatagaagcctcaacttcgactgttcaaatcacataggccacagagatttgtctcacgttacttcccttttcattttctagtgacggctagaatatggtcttagcccaaccttaaatagaacaagctctcttcaccccaatcctgccgccagctcatttccctctctttagagactatcatgatgaagcaagtagagaatggaatctcctggaccattgtctcttgccttctttgcagaattttacatttgttctgtcagaaaaataacaataaaagatttagaatctcatttcctaataatttttgtctttgtggacaaaattttatttttgaaataaaactttgcaggtcttatgttactcattttaaagaagaatatgccagttatttgcatgttaccagacatcctttatggagatcagttcagaagagttgttgggtatgttaagactaaaaggaatattcttttggattcgactccaaagttatttcattcctttccattgtcaacacacatgtttctttttctctgaagtattgggttacatttcagaaaaagaaaaaaatctcctaaacgtgatttatcaacttgcttaaaatagaattagaagaagtgactcccagattagtgggaagatggcaaaaataaacagcaaagaagtgatttcaatagcgacgatctcattaagctgcccatttccaaatttagcccttaggcagtttttttaattaaaaaatatttttaacctggattctcattggctgtgtgaagtctgggtggcttctgaattcttggaagccattctcttttcttctgtaaatttatgctatcctttaaccacttcaaaataaattaaaaactggaaagacagaaattcagccaagctacatgagactccaataactaatgcaaatctgacttgtgttatgtaatttcaaaatggatgtttccttgtgtctaactggccttctgaggtccacatttggttgttcaatttagtaattgtggaagtgccattatccagatcaagaataaatggataccagcaacaaaacttcattttctgggttagtgttatgaaaagaacgtgttttatgtaattaatcagccctttaaggccaaatggcatgtcacctggcttttaaatacactctagctttgcaaacttatagatattggctgaatgaaaatggtggcacattacttttggctgctttagaagaccaaatgcaaagagctcgctctgaaagtagaaaagccagaacccagggtagaagcactactccaagcactgcaaagacaccatcaccttagtggtgtactcacaatcagatgacccggtgtgagcgtgagagtttgtcagtgaatgtgttgagtggatgagggctgggtctggagacaaaacagcttcaaagttcaggcagggaaggcccggcttggcgctggatccacccggctgagtaatctcattctcctcagatgccttctggttttcagctgtcttgggtttcttcctgaaaataaacaaagggccctttgaaggaactgactgcatatttgggaaaaggcatttttagaatctgttaaagataacttgattttttttttctgaagggggatgggagggagtccagtatgtcccttgttttaaaacaagctgattcttgttttttttccctccagtaatggcctaactgggaacacatgaaagcatatgggccaagcaaacagcaccacatttggactctgttggctgcataaaaagaccctgtcccagaactttagacagcttgagctacgtatggctgacattatccaagaaagcatccctcttccccccttaggagttttaacatggtctggaaaaatactagtggaagttttaccgttctagcatttgtcaggaagcttagagacaggactcgtggagtaatgggaggagcactggactgggagtcaggagacttgagctaccgtactagctgtgcctctaacttgctgtgtggccttgggcacctcacttcacctctctgggcttcagtttcctcatctgtaaaataaagggcttggattagaaggccttaaaggttccttccaactttaaatttctactcatggactacattaaggaacattcaactttcctgctcttattaagattttattttaaataaaatttcaaatcacaatttaaatttgcagcctgtacggatgagggggtagtgatgggaggtttctgttagagtagcaagtgaaaagtgaaaagaagagcttagattctagtagctaaagagggaaggtgtcatgcagagatttttctactccaactctttactcatcctacgcctaagatttttgatttggtgcatcgtcctggagtttagggtgtgattgtgtgtttgggacatgaggaagagaagggtgaagggaattagaaagtaattgttactaattgttatatggggtcaggaataggaagtaaaacagcacagctatcagtcagctcaggtctcctctccccaggacaatgcaactgatatgaaattaacaaatacttagcttatactacacagaccctagaccacagccaaactggtttattagtaatagttcctgaacatttctccaattcccttggatttgtgtctttttctatcattatgtggacatgaccagaaaaagcatttattttatttgtagaagactatgtgtggtacagaatttgttgtaagtagatttgtttccatgtttcccttgtttctgtgagcatggtaatgtacttgttatgcagaatattttgtatttaaatttgttgtgctgggtagttaaatctgccctcgcagaatatggtgttatgattagtatgctgtgttttcagtccaacaggttgtgaaataaaatctgtttcttcagagggcaggaggcagagatggcatggcaaagattagaatagaggtgaggctttcagacatctttttcagtatggaggaagccaatacaagagaagcaacaaattataagaccttatcaattgatttttgaatggtgactatgggagtaacccccaaatcttgagtgtctacatggaccctgaaggagctggtattctgattttcagtttaaagatgtagccaagatcaaagttgctaaagcccaactcctttattaaaaccaatgctttctctaaggtccatatctctatcactgttgtctaccaccaggttggaaacctcagggtcactatacaccttcctctgccttaaagccaattcatcagtaagttcttacagttctgcttccttcatattttttctcacatctgtgtttccattccaatttcactgcaatcacctactgctttttatctagctgattgtttactaactggctctccaacctctttcactcctctagtcctgtttctttgcattcactaaatctaagatgactacattagcctgacactcaaggtcagttccgtatctcttctaacttttctcatgtgtcctgtatattggccatactgtaccctcagatttcttgaatatcctccagaacatcctgggaatctacattctgggctctacatctttgctcaagttttctcttactttgaatatcccatatttcatctctgccctgttgaaatcatacttattatccttcatacttattaaatggtgtcttcatcttataactgtcttgattcctctctgccaggtaggacttcactccccacagtgaattcctccctaggtctttctccgaaatgcctaagctcttttttttcttaatcttatttcactcactcaattttatttcaataatggctatttatgtgcatatccctcttgtgagactgtaagctctctgaaggtaaggaaatgtcttagttattttagtattcctagtgttcacctattcttttcttcttccttctctcctgtcattcattcatttacatattcattttacaaatatttatgatgtacccatgatgtgccaacatgggctaaagaataaaacaggactggttccttccctcccagagtttactgccttgtctatactattaagcaatgtagcttagacaaagctgtcattcaataattgattgtggacagaatgaaatgaagctgaaattaaagtgtattttaagaacggtcatagtctgaatcccaattaagtttcctactttttatgcagcaaggtagcaaaactacctgactggctgcttttgctttaagtctgtgaggggtatttaataagagcaggactattttgctcagtaaggctaggctggccctcatgattcatttaaatatagggtcaaaacagtaatgacatatgtcacctagcagaaaaaagtgtttatttttgatattcatagacagggcctaggatactttcagatgtgtgcttcagaaaattaagaaagctttctttcaaacataaggacatagcaaaaccaccaatatattactcttttatttttaacactgcaaaaattatattgttcttcatatcaatgcccttgtttccttccctagattcgctcttgtttcctacctgacatcttgtatcacaccctcctgttgcctcagtgatcactttgggagaatattgatagcacagaggcattggagctacctctataaacaggaaatgttagcaactcaacctttttggctcacccccttatttgtcttatatcactttacttacccttataccactgggctgtttcccaactgtccagataatagagaactgctcaccatcctcagaagcaattcatgtcctgtctcaccctctctaatggttcttcggactcctttttccggagctgagaaaccctaaaacatagcacccgtttacgtctagacatgcacaggtgctgtgaattgaccccatttttgcagttcatagtttattaaggaggaaagaataagccctgtcataattagttgaaaatacattttgaggctgtataaaaagaattataaacatggcacatctgagggcaagtcttttcaagcctctgtggcgatgcactattccctggagcctttagagggcagcagcacactggctgactccagcggatttcagagaggcgaactcccgaccagaaccttcctcctggtcaccatgccaaaggttgatttgccaggctctggcctctcagtctctttcttttcagttctcattctctctctctctctctctctctctctcattctctctctctctctctcattttctctctctctctctctccaaccccttcctcctctctctctgttaaaattatacactctgatgaagtcgcccctcaaccggaaaatgaaagctccaatgaaaaagttagacaagccaacaacaacaaagaaagaaaccagggaaaaaggaaaagggggctggtgacagggaaggacttaagaataagaaaagggcagatgtttcgcaaatatatgcaaagcaaaactgggtgtaccctgaacacttccacagagaaacagaccaatcattgtgcacttcctcccgccacactggtggagctctgcattcaaaaaaagaaaaaaaaaaaaggcaaaaaagcgtggccgcaggcacccgcctttcaacggtcagttctgacattctgactgaacatctctcaattgtccaaggagaacaaaaacattttcatctcctcactgcaaacatttctgttatgagaaaaggctgcttcaagaattgggagtgtgttttaaggagactggcggccgagttagccagcagagccttctggtttttaactctcattgtgctggccccagcaagaagttttaggctgaaacatagcagtgagtaaggctgtggaggatgttggctctttcctaactagaccatattgtatgtggaaagaaatatgcattaaaacatattgatgatatggtaggtattaagcatgttaaatgcatggaaattaaccagatcggcggcatttgatgtatatatttcacactcttttgcacatattgcacacatacagtgatggcaatgctttctgcaacatatggaaaaataaatattttatctgtgtgagctcttagcagtctccagggtgttgagagtgctctcttctttcaccctatcccaattttctctcttcactgggctcccaccctctcttgcacgttaatgtgccttttacttatcagcttggtcttttcctatctggtaagtaatgtgcctgttacttatcagataggaaaaaattagttggaacctcctattggctcatgataatttagaccagtgatgcctcccccaatcttactggagtcgtaacaatttccctactcttttccccaacaatacattaaataggcttagtatctgggcaggagagaaagggtaggtggtaacaaaccaccccaataagggtggtagcggaactgcgctccactacctattagctgtatgtcctgggtagattactccgcatctctgagcctcattttcctcatctgtaaaatgggaataataatacctaccgcttagggttattgtgaggaacaaatgagataagccatgtaaagtgatttgccttgtgctggcacatggtaagagctcaataatggtagttcctctcatagggattgttagttctgtgatattcatcatgttagctttaagaagacatttccgggcaaggggtggtagctcatgcctgtaatcccagtactttgggaagtcgaggcgggcggatcacgaggtcaagtgatcgagacaatcctggccaacatggtgaaatcctgtctctaccaaaaattcaaaaattagctgggcatggtggtgcatgcctgtagtcccagctactcaggaggctgaggcaggagaattgcttgaacccgggagtgcagaggttgcagtgagccgagatggcgccactgcactgcagcctggagcaagaaaaaaacaaaagaaaaagaagacatttcccttcatttcagtaatctgtttagatatctagattttgggtaggggcaaatggattgttattgtagcaaaggcagaaacaatgttaggaccagcaatctcttcctcaacatttgatcttgctgtatacttcctgacatctcctttctgctcacatgtttgtcattgctgtggctacactacaccatgagctccttgaagctgagggttgagcaagctgcacttagcctatagaagcccatcaagcctggacactatggtctattcattgagaccaacctatgggactctggcttatcgtgttttcttgcaatttatcatttctctacctggtctgatgtcctcacatcaatttaagatattttagtgattaaacacattttattttctcaatcttattttttttaaccttggcagggctgatttataatttttttttcagtataatttcctcttaactgtatcagtcaggatcctggcaaaaatagatggcacatgcaaagtttttagctaaagaggatttaatgaaaaaactgtatttggagctgcagatgaggttaagggacctcaagagagatagcaccaggtactagcaatagtagagactgccaggtactagcagtagtggaaagctttaaaccatttaaactgaaggggcaagtaaaatggtgatgaattctgagtccagtcagaattggagttgggaaggagggctgaactaacacatttcctgacctctctcttcccccactttcacatctcctgctgatgtctccttttggccaaattcaaagggaagcccaaggacaagagagcctgggtaatgtagtccagaaggccagtcttctgggtcacacatcagggcaaaagaatggttctggggtttttttgggggtagaatggggtggcaagactaatcaacatatgtgttcttctctcttatactttcaattatactttctggaaggaaagacagaacaaaataaaataggttctgtcttagcttccatgtacctattatgtcgaattgccattcacagagcaagaaaagagaatgctgctcagccgagcagggatttttgtttgttttgcttgctgccatattcctagttcctagaacagtgtctggcacatagtaaatggtcagcaaattttaaatgactgagtaaatatactcacctctgccgtgacagactttatatatatatcatctcattgacttatcacaataatctggttaagtaggcagggccactgagcattattgtgcaggtggtatggggggggtgggtaggtattaaaatttaatatgtgcctccccaacccacttccaagccttgtgactaggcccgaagcattgtcaacccaccagaagagatatacttctgtaaatgattcacattttaattttttatcctctttattgatttttgcacctagcaagtttctgttttattattattatttctcttttatgcattggaaagccaagtttctgaatagcaaagactgcaaagattataacccagtctgtccattctctagggcccatgagaagtaaaagcaggcactggcattctgcacagatgaaatacttcctacgacaggaatacatgctcacttgtggacttctctgtaatctgtaggcaacatcagctcctgatttctaggtctggatctgggttctctgtagcacaggaaggtaagagtgataagaactcttttccctcttaaaggatatagaaacttttaaacccatctgcatcatagtaaggctgtgttatctgtatcagcatagttactctgtgatgaagaaaaactcagaaaactatccagatgtgggaatttctcgggtattccttgcacttgaacttaaggatgaatgaaggtatatacaagtaagttccttgtgtgggtgtggactgaagaaactatgtttgatcttctgtcatgtctttagtccccagtaactcagtcctattagtactatagaacacattcccctccgggaaaggcaggcctgtctatcacctacacagcagcccccatcaactatgattcagttgactggaagcattaaaggtaaaaaagcaacacaaaataaagcaaaactctggcttcatccctttaggtttgatttataccagaatagctaaagacatagaaatatgaatgtaaatatcctacctgaagcctaagagggatgttagtctcccaggtttagcgttttccagtaacatagaagtctgtaaaacaccatcccattacctgcctcataacatataggaaaacttgtgaatataacaactagttattgttttaaaatgtgtaattaagttactttgcatgcagaacttctaaataattcaaatgactggcttttctattggaaaatagcatatattcatctgttatttcagcaatgattaatgaatacttgatatcaaactttcatcagtattttcccataggtatcatatcccctaccccaaattatttctgtacttttccttgcaaggtctctacttctcctacataaatgccttgcatggcgggaactaaatcaactacacagacccatacatccagagagcagaggtgagctggatacaagtggcttagagatgtggtggaaggaggccagagctccaagggaagggcagcaaggagacaacagcatgggttgcagctcagacaacaggtaaataaaaccaagcaaagctgctggtcacagatttgaccagggtggcaagaaatgacaagctaccatgagattcaacagtggcacggaaggatgatgagaagcaaacagattaggagaagctgccaccaccgtacatagaggcacagatgaccaagcagaacagcaccagtccctgcaaggtgtgctcagatacagctcagcacagccatctggccaggagggaatgataatgcacatggtgtgcactgcagccgggaagttgagaaccgctgtgggcacctcaggactgagtctggttaccctgctgatccaagaaatgaagccatctaaaattttgcctgctttcacaattttctgtgtgtgtgtgtgtgtattaaacaaagtgaactaagaagccttttattggagacataatgtactcacagtagtttcaaaatcaatggtgtcactcttcaggtaaattactccaaggcttgggcctagtgcagatgttcattggggcagggagcagagagcggctgcatctagatcagacaaaaaacaaaaataaggttgttaaatgaacaggtgatggtgatggcaattatttattttgataggaaagaactttgggacttgagtgagaggttggttgtttggttctacatctttgcaccagagaatggcgaggtacggaagggagaatggagaggatgttgtccaggctccattttcagtgctttcacctaactgcctgtgcagcctgggacatcaacagtaccctgtcagtgcgggcggagctgattttgtggttctgacttagaagctgagttgtgggtgacagtgggggaaggaagtagaaacagtgtccttcaaccttcccacagttgattcttctagtatccttttcttttttttttcatttattatatttatttattttttattcacacataaaaattgtatatatttatggtataaaacatgttttgatacatgtatacattgtggaatggctaaatcaaactaattaaaatatgcattaccggctgggtgtgctggctcacacctgtaatcccagcactttgggaggccgaggtgtgaggatcacgaggtcaggagatcgagaccatcccagccaacacagtgaaaccccgtctctactaaaatgcaaaaaaattagccaggcgtgatggcgcacgcctgtagtcccagctactcaggaggctgaggcaggggaatcgcttgaacccgggaggcggaggttgcagtgagccgagattgcaccactgcactccagcctggcaacagagcaagagtccatctcaaaaaaaaaaaaaaaaaaaaaagaattacctcatgtatttatcactttttcatggtgagaacacgtaaaacctactctcagtaattttcaatatatactacattcttattaacgatagtcatgaggatgtacagtacatctctggagttattcctcctgtctaaccgaaattttgtgtcctttgactgatgtctcctcagcgtctggcagccaccattctaatttttgcttctataaattaagcttttatagattccccatataagtgaggtcacgtggtatttgtttttctgtgcctggcttttctagtacaaaaaaaagcctattttttccccatatatcatggatgacctctagattcatccatgttcttgcaaatgacaagatttccttctttttgaaggctgaatagtgttccattgtgtacttttaccacatttctgatattcttgatttcatttcagtctctctctttattgcttagttcttaatgtattctagtgacacccattgatctgggcatgttctgagcattccctctgtccttcactgcaaaggctccattttcttccataggctctaaccctgaggacaccgaattaccctattttttcccctatacctcagtctgctattctgccttcttcactggcttattttctttcttctgttctctaaatgtagacattcctctagatcctctcctcaggctttgtctaccccagtcctccctgacctcaacaatcacttctccatggagagcatccacattgctatctttagttctagcttttctacagagctgcacacccacattctaaataacagctggttattggttcattcgttcctttgtccattcattcagtgtttatatagcatctatgaggcacctggatgaatacaacagggtctctaactttgagaagttcacatcgccatcaaatactacacaggcttttctaattcagaaagtttagaacttaattcattgtctttcctttaaaatctgttccttctctagacgtcccatttcctgccattggtattctcttcatccagttacgtgggcctacagctggggagtcatcttcaattcttccgttttttttttcttcctatatccaattagctacccaatcctgtagattctactctgattgtgattcctgaatcaatacctgttttctataccagcccctatttctccctttgctacctactgtgaggacatctatgaaaagctcctgactggtttcacttttccagtttttctttacctcttgtccatccttcacacaaacattacattaatttttctaaagtgcccttctaaacatatcacttctttgcttacagtcctccttgcttattggattaaattcaaacttctcagtttggtattcaaagctgctacaatgtagcccaatctagtttctcactcttatctctacactccattctacgctccagcaaagtcctactctttcctaccatgttcatggtatttcttcctttctttcaatgtctacatgtagcttcttcaagggccatccaaatgccacctcatttatgaagcatttcacaaaggagagtgcccttcttaaatattattagcacattctgtactactccctttgcatattctaccaattagaatggttatttgtgtaatttgtcttccttcttcataagccctttgaaagctgagacaatttttactctgagtaccctatagtgggccatgacttcttgcacgttaagtttgcactaggctgataatctgctgaactgaatttaaaaagaataaaccctcttgccttgagtcatagaaacggggactaaattgaaaagacctaaaagctcatctgcttcaaccccctcatttttcagacgaagagatgaagggaactgacttgctcaaggtcgcatccttgttagtggctgggcaaggataacagacataaaaggccacagactaatatttatcagtgcttacttggcaccaataggcccaacagatcatcagtaatgacaagaccagagagagggaggttggggtgtgtaacctgcaaaaatatattgtgttccaaaatataacaaatttgcttcatttatttgcttcaacaaaccgaactaataaatatgttttatagttaaatgttgtctaaaaaatgagggtggatttaaaaaacaaggaagcaaagttttctaacattaccagcagaaataattatgacaatactgtcaacaccactggggaggaggtgcggatggttaatgggtacaaaaaatagaaagaatgaatacgacctactatttgatagcacaacagagtgactatagtcaataataacttaatcgtacattttaaaataactaaaagagggtaattggattgtttgtaacacaaaagataaatgcttaagaggatatatgccccgttctccatgatgggattatttcacacggcatgcctatatcaaaacatctcatgtaccccagaaatatatacacctactatgtacccacaaaaattaaaaacaaataaaatgttaaaaataccactggggtgataaactcaggctgaaaataagaataaagaaatttctcatgctttggaaaagctgtgtgttcagctggagttcttggtgaaaacatgcagtaattccgtggttaaattcattactttgtagaaacaaactattggcaatctgctattatgccacattaacacttctttttccacctagcttagcctagtactcattctctaggtttgtttaaatgtttacttgtttttctttccttatattactaatttacttgtagaaatgcatagacaattgcctctgagtctgttcaaattttcttgccttgttcttctcttgtagtagaggaaacattagttgtttctcttctctatccttatcctcaaacagaatcattttctctcacccaaagatgaaaagcccaacaaaacatgctgtggggataatagtgtttacctaggtgaggaaaacagacttttccagggaatctcagtaattattacttggccagaaaagctcagctcttaaatgttagctccaatactacaagacctcatctgcatctcccaggtgagcgcttgactcactgttactcaccagaggaaaaccttggtaggtagcattaatcaaactctttttggccagtatggtggagccatgctacgcattgagacatccattaaatagcatcaccccagcagccacacaaacagcaaaatgggctcaagagctcttcattgttctttctaacccatcataaggctggacagattattgacacttcaccagatagaacttacttctccttttgccccctggcaactacattaaaatcataaaggaaatcactcatcaatagtacattgcagtgaaaaattatctggcaaatttacaaatcctttgtgtaattatataaatgtacattttaaatatatctaaaatctgatttacattgtgcattttataattaatacaaccatagtatgtctgtcctttaattaaatccttctttctcagtcccacatcctgctgctataatcttactttcatttttggcaaagtgtcacctagctccatcttctttccccttttgccttagtacacacctgagcgtctattaatcagaaccactgcatggtgtgtcatgttttattgcttaaagggtggttacactctaaaaaagattcggtgagaatgacttcatggggtttcacatttattctcttttaatgactttcatatccagtgtactcggtttttaagtcaaaagataattttgaggggctgctgatgccacaaattctccctagaacctgaaaatccagctgttgtctctgcttcttacatcatcactgtaataaagaatctgctcttggaacccagctggcaagtttcttgatggtgtcagaggcgaacagacagtaggtcacttctctacagcccgtttcattgttggcgtttctgcagatctgtcttggaagcccttagagagcagagctgttatgaaatacactgccacatatcaatgtaaggaactttctgcagatgtctactttgagtatggcctgtcccagtcctaggaaatcacaccacatcgttctaaaattatagatggggggttcatgattaaagtttacaagaaaggtaatagtaacaataacagctagcatttattggatgtctaaattttatcagggactgcaccaggcatttttataaatgagtatgttcttgtttaaccctcatagcaatgctatggtgtatgttttagtatacccattttacagataaggaaaagtgagacttaatgggcttacgtaacaggtcgaagtttagaaagctactggatagtgaggccagaatccaaacccagatctctctgagtctaaatctgtactcttttcactatataacaactgttccaatgcagcatggacacgggacacatttctagttcccgctgtgatcacagtacaaggaagatgcttatttccacgatggttcagagccactggaaagatctgggagcacagactccaggagaaggaactatttcagaaactgccaataagtatagtcccttccctcctcctttctaattgcagatgagaatgtcctctaacagtcttctcaaactctaatgaacaaacgaatcacccagggcttctgattcagcatgtctggggtggagcttgtgatcctgcatttctgagaagctcccaggtgatgctgatgctactggtctgggaccacaggtcttatttctgacactctcctttctactagggttgtttttgaaggagcagttcaagccaaataacttggctaacagttcacacagccagccgactggcttctgattctaggccagtttgtcaggtcatcaggcattacacagaattcaaggagttcttagcatagagcacactgtcaaaaaattgtttttagatccccaagggttttcccctctctctggaaattcaaaatgataatgtctctaacatgtaaagttcctatttttttacattattgttatttttaacaataattatctggtaataattcaaataacaccttccctctgagaaattcaatgagctttactaaccttaattgtctaacagcaattcccaggtgaagataaagctgtctcaaagatcatagtaaatttaaaattgttccacttccctcgtttctttgccccaaatgtagtggtgagttagtggggacgggttactaattggcaaaggcccactatcataatttgaggcacagcaaatttcataaaaaggatacatctaagaaatatttagcagagaggtcattgtggggaatacaatgttagaaaaaaaagagttagaaagtgtaagataagaaaagagaaagcaaaatcaggactagctgatgacctccgatgagacatttaacctctaggtggctcagcttttctatctgcaaaaagaggaggttggttttatgatttttaaggtcccttaaaactctaatagtcccctgagaaggaagatgtgggaattaagtagctcatcaacctgttaaaccattaaacatgttaaggaagtctatttgacttttaactttttagctaattacccgaaacaaattcccaagtctacgtcaccagccccacctctctggaaagtggtgagaaaaccatttaatgaataaggcaccaaagacatcacggccagataaactaatcaggaacaccatcgtcagcttactgatgctgtgataactattttactttttaggttttagttccttaattaaccactagttaatacccatgtccataagaaacacctctgatggcttgaagacccctgggatggccctgccaacacaaggtggaatcacaatcccactgtttgtcacattaaatctatgttaattttctccatagagacctcttgattcctctttgacagttcataaactctgttaatataagttgcacatcccatgccatgagcgttagcattatcagatacagttgattcttgtttaaaataagagatcttttggatcagagtacatgtaaacacacacacccacacacccacacacacaatcatgaatttctggtattaatgaatctggcctggtgatgggaacccctctattatgtcaccggatactggaaccttcttatccagaaagcctgccacaggtcatgttaataagatcgttttaaactttgtaatgagaattctaacatgagcatgatttatgacacagcattttatttggtattatcagagtttcctataccttacctcttacagtgagtatgtgttctgaattaaccattatagtttgtggtaaatggaaaaaaaggtacagagaaacatcacagtggcattactccagataacacactctgtcactgttcccaaagtgaacatcatttccctcttcctgctcccatcacttcaatagtaactttggctattactgactaaatgcttaccgtgtggcaggcattgagccttttcacagataactttattttcttacaattactctttgaagttgggaattatattcccattttatagacgaaggaggtgaaactgatactcaggaaaggtacagttattggtcatcagtcatgaaggcagagggtagcaaagcagagttaagggccaggttctaaccacatgttctagagcttaacctataccaggctcacaatcaccaaaccactgatctgccttcattccactcctcttcatttgtgatccccaccattggcttaggctagattcttcttcatggctctctcatgtcttcttgaatatttcttgaaatttctcaaaaccttctacacttgatttatgttttccctccctgtattaataatttaatccaaaaactcattaacacttcttttcaacagactttatcaccccttttcttagctctcatactccttctaaattactcttttgaggcctcacatttgacatcagatgttccacacccagctattgaactcactttcccagaagcccaaggaacctattgttttcagctggttcattagtaggccccagttggccttaccagatgtatttgtccagtttgatcttgccccatgatcaaccatttcaacactgtcctcagtaaccatgcagatttccttccttttctaactttctatgtgcagtgcctccttttacattcatcaactgtgaatctgtatcaccattctccatttgctcccactctcagaacaaaaggctacacatgcatgctacctggacctatgctcctgcccactgtttccaggtacaacctatggcagtttttcttagtttgttctcctttatgaagtcccattctctttttcagttgatgagctagcatcctagtttaataaaaggatctacaccatgcagtgtggtaagcttattagctctcatctcctctaatatctctgaattttcattattttatttcctcaggatatatcttttcccatgttcccttcgtatcttgaaggttattctctctacttctctttatcttcctttggtttcatcagggatactttctctgtagctgatagcatatcaatttctaatagtactagattaatcatcaccacataccttttttttttttgtcccgcattcaactcctgcccttcaaaaatcttttcagatggtgtatcttaaagtgtgtttcatactggaacttcaagatgcatctcaaaaaaagttcctcagtcaagtaagtttaggaaacactgaaaactatatattctattttcaaactcgcaagtgtacacaggatattaaggtgctggaagcctaatctttgtccaggcttaccggattacagactcccccatccccctttttaatggaacacttatttaacctcagaatatgcttcgggaaaagatgctttaagggattcccctggttccaaactcttaagcctgggctcggaaattcactgactccctatcaaatgagtcctctcagatttcctttccattaatactccacatggtctaaactggttaacttatagggtgtcagaaagactaagcacatttctatctctgagctactgtatataccagtttggctgcttggaatacctttatcacctttcaaaaaattatataggacttttttctccttcagggtccatatataaaaatgtatcctttatgaaattttcccttgtgaagactgctttagcccataatgttttctgccactttttaagtacttcaataaatggttatggtttactgcctgtttgctatattattagcgagggtgtacatcctcttgggtaggaaccttgttttatacactacagagaccccagctttttgagcacagtaggatgttataaccatgtcatcggttaatataaacagaaatggatggcattaagacatgatggtttaaaacccaatttctgtagctattggaatagtttaagatgctaacagcccaggtgaaatgttccatcacaatattgggaagaaacactacccgccatcactgccattgccctgaaaatgataccatgtgtgtctaaggatgtggataaaggctagatacagaagagcaaaggcagctccgttcttaggtgaaagtaagaatttgcattagttaacaccaaatggcgataagattaaaataatctaggaacatcaagtgatccatgaaaggaatcactggaatataccaatggtaaaattaccattcataatcattaaatcatggtaacttgatgaaaagaaaaaggatattttcctacttaaggaagtcagggtaagtattgtctgaggttccactgtgtgctattgtgcctggtatacagaatgtgtagcaactatttacagaatctgctactgccttctagtcacattccaaattctatctctttgaatcagtctggagacacaatacattggtgaattcaaggcagcttggcaacgactggcacaacataaaaccccaaataatgaattccatctttcccataaagctcttttattgacacaacatacaacagcgcagggcaggttgtctcgggctagtgtgtaataactagatgttaaggggccctgagtttttcagattagatgttatctgaagttgggactcagcaggttccctaacagtgaatttttagtgggcctacgactagaagtttggtctcttgatgcttagtcagggagttttattatgtgagagagaaaagtatagctttctttcttaaaactgcagcaatttcatattttagcagaagagaaagtgcattttattagagtataacctgtggagtattttgctaccttcctggatataaagcggtatacaaacaaaaaatttaataaaaagctattttataaataagaatgtttacttgtgtttaccttaaaataggtatagcttgtattatttaacatgtgaaatagaaggataatggtaaaatttcataaatataaaattctgtgtccgtcttcagttaaaattcgtaacagtgtatcagagtgttggttattagtagtaatcaataataagtattttttaaattggaatttttattgcaggagattattgggtgggtgaagctaaatggcctagatgttttcctgtcatgtcaatacttaagaattgtctttctgggcaatttacacatgtgagagtgaaaatgaagggtggcctgcctattgggtgtgtaacaggccaccggggcaagactgctattttctgagagccatgggcagtttctgcaataaagtatctgagtttcttctttttgtagtaaaaataaatagtttacttttatgttctgggtgaagcctgagatctctggatctctttgctggatttcactcttggtgggggcagggagatactattggcaatgctttatatatattgacctagacatgttaaagattatgtggtactttcatgaacactctaaaaatgagttctccctatcatgagttgcatagatgaggagattgaggtggatggggtgaagaggaaggaaagggcagtttaagcgggctagctaatgagtagtagaacttaatctaaaaccaagattttcagcagaaaatgctttttttccccaaaaaatgccatggttgtcaacaagctttgtagcaaatctggggcagagcactagatggagaatcagaagatctgccttgtcttcctggatctggtaagaaccagccgtgtgaccatggccaagtcactaacttttgtgagtcttattgttctcacttataaagtcatgagcaaggaatcaatgaatggcataatacttgtaagctgtaaaatctctctcttgtaaaatggtattgacaataatgtatgctttgcctatcttataaagttgtgaggctaaaataagctgatccatgtggaagtgctttgtatagtgtggagtactgaatcaatgttgtctggaagatttaggaaagggtcccgaatgtgtgtgggaactgacagccagtccacttccattcaggttttaggagaagctataataaagcactggcagcagctcaaatcccactccatcctctcctctcccagcacgctgcagagaatcacttgaggaaagttacttgagtgggtgagccaaatgctcaagttccaacctttctgagtagaagccacagtgaatcctgagccacaacacaggtgacaatcactgttcctccaggtgtgtctgaaacactgggggaccctagggaaggaggtcagacgtcactgctcctgaggacccgttttctcctgtacacagctccagcccacatgatttcacctggcagccccaagagacaaaaaggatccagaattagcaggagcctcctctcctgataacctaagtgctctgattgaaaggcagagggtatcaggagaatggctgtaccgagtcggcattgatttctccagcctttgtctgtgtctggtttctgtctcgtttggaggtggttactgttactacaagcagcatgaatcatgtctctgttaaaaaacagagcttcaattgtcttacataacccctggtaactgaacgtctaataatagcaagccatttccaggtagggaatctgtctacctcccagacacacacacacacacacacacacacacacacacactactcccaatgcttcacagcacagtgagacagacagggaggagacagaaggagaaaggggacagcacaattgaatttttttgtgttttaaaatatattgaataatcatgcatcatgggatctgataaccaatatacttagctgagctagtttaataaactgtagaaaacaagaattcttctttaaagtatttgaaagtatcccaatccataccagacagacaccttctctaacactcttatactgcataaaaaccccaaacccccaaaacagagtggggtgaaaatttcactggattgtctgctagcttgtaccaactagcttcaactttcaaaggattttttttgtcctcttttttgtttgaccagagagtgatattccaaaggttcttggccgagatcatttcataaaattccagagagtgaaaggcaactgaaaacatggctgcagtgttccaccatgcagactatgtaatgtcaggcacttttgcccgagccactttctttgacggagatgactttccatctgaggacttacatttttcccatgagtacactctctggcttgtaatacatgatgaggtctttttatacttgatccccactcagctacccattaaggtggctactgaaataaaaaaaaataataggagaggctgaaaaatgatttttgaaaaatcacaaaggtaggattttctttaaactaccaatttgtttgagaacaaatacaaatgctggataggaagtttaaaagtttatggggaataataatataaatgtataacatatatacgtccatttcctcactgcttcaccttgcccatgctaggaaaaatcacttaaaggctgtattttttgagtgtgcattctcagagtgaagtagctgtacatatcatgtaaattggactggggaaggacttcgcagaaaattacagatggcaatcacatcctgccagtcatttggtctagaaccagagaagaaaaactttcttttctcttttgattgttcagtaacatgaaacagtggactagactagttcaaaccaaagaatgttttagggcacacccactttgaggaccagcacctggctatgctacatgctcttcaattgtttaggcatataaaaaggagtgatgagatggttatatgtcaaaatggctgttctccctccaaacaggatttgattggcttatttgcttttggagtactctccaaatccataaacaaaggagtattgaattgaagaagcaaacaggagaaagaaaaaggctaaaaaggaaaagagagaagaagaggaaggaaaaatactaatttctcagtattcctatctgcaaatctggctggatttgataacaaaactcctactactgttctctaatggtctttgctgcatgccatatggacatggcttctaaaggggatgaattctaggttttcctcacaaatatccaagcacagaacagcagggatcttgacgactaaatcatcctaactcacgacgaggatcacagaggtggaacatggctgttgggactagattcttctgcttatttcatgtgctttgtgaattaaattgttcgtagagttggaaagctggtggactaaatgttttaataaaaacagccatgagacacaacagttttcttcacaaaggctttcccccctagctactgtgaatatattgctgaatggttctgacttctggaagggcaggaggtttgcctcttctctttgcctcaaaaaccaggcttattctatgcatctgggagatgattatacttacccgaaatttcaggatactatgtcagacagttccttcacagtggtgtgtctggcacctaagcaaggacttggtgggccagacacatttaaaatgtaaaagtggatgattatattattttgcattgtaacaatgagagtatttctggattgtagctgacgtgtagatcatcataaccatatgtggcacaacaaaccacacaacattgcatcagaagcttgtagttaatatttttaaatgattgattattttgaaatagagaaatggtggatgcttttttcgacctctttaaataaccacttattgaatgtctattgtcagtgatggactctttcttcacagaagggagctgggctatgccagactctcaccatgttctttctcctctaacactgaacaaaatatcagtaaaacaccaagtacagctggttttgaacctagtaagaaatcagtctgtagtaatgggccatattggtaataattggaactggtgatatcgatagcagtgggaataactgacttacaaaggcacagcagttcaggaacgtctcagggactcagagtgggtaaatgcgtaaatctgctctcacctatttatatgctccaacaaatatctggaactctagaaacttcaagagtctaatatgatcaggccacgtttataggtattataggattcatataaaataaggaggcatacatgttgatctagtgagcgtctccatatttgtacaacactcaggatatgtctgagaacacattttaatttttagaatcagctatagaatctggcagttattataaagcaaacttcacttcaaaaaaattaactgagaagccagatgataatccagatatacaaaacaacattggtgggataagtcaaataattctctaaaatgattatggagaaactgaagaaatgaagggcacctatttatcatatgtgggtccccagccacgtttgtaatctgttgtgtgaccttgggcaagtcatgaaacttctctcgagtctcatttttctcatatataatgtgggagtgttagattagatggtttttaagattctttccagtaataacatttgatgattctaaagtaagaagagatgaaagagtaattcctctttcctcttgttttggtaaatacttgctttctcctgctccgtgcctatgcagtttgcagtgagtattaggtttctggactcaagaagtcaaatagtaaatactgaagctatttttccttgtacacatggacaaatcataggggaataatccttcctttctttgtatatcagtgtctcttctcaaatcagacttatgcctaaggtaatcacgatcattctggtactaataaagatttttcctcatccttcccacaaggccctcacccatgctcatgaaagcttatgtgattgggttatttctatatttatgtcttggctattttttctctttcaacttgtttatgaagtccctggtaagcataaagctgcaaaaacaaaaacaaacaaataaaacaaaacagctctgtttgaataatttacttcagttgaagcagtataagaaaacatcctaacgccgaggggaagaaaacaggtcataaaaataccctggtatcttagaaaagactaaataaaagcttatatcaataatagtttcatatgttattgtctttcattttcaaagagaatggtacatattggctttatagtctggtgtacagacgtggctatttttccccatagctctcaggtcagtgcatcctcaaagccaagaaggcccagagcctgccgagctagctttacataaacaaaggagctacacagaaaacccaatacccggagcttatatcatatcctgactaggcactctggttacccatgactcgctcttttccatctgtgccctgattctctgctggtttaattcccttcacctagaatgccctcagtttgcctccttttactgctcagaattccctctggacacaactcacgactagcataagccccatttccaagaagcagcttagtttgacccaacttagtttgacccagcgaaaattttcatggatagcaagtgaaaattagtccttgtgataactggagtcactgaaaccaggtatctaggaagcactcagagaataccagagaaaaactttcaagggttgcagtgtcctcataggaggaaaaaaaaaatcctagctttaagaacaagcccaatatagaagctgtggtatgtaagagaaaagttgtagccatgtacgggaggaattgtgttaaaacagtctgactttttttttccaataaaggagaagagatcctctgtttcttaaaagaagtttagtcattggatatagcaacatacagtgtcataaagtttaattgcattaattatgaagctaaaatgtctacattttagtagagagaacatggggcatagctaaatggcgaagacataggaatgtgtatacaatttgagtttcacttcctccaaatctctcagttagaggatccctctcagtctgacggtcttatcatcaacagcttcacaaactctgacaacacctggctgggtttaagggatgggccatgatatatcttgagagtaaaagatggaatgaaactcagaaatgctgaatgcttttatatatgtatacaattttatttatgtgtatatttatatatcaatatatacaaacatatatatttgtatgatgtttggcaacctcactcatggtattcctgtgaagtaggcatgtggtaaacataattagcccattaaacagatggtagggctctggcatatctcaccatattctaaaatggtggagctgtaagcagggactaaagagagtgtagtttgatacatggctaactgcaaatctctgtgaattgctactttcctaaagacaatctgggtaggctgcatttggctgagaactggggatagtttaggaagctttaaaaatatacaaagggacaacttttcacattcattcagatatagtatcttcatttttacttactagaggcatttttttttaaaaaacagctttttatcttaactcatctgtgttccaagcaaacttccaaattgctgagcagattaaaaaaaaaaaccctacatgccaagtagaaacactgggtaaatgttattttttaaaattgtcttaacaaagtgcacttttggaaaggataaagttgaaaagacgtttggtactgtaaacacttagctgtcattgtagcacagtgaccaaatacgtccaaaagcacatgtaatgaacttttatccgactgaattatatgaccatggcattgccactctatagtacagcaggcttcagagatcctgttattaaatattctagcctaattctttatcatttgaaataggatctagcagaagtgaaagagttactaaaattaagacttgaatttacaagtgtgtttgaactggcttcaggaagacatgaaacatcaatacatctggagaatagaacttgcaattgactgttctttaccatctggtctcaagaacattttctgcttggaagttgcataagcaatgaaaaaacacacaaacaacttcctgtaccatgtttttggtcacttataatgacgcattacaaagtaaaccagctaaatatgagcaactgcgccttactcgagatgacaacatacattatataactaagatcaatgaaaaagaacatctttattttaagagacctggacttaaaatattcaagaataaacatccttccttctaaggtgtttgtactccttctaaggtgtttgtactgagtagttttggctagacaggtttgtagagtcactactacaaaacaatccctatattttttcaaactgaaaaaggatataaaaaagcaagctatattgaggaataaaatgttccatatattttaaaatgttttttaatgacataaacttgcctttttaagcagtaaaatatattctacacatgtttttcatagaaaacttttacatatctttgttttcttaaacacagtatgttgatgtaatttaatttttttctatgatacagggtcatccttgtgactattcattgttcctgttttacaggaatacacttttcttacttgtggtgagaactggcctcatcccttggctcagcctaacggccacagactgagctatagcccactagccactgccatagccaactggcgtcactgtcccagtttttcagacccatcgcctctaaatcctctctgctaaatgtattttctaatgtgctttggattagaaaatcaaataaataagaactgtagagacaatactgcttgaatgcagggtttggtagaagatttgggggaaactcatttggacacttgaaggtcttcagttacttctttgctcagggttgtaactcagagatctgaactaccagaaagtggattttgaggtattattgtgtaacacagagtgaaacatttatgcacttttattgcaaggcttcttattttaaacagggttgtccagaaatccattcttgattactttacttgataggtctctgatccattatatttcactcccttgatttcctccagcaatgtaactaacataatgacaattgggaagtaaagaaatagcacatttttaggataaggtgagagagtcttggtaactgacttcatcatagtgatggaggcaaaaatatacagtcaagttagaaaacttccctggactgctaatgggaactctggcctgactagacactgggaaaacattaaaaactgtgaagttatttacattaattttcagtgttcagagaagtaacatctgatcatcttttttcctcttctccaaaaggagaagtcagaataattcgcaatctgtgataggatagggattgtatcgaaatttgcctttttattacctctgaaaataggatttctaagcaaactaataaccttaaaactgttgggaggaaggatgggggaaaccaaatgtaacctatatgaggggggggaaacatctttaactactttaacatacacacatctgataagttactgaaaattcttatttattttgaagttagtgctgaagaaactctatctgttaaaacttagaaatctcagttcaaagtacatggaaatattccatgatcacgttttcagctcattctagtcgtctgtctcccagtttatttgaactgatgaaattttacaaaataaacttctttagctttctagagttacgtttttacccatgtaatctatttgttaatttttgtagcatgcttatatgataaaaaatactatgtaagtactgagtttgcttgttatggattatttctggatacagagaatttgcaagaaacttcagtttacagcagccaaggttactgcagactaaagcagaagttcaggcataaacttgtcttctaccagttttccacaactttgctgttgacagcatctgaggacatggttgatgagttctgaaaatcattcacaacattgctaatgtttaggaatcttatagctttgccggacctttccataatcacgagagaaaacctttgacgaaattagaacaagtcctcataccctcccttcctttcttctagtgatttttttttttgtattggaacaatcgaaagattcaatgtttttaaattccatagaagactaacgattgaataattttctcacatctctgtttgcactttcgcagtctggttgcattgatttgtgtctcacaagtagacatttcctttgttggtcacaaatcaatgctacagaacaaacctgccagcacattccacccccacccccaattttttgcagtttaaaaacaaagcacatttatatactttttcttttaaaaattactttcattggttagtaatacactaaaagaagacaaagcctcagagttaaaaatccccgggagaaggagctcctctctagctggtctctgattctctcacactgcctggagcaaagaactgcctagtgggagagcagcgctcgtccgccgtccgctcctggtgtgctctgttaacccaattaaggtcctcgccttcatacatcacaaagctgcccaaagcaacacactgtgatgtcacagtcagatatgatttcatggcaggaaaaaaccaaaaaggcagaaaaggttgaacgtactctgcttttattcaaatcttctaagagggggaaaaagggaagacttttttttttttttttttttttttttttctgagagaaaaagagcacaagctttctgacgtgaatgtgaaaactccgttctgaagataccctggtgcttttaccccaagtggataagcatgaataaagaagcacaaagaaacactgtcatcaatcagaatgctcttgcctacacttagctacaggtggaaagcaagcaggcacgatttgatttacctagattaaaagagcaattttctatcttccttttttccttttaaaaatagccaatcgattttggcctagctattgctgactgtacaggtccattttaatacaccactgattaaacggtatgttcatggctgaaggcactacagcaggaacaaacagaagcagctgaaggaagggggtgggggacaggcgagagctccaaaaaacactccacgaaggccacaactactcggcacttcccccgtagacagttgatatagcacattttaggcttgaaccagctataattctgggagtttgaagcctggaattcatttagctttttaattctgaccttaagaataaaaaaaaatcaaagctatgttttttaaaaaacacaaatgagggaaatattgtgtcctaaactgcaatgacatctgaaatgaagatgtgcctcagaaagatgcttcttatgaaacacttgaaatttcataagttatagaattatctactgaaagaggacctagttgtttagagactttgtttagtgaaattgcatgtaaaagaaacagaaagaaaataggacttttatatagggtgactatatgttgggattcatcaggcagctctcagaagagggagaatatctctactagttctagaaaataaccatcttgattatcatgagaaagtatagcctttatcgaagtctgggtggcaggaaaaataaattagggagggaccttctcaggcaactcagagagagacccaacatccagcagatgtttcttctgagaaagacaaggtccatctaacaggtgagacatcagctgaacaatggatgccaggacatgggaagtggctctgagaatcagcgaactccatgtttaaaaagtcaacccactttttttttttctgtttgcttactgattccttgttcccttctctcctgttttctctctccaattatcatttacttaatttgaaattctggccttaatggggacagaaccgtatccagaggtactattaagataagaaaattcaggaagaaagatttaatgaggggcttaggagtttttggaagaggaaaaggacattagagagaaacgagggaaaaactaagaaattaaatatcagcctcagcacggtggctgtagaagaatagcttctgagagacacagatggtctgcattctccagaacaaaaacaaacaggaagtaacagggccagagccccctctccccttcattcctctctccagtgtaaattggaaaaaaactgaaatgtgttcacatcaaaaagttttccttcaaactctagcaagtgaccacagtaaaagaaacaagagagcgctggttccagcaggtaaaatgctgaaaggatgtcacatcgtgggggtgaggaagaaatcagggattaaatacatacagtttggagaaaaatcaggctctatagctaactaatgatgaatggagcagacaggtggcagatttgaggtccggaggagaggaagggctccattttgagccgcccattttctggaggagaggtggtggccgctgtggaaaatggctactcctggggtgcatagggagacaactgacttagtggagggaagggaagaaataaactagggagtcatccagggacacatcgagttagtgagggttttagtttggatgataacaagctcttaaaacatggctttgactcataaaaaatgtagctgggatggatggctacttacagggttaaaagcaaactgagagctcttctattcccaaatctgaatgctgaagtgctgcctagaacagcaaacatgtacatgcaaaatatcaaaaatacacaaagtgggggtgcagaggaggtgcaggatgcaccagtcacctccttccccacacccttcaacagcacagagctctggcagggtcatcaccagtaaaactggattcttacaagccattccacagagagaaaccatcccaggtcccccatggctccaggcatcagtgaggacagttttcatgttccaaaactaattggacagtaaggagtgtctgtaagaataaaagcgggtgggaatggaggatggaaataaaagggaaaaaaagtgtccttgttgaaagttttaaattacaggctcagtaaaaaactggcattccaccacatccggtctagttaccaaatggaaaaatagggtcattaacatgtttatttgaattacattagtccttctctttcatatttaatttattctgttagaaaaaaacacaacgctctgcatgctggtgaaaggcaggggtgtaatggatcagggagctgaaatacaatgatctttacccattatctaccctgctaaggcttttcagaacttactaggatcattcagggattcttccctcacaagggagggaagggtacagaaagatgtaaggtacagatgctactgagtttgttaaaataatattgaagcacatttaaattaaggagtggaaggacgattttaatatggaaagtttacaaaaagaagaaaagtttgggataaatgacctcttctgagactgaatgtccagatgcaaggttggtgctaggcttacggaacatctccacatgatatggaagttgtagaacattgtgttattagtattcggggtattaaaaggcgaagtctgcaggatgatctcatgaggcttgctgtcatccacaagaggtcagggcaacttcagtacaagcaagtataatgcagtacattcaggggaaaatgaaacaaggtatattttcaggaagatgtccagaaatgacctggctatctttgtggcggtgacatggaaaggacatagacttagtatcataaggccagtccctgctctacaacttactaacaccatttgcacaagtaattcaatcagttttcctcatccataaaatgggaacatgaacagttaccatagagttgtgaggatcaactgagacaatctatgtgaaagtgttctataaagcactgtacaaatgtaagacatttattttctgaagacagtggtgccaagtgtgagccaagcagtgtgccaaatatcctcagaaataggattggaaacaaagcagggaatgctctgacaaagctgaagaggacaaggatctcccatctcagtgtgactgggtgtatcgctcactcaaacctgaagggatttctcaccgggatgctgaccttgggttcatagactaactccacagtaggttgccacccactcataatgagtcatttaaagttcaaatcttacttcatgctagcgatgctagcacagaggcaagcagttttaggctttttttggtcacagatttctgctgccattgtcaaaacagtagccccaacctctaactgcaacctagggcagccagcccaacctagacttgattctggtcacttttagtggaacaaattggctcagaaaacatcgccttctacttcttctttaggatatccaaaatgagcaaaaacttcagtctctagcttttccttaagacaagtttctccctttgctacaaacggaatcacatctttttgttatgattcttcctctatggtccagtttgttgaacattttgccagctgtttctaagctgaactttggcttaaatacaattgcagtcacactaagatcattctgttttgagcccagagcatagagtgtaattttgatagaggaaggggagagttaaattacgatcagctctagtaaaaggtaacggcaactcatgggtgggatactttctggatgaagtacttcaaaaaataaataaataaaaagaataggagaacgttcagtattaattaaaataatcatgacataagatgaagatttctatttataatgataaaatccaggcaaggatatggtaaatgtctataaagaaacaaaaggtctgggaaactgactatggatttctttttcaaattctagtatacgtgaactggaagtcatcttactacttttcaaaagaaacaatttatgacaaactaaagaactactttacacagtaggcaatcaacttataaaattcattaaaggtcgatgacataaatagtatcacaaaggtttagctaaattcatggataagtccatagtgggttattcagagaaactaggctatctggaggaaaataactctaattctttaagttagcaacaaggacaattgtgtcttatataacagtttcctgtccctgtgatcagaaaatgaatgctgaactgaaaggaccataagcctgaaccagaggggcttttcttataatcacatgcttgtaagaaagtagggactaactatagtgctgatattaagcctgctggggccagaaggtgcacaaattcttgaacctgcagtcacatatgtcacattacctaagctgtattatgccactccttctctgcagcaactattatcatctccatattacagatgagagaagtaaggatcagggaagttcagagacgaaaagtaaattaacaaaggtcacacagctggtaaatggcagatttgggatttgaatttaggattatctacttctgaagctctgctaccacactgctgctgttttctgcccagtagcctgatgtattaacagcttaagatgactaatttaacctgttaaagcgatatgaagtcttgctcttcatttgccttgatatctaaactgtgtgtgcagtagcttcttgtcatcaaatcatgtgctcatctatggctttacattaaagatgtctccagctctcattaagagggaacaaaagaagcaaacagatcacgaggaggtaaaaggcatgctgctatggattattatagagtacctcagactataatgtatattaacagaaactcttctctatcaactaatctaaagactcattcttagttttcctaatctaaactcaggtactacaatagaagtaatatccaagaagtgaatgaatatgatgaattccaacaacctccttgctttggtgactctaatgttgaatgggatatcaaaatggaagatgagaaacacaagaaatagctgggttgggggagaagcacgatgaggagaagaaacattagagaagaatccggagtttactttcccagactctaatttaatctgaatgagctttgtttctccacattttgaagaaaatttaagtttagtaataggagattgtgtaatgcaagagtgttgctagcctaaaggctgtgataacatatcttaggagctctgtgtccctcataacaaaagtaacaaacctttcaaaattatttgtggccttgaaatataatacaaaatacctgtatcttaatttctatccttgtaaaatgggaaaagttatttttatatgaaacaacgaatacataaaatactatatatttatataaaatatataaaatataattataaaatatataaaatataaaatgctatatgatagtatataaaatactatatattttatataaaattattatatatgtttacatgtgaataggagctatttgtgagttttattaaaagtctaggtaaaagtaaagtcatctatactcctttctctggggttctcttccctttccttttgtatatttttgctcccctttctctgccgcccccccgcacccacccaggattttaaccacagatgtaatgggtttctgtaacactggcaactcatagctttcacaaatgttcccttggctagggaccacccaaatagtgaccaaatagtgactctcactggctaatgaaaaatcaatgtggtttgatatcattaggacaaggtcaaaataatcctctaagcagaatttccttacattccctcaacaccaatgtgacaatctcgctgcaaacaaggcatagggatgtggcactgctgaacctggtaaagctatgtcattgttaactgaactaaaggaactatcagtgccaaagaagaaagagagtaagagaaaaatgtcagaaatgactgtctagattcagagaaaaacttgatgaaggggcatatagggatggaagacatcttcgactgatgaccagcagctttgaactctgcttctggctcttgatacaaatttgatgtgttgggtggtacaaaatcactacactgtctaggcctaaatgccttcacctgtaaagtgtgggactcctttcaaatctaaagttctgattttgtgtcttgtttggctggcttactcggttagaacataggtttaataaggttaacattagagattcagttttcatataaatcagatggcctgatataatactttgcacatagtacttaataaatatttgctcaatgaataaatgtcttggaatagagaaaaactctatttcatagtcaaggattctaatttagggttaaatggagtggggccaagagagagcacggggcttgatactaatgcatctgaactcctgggcgaaataacttaaaacgtgggtctcactgacattgagtcagtggtatcaccatatagtagttgtgctacaagaacaatcttactattcagactctttgaatcacctgaaagtgttcttgccagtagcctcttcccaaaagagataaccaatcctgagagaattccctgattttaagattgcataaatagctcatcaaatccctacaacattcagttgggatatgaaaattacagatatttttttcctcttcacttttcacatggaaaaacagaagtctgcttccattgcagtcaccccatctcctacaggggtgggaaatgacttagccagtattacagattgagccactacctctttgtaaatactatagttgagcatagaatttgcccacgtatggtacacccagggatttaggtggcaatcacatgccagaattttgctttagataatgagaatcaagtcataaaagaacttgtgaaaataaaaattgagacacttaataatatcaaccacctgatcattgtggtcagacatatgataatttcaattccttagcaatacttaaaaaaaaaaaaaaaaacaactaactaaatagagggattagaacctggaagataaagaatcaaacattagaacaagtaaccttggatcataaatattctctgacattttcaatttgcttgcaacatacagggttttgttttgttttggttttgcttccatgagtgtattgtatcccccactttctccccttctagaagctggctaagtatagacgcagacggtgaaactcaatcgcagagtgctgacagagcttctcttagggtctacagaacagatctactgagtctcacatctcttggtcagcagcgacaggtaaacactagctttattttagcagctcagctgcagctccatgggcagctgtccttactgcacataatcagtccctcttttcagggggttataactcaactatcaaaataccaaaatatgctccggtttgaaacttggtgtatagagtcccaagcccaggaatgaatgtggtttacttccaaatttaagaaaatattgagttttgtaggtcatttatttactattttcaaatatgtttgaagaatcttttaaatgccataggaaaatgtactaaaaaggacacaccattttaatacctttggtgattcattctgaatttcagcacaccactgaaagaaccaaatggtggtggaaaaaaagagtttgttttattttcttaccaaatacagatgttttgaccacttgggtcctcatcagtgttcaaaatattagtgtgttgtaacataataaaataaaggcgttaacttctttgttttgttcttttcagtgatgtgcagaatggattaacgagttcttgtttctggccctcgtataactcaaaaactcgtttcaacttaaataaattaagtaagtaattagttcataatatggcctaatcacctctggtattttgaaacaaacaaaaacacaaaaatggctgttgcacatttgcacttaattacttccacagaaaacactcatgtggactttattacaggtgacataaatttcaaatctaagctttgtttgtgatagaaacctgggttatggtattgtgtagacttccacgaagattctgtaaccgtccctactattttccttaagaaaatgaaaccacagtctatgaaaccacattcttgcgctcttaattggcaaaagaaagtgctttatttcaaaaactctggagaatagtttacttcctacagaggctcaaaggacgttaatataaaaggtagtatcatttctggaatttctgcagtgttcaatttttgctcttggagtctgaacagttcttgtttgcatacacgtctatctgggaattgctcttagtgatcaggacagccttatggaaatccttccagatgaatatactcaatagagcaaaaaatcttgctctgtctttaatgtaaaggaaaaaaggacttttaaacaagtgtgtaattgtgagttctagccttaaaggaactttcttggcttggatttcttctaccctccccttcagatacttaataatcaaagtatatgccaagaaactaatgatgcaaaccagagtattgcacatgaacttggatcgctttcccattgtgtagtgtgtgtagtgaccaagattggacccaaaaagtcgatgatagaaaatagacaatgcaacataatcaaggtacgcccaccttgggtaaattcactaacccatttcctatccttcataaatgcatataatgattctcagtatagattctgaaacttctaggctaatctggccatcagctgtgaaaggaagaaggatcaaccttgattagtaaacttccaggtcatttgcttggcatgaacccactgatgtgttagctgcatacctcacaattctttaggtgttatctgatgttaccaagcattcctgatgccctttgaatttcaatacagaaatctaagtacaactaaacatttccccaagctgtgacagccttatggctattactcattttagaactgagaccaacttttcttctgacatttgacctgggagagtttcttctttagctttctgagtcatgcaaatttattcaaattctgtattgcaacccttgtcagttgtggccatacattcacttagtgatatcttacacacaataggctctcaataaacatttgctttccagaatgaaactagccttatcataagaaaaaatggaatagatttcaatagagttataaatgaactagaagaaagactaatagatcttgagtatattaaaaaaaaaaaaatcaagcagtgagaacagttgggttttgatacagtttcccaagggaagtagtagaagtttcattactcagggcattttaaagtagaatagacaaaacactagtggggtatgttgaaataaaatatgcgtagtccgtctgtgaattagtgtttactttcaatataattataagtgaagcaacactgtaatgggaatttttcatacacaggaaagctatggctactatgtttccacatcgaccatatgttgcacatattggttgctgtggatgtgtatccctactgccctctagtggatgaaatgtaagacctacctgattaaccagatctaacaagctactggtttgggggtatatcaatctttaatcatttagggtagaaagaaaatagctgtgttgatgcattttccatcaaattataaaattgaagggcattaaaaacaacagaatcaaactctgtaattaagactgccatttaatgtttgttcgcacacggtattcatttctgtgtatccctgccaaagatccattgtgtaatgttgtcctcacatgacattaaaaacaccagttccctggaaaatacaaaaaagaaaccgtgctgccttgaaatacacggagttcactttcagaaacataaaattaatacagacacagtaacataatttggaacacaaataatggctacaagaaacttgaaaaccaggactgctccttaactctgagcaagcgtattagcagtctatgggtgtgctggctggtagtcagaagagggcaagcaaaatgggtttcagaacagggaagctgatttgagaaaggactgactaaacacatagtaatagggcaggaaaataactctaaacacacatttggtactgtgggtatatatttaatgctgtcacattgaggctgcttttcaagtgtagcacccagatgctgtactcccaatgaagaaagatagggacctgtacagttctttggcattttgtcattaagacacaggacaaatctgaaggccatcctctttgtataattttaattattttacaggatttagactttaatcactaagttttagtctcacacttagcatataaaataattctcctaaaacaccaagaggaaacaattatacaatctacgttgccaaaacaactgacataccaaagagaataaatgaaatccgaaagaagagaaacataccgtgtgcatgctgagtgcaccagggcaatggcccttattatgaatgtgggaaataaattggctaaatctttaaatatcataaattgttcgaagctggtgatatgtgagtagatgtacacttgaggggaggggaactgggtgggcatggcccagatcgctctctgagttagtgacagtttttacagtacataatttggtaaaaaagtattggtttagtaatgaaaggtaggtcccaatggacttctccttgtaaacttaaaaagagcaacagacttatctagatagagctacaaagcaacatgaaaactctcattacctgagtgatctagaagaaaatctaacttgataaatatcctggaagcattgttttcatctcaactagatttactgtatagcaattagcatctctatagatagatatggggaagcccaggagagctgggggtaagcagtatgggccaaaaggaggaaatacagccaatttcctacttagcaccacggacagagctgtcagcagaaagaaacatccttggagttatccttggtgttaaagaaacacaaagaaatcagtgttgcattttaaagatgcttcttatccccattgcgactggcagtctgggttggaattatgttccagtgcttccctgtagggcacccattggagctgaacgaataaaaaggtgtcttgcccgcctgtgcacatacaggaaggaaaggttgatacaggagaatgatgtctccttgacttttgtctgactcttctctggtttttgaaaaatcatagcactctgaagaatactatccagtctttcccatgtcaagacaagtccctgtgcatttcagccttagggtctctagggcacagggattgctctggggcacaactagggaaagggaataagtaaagacaactctaaaaggaagtaaaatgccttctattccatctcatgttatagaagattacaaataagaccctcttcttcctctcagttctggcctttatgaggtggaagtcactattagactctataactgaataacagattctggaaaattagaactatctctcttgcacttgagaagtcagtgggtctccttttctgtcctgctgaagccagatacagacaaatctagagaaccagttttatgaaagaaagtagcctagcacaaattatttggcattaaaccataccatcatttgctaaagacttggagtcaaagcttttctcatttgattgttaataagaagcttatatttctaaaatatcttgattaccagggaacttgtgggttttggctttaatcaattcttagggcttttcctatcttttgtttcttagacctttatgtccacaggatagtctagagagttgaaatttactttttgccagctcactatgcatgttcaccaaatggtaaagttctcactttaaagcccagcaagacaagatgagctctgtctgcccagcagcctttcagaggcattaagggtaagagagaaggtaagtaattcactatgcgtccccatttctataatggggaaggacgtcttgatacatttacaatactcctctggggatatttcatcagttatacctaaactctaatggacaataattgatttgaactttccacttagcacagagctgtaaacagcttcactgcagacggcagcaatgagccgacgttttgtaaagtggagagagattcagaaaacttttgtactgggtcatgccgtagcctaacagcttttgaatccagggaagaaacagtttgtcctcctggttttaatagctgggctaatcgagtttcaagcctgcagtaggtataggttatcttttgaaggcattccattttaacccctcactattatgatgggtttataacctagccataaaaatgtactcctgatttagacatacatcaggacacattcaaaaacataactttctgaatgttaatttcctggtgaaggaaaaaataagacattaaagtcattttaagactacagattttttttttttttaactctgcgtgggtggtgagcctttcagggaaaatattccctctcctccagtgtccctcatctggttgacaccaccctgtctctccctctcactcaacatcactttgtttcgggctgtatcttagtgcaatctcccatggaatggccccaaagactaatctgctacaaggcatgaaacaagcacaagtatagctctgttccatgactttcttttatagcctccctccagccccgttgaacacacaagtagatgaagtttagaagaattctttcactatttaaatcagctcttctgtctcactacggcatgatagagggtaaaatgaagagaaatgaaagactaactacattttacttagaccactacatcgtctgctcagtctatagctttcctattttgttccacactcctggaattctcacaatgggattcaaagctcacctagaagccactcttagacaacaaaggacacagtcccctttggagttgttgctgccacttctcttgtgtcaaagatctacaaaccttgtggctgtgaagtaggactttatgaacacacagcaagaaagtatattttgtgaatatactgcaaccggacgttacccgccttacatgaatttgacatggaatatgaattttccctcaattcagctgataagattgtaagagcaaaggcataccactgtcagaaaatagatttaccctgcacccccaattgtaattccctttctagaaatctacagaaaaaataggatataatcagacattttgtaagatgttgtccagattctgaaatgcattaaaatcaaactgaacataacttgttccacttggtcctgaaaattacattctgtagcttctagacatcaaacttagttctggttttgatgtaaccgctgattatttaggtaacactaagcaaggtactgaaccttacagagcctcaatttttccatttctcatttggggagaatgacacctgtgtgttcttatttattgatggatgagatgaaattatatcataagctactgaaaaaaatggtgttatatatattttgggtcagtcacctttacctttacagcagcatgaccaatgattggcaaagtagtcaaagtctacttcacccctcctgggtagaaggcaacatggaaagggtattttccatcatttggcagtaagggcctagctctacccatgttcttccccaggcaagcccttttctcccataatcaaagggcaacattttaatatttaatctttaaatcaaatatggcattctcaaatttgatttaaccaatgtctaaacttcactgagctttcagttgagccactaactccctctttcactgtcaagcttccatggaacactctttaaccacaaaattttgtacaatggtacctagtgagctcaaatgactttctcactgatcaacaattattagtctgtaaggagtttatactacagaacatcactctggtgtgtcaggctcagctctcatagacttaactaagcataaaatgtgctttacaaataaaatgcttataaaagttaacaaagaagttaacaaaagttaacaaagaagtggatgacttacattcaccctgtgttttataccttggaattcaaagttccatacttaatggaaatggggaaagcttagcaagggttcagagcaaaggccaaagaaccttccttccttgtttgcccaaaatattaaagagataatttgataatggtcattagtaagatgatgtgttaatagatgttccttacctataactcagattaaacatttaaaaagggggtttatgaagtatgagggattgagttgagttataaaattattacatacttcaggagatgttaaatcctcatatgaaatactctgatgttccagtgtaagttttatgaaatacatttgatccctatttatctgtgacaatttagttaacatgctactagagggcaggacaggtgaaccagaagagttctaggctttggcatctcataaaagttaaaaatgatctgtagagcttatcttgaaatactctttcataaaatgtatgtgtatgattcaatgactgagccatcccacatgctaagttgactacggtcatagggaaccaacctcatgtgaactgtttgatcccattattgaccagtctttatcaatgcttggcagaggtcaaggaagtaaatctaacacctataaaacaaataagcgatttccttgtttgcttttgaaaatgccacttactgattttatttttctttacagttgttagcagctgtacacggtcatattataattgtcacataacaaccttaattcagggacacatcttttgaaacaatgtattattcagcaactttgggtaaacatgcaatttaggagtggaaaagatgcacacagacacaagtaatcatagatacaaagcatggtgaatttctgtgccatgcacttcacaccccaactcatctcgcagggaaactagagaaggggcagaaccatttctattatgataattcacaaagggaggccatatagatatgcatgcaaagtctctccccacctctccatttacatgccaggatttcaactctgcgacactgagtcccttcatttagccaattagtccttccagcttcatgtaatgcacgccaaaaagaaggagaaatagaagtgctgacgttcactgctttgaaagttgctattctaatgccaaagctgcctcttgagcaatttccagaatgtattaacatgggagcaaagcgctattcctaaagacagggatcacattatgcaggggagccccgtttaacgtgtcacaattgcacagaacctccatcccctgcacgatcttacagttgtagtttgcatgggctcaagtttacggtctttacttaggtgaaacttaggaggtcttcctaaagaaaagaagcaatttaaaaatatctagtaagcaaggcatggcacatcttttgtaccatggcattgaccaagtccttttactgtcattctgaagaaagctggtcaaggtgtaaagcaaaccggcctctcagtttaggacagagtgaaggattcttcagtttctttctttctttctttttttaaatcaattaagtctaggttcaattttaattattttaatttggcagacatccctagaattttccctccatattaaggaccaagttgaaaaccattacataattgtgtagctgtgtatctgaatgccctcttatgcacgtgattctgatacttagtaggcaacaaggtgtcgctctgaaatttgaaaaaccattaattcttcagctgaccaccctgtttacagctgaagcagtgatagagattttaatatcgccttctcccttactcttggcaatggatttacaaaagccagtttgtgtcagcctggccctctacaaatttagctgttctttgcttaaatcatgacatttgcaagagatgactggacaagtcccccactgaggcagcatagcagaggtgaaggggcacttgaagtcctatttcttctacacgttgtctctgcttacttcgaccacatctgtcttctaggtctccttttcccaatacacaaaatttgaatactgactgagacgatcctgcagggttccttctagcccttttttgcttttttaccctaaaacgctcaaaatgatttctttctatgtctttggcttctataatttataatcttggctcaatcttctcccttcatttatttcctcaatattaccttttgtaactcttaaatatgctgtccctcaaagaactatcttaaggccatagttttttcttcttatactcatgcatctgaagggctgatgcactcatccatcttttctcataatctacctcttttagttagggttaactaagttagttaacttagataacactttctcttcagaatatctctacttagatggctgctagcccctcaaaacccaaataataaaaagcattctctctttccttttaaatcattctgctatacaaattctgtgtaaccacagtctaatatatccaatgcctcaatcttctgctaaacgttcacattttaatatattgcttctcatatagagccacttatcaaatttagaaattttcttatgatgatgttaactcaaatatacctttttaaactaatattcttggccagctcctaatcacattgtacctaggatatgaaaattgcctcctcagccgggtgcggtggctcacgcctgtaatcccagcactttgggaggccgaggtgggcggatcatgaggtcaggagattgagaccatcctggctaacacggtgaaaccccatctctattaaaaatacaaaaacaaaattagctgggcgtggtggcgggcgcctgtagtcccagctacttgggaggctgaggcaggagaatggcgtgaacctggaggcggagcttgtagtgagccgagatcgcgccactgcactcctgcctgggtgacagagcaagactccatctcaaaaaaaaaaaaaaaaaaaaaaaaaaaaaaaaaattgcctcctcactccaaacatattctcaatggtttgactgtcacagttccctctttagtcctccagtggctttctaccctacttcagatcaattgtgaattatagactcccagcactgaaagccccctccctgtaggtctgcttgtctaacctgtcagcatccggtgccactaaggcccaccttaatccacacagcaagtcgcttttgtcttctggcttccttccgctgagaatacaccctctccatctctgaactttttccacataagcctgcatctacggaataatccctcatgcactgaagaacatctttccttcattcagatgataacttaaacctcacttatgccagagagatttccaagatgattaccagccaactgttaaccctctaaaacaaggtaagaaccactccacccacctttccacacatttcagaaaaaaattatatttttaattgtgtattgtagttgtttataaattattttgatggcagcaaaatatggtatttaatacagtttatttattgccttgcaacttttaagtcttgatttcaaattggtataaaaaacaaaaatgaaaaaagtcccattttgttactttaatatatataaagccatttaagtctcatgctttttgagatctgtcaaccgctatgcacatgataggtatcactaaacacacacttgttgaattgaattgaggaggaaccatcttaaacagtttactcacagaggaggaaggaatcagaagactatgaacataaatattccatagcagcatctgagtgtaacaagaaataataccaaaatgagagtttcccaaatttctctcaccctcttgattgtttaatattatattcataaaactatatttttaaaaacagctttgattttaaaacgttaaatttacacaccaagaagtagacactagcaaagtctcatagtctgatttatttctctgtaatatatctgtcttgagaacatcagcaggaatacaccaaagaaatatgtccctcacgggatcaactatataaaaagacagaacacatcatcagcacaaaaatcattatccatctaatttctcccattctagatggctccagtgagcccctcgatcattactgactagggttaagatagagcttaatggattaattaagccaaagcaggactgcaatgcagaccgaagaggagaaggtcctgacacagatgagacaacaactctgttcctcttttattcaaatgtgcaagacttgcccacccccaagtactacacatttatactgtaaatagtctccaaaaataagatttggtgtctgctgtctgggtcttcccctcagcactcaccaacatctaatacttgggtgttaatcaaaatgtatcgtgtaataagaaattaaatgttaagactttctttttcttcagaaacgtggagaatgattgttaacagaggtaaagcagtagaggcagagcactcgttttggcaatcaaggagcaccaactaagggagaggttattgtttgaatgtcaatgtgactctgagagagggccagggacacagaatattcacaaagagctgaaaggaagaagtgcccacagccataaagtcacggggactggggggcatgcccaaaggcatctgtcgtaatagaaaccttgagatttgttcatttaaaggggattttgaaattcaaatgtaaaaagagaacaagataatccaaagggcacaatttggggcctttttcttcttgtaaaaagaagagaaaatagagagaatcccccataccccccaacaaagtactgtaccatagtggcagtttactctcacttttacgaaccaaatcaacatattaatgacttaaaaaccacgttcacaatggggacaatcagactctatcagacacaacattaaatacgcaggtattaaaagaaaaaaatgcaaactaccaagaaatacctcactccggaaatggtaaggctgacgaaagcagactatgtcattaataccaagcacaccagaaaggcatctatggagctagactgggagggacaggcctcatttgcaccaaagaggaagtgccctgaaggggcccagaagtggggaactgggtagattttagtctttttctttttttggtaggtggggggaatgacagaaacctggcaggctcctgtggaggtctggctgcccccaccatgttgagtcccagtgtctaagtaagtaaagaaatgaaaagacacctatctcaatggttgtcctgaaacagttttaaaagcaagtacaagtccccagcccctagtagaatacaaataatttcatttgtgattcttgcatcaaggaaaaaacttgtgctaagttcaaacaataggatacctctcaaaaagatatgacttctcactagagagaaagaatcaaattctggagtgggaagtgttttttaccttagtgatcttttagtcattttgtaaatgaggaaactgaggacttgccaatggtcacagaagttaattctgtagttggcaattctagcagtaatgaatttacagatagatttggggctatgaggaatccagtggaattgggtccttcaaggccttttatttaaacaattatacatatatatacaaaaaaagatacagggggagagatctatagatatagataagtctgtataaaatatattgctgggtagtaaaaagaggaccggtgttgtagcattttcactaccatggtcaagaagccacggactagattcatttgttcagtgaacaaacagttactgaactctgtgtgcaagtattataaaagtaaaaaagtacgattagacatagtttgtgctgtttcaaaaagagttaacagtatagttgttttatatctacaatacaacctcttaaataatcaagtagtcaaactaattcctattggattaatacaaatcataatcattaattttgaatcttgagagaaggcataaactctgcattatattttagttagacactggaaataatctggaatgtttctggtaccccacatctaaagattggatttcagctattcggtgcatttggatgtttttttccctttagaatccatcctaaattcaatgccctaactcggtagctcagaaacagagctctctaggcattgctgctctccttctgcccagtctctgagagggtattgaggttgaggatggggatgaaactaagaataaggcagagaacgttgctaagtcatgcttctttcagatctaacacatttgtagtcagacctctggccctccgtatccatgggttctatatccgcaaatggaaaatatttggaaaaaaaaaacctccaataaaaaataatgataccacaatgaaaaataacacaaacaaagaaacagtgcagtataacagctatttacatagaccttacattgcattaggtattataagtaatttagagatgatttaaagtacacggaaggatgtgcatgggttatatgcaaatactatcccattttatattagggacttgagcatttgttgatttcggtatctgtgtggtgggctggggtgggatggggtgtcctggaaccagtgccctgctgattggatatcaagggatgactgtacttaatctccaagtcatttcccttacagttatattttagtatatggcaaagcacaatgatttcctttgagatgaacaaaaattgagtagctaaaacctaatgaatacaattagtttaagtaatctggttatggagaaaaatcactagtagtaaagaagtgatcatattacccaagcatttctcttaaaaagaagaaaggagaaagataacatgtgagtgcctactacatttcagtactatgctaggttctttacacaaattagctcatttaattctcataaacatctcccagagcagagattgtttccatttcttctggtaaagaaactgaggcacagcaagattgtgttttgagcagacatacaaagctagaaagtaatttatggcactcatatttggatccaagtttgtccatctacaaagcctataagcctgctaagggagaaacccaaaaatgaaacaacaatgaatgccactggcagtctttttattggatatctactatatgatgctaagttatgtgcccaattaattcgaatataaacacacattttctgccaccttgatgtttaaatatatgagcatgagcaaactaacatttggatccaccatagaatattgatgtagaaaattcaaatcactcatgtatttttttaattttagaagacaatttacctgatgttgcaaagttatcatgcaaaaattaatgctaaaaacataaaaaataccctataaactctttcagtgccagggaacatcatgcactgctcctacaaaaacctggcacagtgaattccctgttaactgccagtagatagggttttatccttaaaaatatttaaaggtgagcacatagtctgcttcatttttactccagggttggcattctcactgcctctacttaccttgttttctgtaaagtgtggaaaggaaaacaagtgaatttttctctcatatatgaaggcctagatgtggggaaaggttgtttaaatgaaaacatggagtttctcctcgtgctaagctggggcatttggagagtcccctcctccctgtgcccctccatccacacaaacatacaccccagttcacgttctagtttcacgcgggataggaaaagaaaacgaaaaacagaaaaagcaggaaaaagtacagaagaagaaggaggaaggataggaagagggtctaaggaagtagtgtagtcttccagagtgctccagaaagtgaaacgatgaaaagggtgagcctcaagagcaaggcacctcccagctctccatggatgaagagtctctatcagctccagaactaaaaccctcagtaggcaggatggtgctaaaagaagaaaaactctggaagggggtcagagacggatattgcagagctttctagccccttctacattacgtataaaaacgattattcaagaaataatgtaattttccagagcatgttcaaatgcaagaaaaaggtgcattctaagattaaatgtactacgacagctaatgattcattatgttaaagttatttattatttacaattattttctatttatgacattgtagtctttcattgacacttgataatcaagagttgacaaaataccatttgaactgctttgctaaagaacaaaaaaagagggattaaggtagacaggaagtgcgtccaccaacaataaaaaggacacatgactcataccccaatattaatgacaaaaatatctacagtgagatcctaaagttctgggtatttgtctaatttttccacaatcagaaccaaaggtaaaaacagcattgacagctactgcagtttggtctgtttaacagaccaaatgctgggatttcaaagattcatggctgggattccaaagatttgtccatgttggaaacagcattcacagtagcttttcggtcaagtggcacaaaggagtgaaaaggtagaaaaggaaacattagcaccaaaaatctctagtcatcttttaccaccttaacatgggttagctgaaggccatggagaataacggatgtgcagttgtctctttcttatacagacagcagagagaggggggaaaaccacacacttatattttgctaatgtaaaagtcccagtggaaacattagcactcaaagacattaatgtggatttgggacactccctgaaggattttgattccattagaaaaaaaaaaaaagacagtgacagatataatcctgctttgatatgtttaatgccatttaaagagaaactgtacccatttacctcaggccaggacaccaagagttcaaaaagtgaaataccatttctcagtgcaaagaaaaagcttggaaaatattatgtgaaaattaatttggcatgcttctttgaaattttagatttctgggatgagcaaatgggtacagttttcttttaactgtttttgaacaccatgtgttgagaagaaaacaacagaatggcaattgctcatccaaaatgctaacttgtggcatggcacagtcaagatggcctgccacagccaaaaagcaggtgtgtgctatgcctctcacttcagtagcatgcacgccacatgtccctgcattcggcaacctcttgcatttgcttttggaacctttctgagggggacagtaaacatgactcaacagaatgtctagctgaggagggactggctctctgagcctgctgtgagacagactttttgaggaagaaccaaaggaaaactggaataatgtatttattttggaattctttggtatcacttcctgtgacctaacaccaagacgactggttccagatcattttgtgtggatgaaatttagcatctaatcaggtcggagagtaatggtgaagcttttgtgtgactggagaggacacattaaatcagctacctcatttggactgaggtcaaggttaatgtagctggtacagatcatacgaacctaacctaaaagcttagagtaataaactcctcacccctcaggtccatggataagcttgaaacagggtgtacaaaaccatttggtgtgctgggatgccaaagcttcttcaatctgacattatgaatctgttattatgttactctaggaattaaaatagttttacgtagatataggtccttttcaactatacaacagtcctatgagggagacgaggaaacagaaaaaaaagattttccttctgccctgtaagaagcctgataaagaggccaagttaaaagtcatgaccacgtctaagctcaagtcaggaaccacttggaatgaaatcccaggatatctgtgctgtaggaatagacaaggtctgaagataaagaagtagatgaaaatcaaaattactattttagaagacaggagtgggacacctctactttattctatacttttaataaatacatcaataataatttattaaaaacctactatgtgcaaatgtcaagagtggggaagaatgaaacctataagtaataaactggaaagaaaaaacatccttaagcttttctgatgtaactgagtgatgttctctgcttctgagtagaaatttatggattcagaaaaggtaatttctttccaaacactcacatgccattgttaatttcactcattcaaatcacaacatttactactataccttttatttctgatggcacattctaggtgttgagggggatacaactgtgtgtaagtacagtctctgtatttattaagcttactgtgcagtggcaggaggaatgagacatataaacatgctctagtataagacagtatgtaatcagtgccacaggagacatacaaataagtgctttagcagttcggaagaagcaagtcctcctggctatagaaccacccctccatagacatactgaaatgactcaatgcacagaaaggaaggatctgtacaactttaagtcaacttacaattgatgtgcattaggggattggagggttagctaggctgtgaggggagggatgtgctcactgtgtccacagctcctctcacactgggtcaccccataattaatgtttatcaaaaacatgcatggataaaagtggaagtcaattgaatgatagaccaggtcaatgggtctgtgttagttctagatattttagatgattattaacaccctgctagaagttggcattataagaacatcattttcttcccacactagtgtaaaaagttcagttttttacccattccagagtgatgggaagtaaaattcagggcttcagtcttccaaatgagggaaatacttggcctgtgcaaaatgctctcggtaggggtatcaaaatgtctttcaaaacagcaaaaaatacatttcctgatagcccctaaggagtatgagttggaatccatgttctctagatgtgacgatggagttcgggagaggcaggtatgctaggatccatataagatcgtatttcccatggtagtgggaaatagaatttgaatgtcctggcttctaggtctgggttcttcctacagaaacatctttttcattttgtattcctcttggacactctagtcctttacctcatgaagagtagccttctgcaattggggtgtgtgtgtgtgtgtttgtgtgtgtgtgtgtgtgtatctttctaagagagaggatagccttactgatgtgcttttgtaaaggattcaaggttgtctggatcctcaaataatgcaattgaaaaaatacggtttctttgattcaatggtgcttacatttgagcagcgttttctttttccattctcaaacacagtatttgagactatctgccaacaataaaaaggtttagagcatcaaaagtgtaggcgaaccaaatcagaattaatctctgtgaaaaccgagattcaggcgcatggaaaaagtttaggaaaaaatccaggtgggaggcaatcccatagaaaggtgtctggcatctttcctgattcaaagtgaggtgtagtaggacacatgtggaagagagatgagcggttctagctattcatatgatccattgtctcaccaatgctcacacaacttgggactgtgttatcagggggccatttgatttatcatgtagtccatgtatcctattgtatgtatgatccggagagaggttaataaagggaagtctaagcttaactgggactaaaatgaggtggcaaacagccattcactcaaacaagactcaccagattaatctgtggagtatccagcagcatttccttttattatcatatgaaaagctgtgcattttattggaaaataattaactctttaaaaaaaaaaacttgcacaccatagcagcaaaagggaggaagataacagtgatcacttctgaacacctggtacacgtttggcactgtttttctttatgcatggatttctttacatatgttatctcatttgatcttcataccaactacgaatgattgatattttgcccattttttttgtataagaatcctaaggttcagagaagttacgtaaatatcctttggtcacacagctagtagggactaagctggaattcaaattggagcagtaggacacaaagcctgtgctcctcaccatgccttgccaggccagacttcatgtgcttttcatggcatgaaatcagtgttgggggaattctgcccagcatctctggttagcagagtgaattgcttttatcatttgccaacatgtcacagaaaaaaacaaaacaacaaaaaaattaaaactcctggctctagatttcctatcaacctgaagtttggcttggttacatattatttgaatatctgacaatcttataaaaagtctaacgagaataaaaaaattcttcatttatgctagctcctatgttagctaaaaatctcctattcctacataacaatgtgcctggggaactctctcactgccagaaactcatctgaaaatgctgaaaagtcagaatttggggcctatatactgactaatgttaccagctgtgagtcagcttgaacatcagtaatatgatatttcccgctacaatttgatttggttaaaatgtgtttgaagttcacccttttattaactggaattaccacctcctgtaactggagggcctctgagaacaggctgctggtgcaatccaccttcccacccgccaacggtgcatttcctggcaacaaatactattaaattgataactacagaaataggtcaaaatgtcttttcaatagttgctaatatttctctaatgctccatagcctccctttgattcttgtgctgacatttttttttgatgagtgcaggagcaacaactgttaaagagaaatgaccagaagaaaggaaagctggctggggtggatggaggtgctcttaggagttcccgtatcagacagaaaagctagatctccctagaggcccaagggccccaaactcagctctgctgttgagtttggtgacccagaagaaaacctgtgtcccatctgagcctcaatactctcatctgtaaaaagaggagactcgagatgactgattattcaaatttgcaaaatgcccagagttcacaggaggtagaagccctgacttatcacaaaacatttgggttttaaatttgtttatagtactcttataatgttacctgttaaggccttggctatccaagatagaaacttattttcatacaaaaaaagtaatattgtgttatattttcgtaagagagaccctttgctatcatactgggttttattcactatgtaaacctatattccctccctctctttcctccaggaacaaagtttgcttttctgagttcacatcacatgtgtgattacagcaaagacagaagtttgaggctgcagtgagccatgattgtggcactatactccagcctgggtgattgagccagacttcaacccttaaaaaacaaaaaagaaaggggtggggtgggtatagtcacattgggaacatagctgattgtgagcctgcaagaagaaaagtccccttgctaaaaaaggttttccagcacttcttctgagatgcaaacataccacggaggggtcaagccattcatgccttcatgctataaccacttcaactccaagagagttatctcagtgtaaagcagttttgaactggagctggagggagggatagggataattctggaacaggggaaggtgaaggaagcaatcagattaactaacacaaggaccctaggctctgctggcagaggagaagatgaagtgggtgacaaggactgaaaagaacccagtctctattgcagtttttgcccagggccttgtctggagctggtgaaccactaaaaaaatcccttgagagatgtcatggtttatcaaaaatgcctttggctcttctgttgctccatggttgtgctgttgctcaacaggcggtcagcaaactacagcctacttggttgaggtgagagtagcttaatctcatataatttaaactcacaaagactatctctccatcagatcccttctgttttccttcctttcctagagcagggaggaaaaaatgtgtgaaagtaagggcaaagaaggaggaggaagaggtagaagaaattaacctttcctcagcttccaagtgagttaggctttgtgttaggtaagcatctctctagatccttccaacagccctgaagatattattagtaataggaagtattttatagggttgaagcagctaactagagctcaaggtggccagtcaggctccttgttacacagcactcttttctcagctcctacaaaatatttatttatatgtatatatttctttttcttctcctcctcctttcactcatgggtgcttgaaaacaggtttaggagccagtcatgtggaatttatctttcaggaatgtcgaacaccccttgagttatccaaagcatacctgactaggagtcaggaggcctacattttctggattaaggcttggtcctaacaaactgtcagtgtggacaggcccatccatctctggggtctgctccaggccttacaattctgtaattcacactcatcaatgtggtggcaggcattagtgtgtttgtacaaaactcagcaagaagtagtctccttagatgctacatgtagactgaagcgaggaactgcctcctgctaatgccagttgtgttttgagtaagaagaataaaaggattgatctgagctgaaagcagaagggaagatgaggggaaggccacagaacacatagctagcagtggcattggtgggggtctgagagaggcagaagcccagggccagagctgagagatcagcttgtttttagcatacacggatgtgtttgatcacatgatggttgggaggtacctaggctaagataatcttaatgttaggtgctcattttaaaacatcaatttaatgactgaagcctattttaatgatccaataaaggccaaagccctcactactatgatacaactatttctccctagtattcactccttgccaaaaaaaaacaaaaaaaaccaaaaaaaaacaaaacaaaacttggctgagacagctatagagtttctgattacaaaacaagatcaccttgatcataatcatctcaaggtgcttggaggaaagaaggagagatgagttcttctgaaccacattatgtggacagaaatcttcaaagagtttaatggaggaattaacttttgaggaattgaaaaaggtatcattttcagtaagagaaaaaatgactgatactttcaattggtatgctagggaaagataaattctaggcaagaccagctctataatttgtggggctcaaggaaaaataaaaaaagtagggctccttattaaaaaattattaagaatttcaggacagcaacagaagcacatcaagccaggcatagggcccgtccaaacatgggaccttgtgcaactgcacaggttgtatacccatgaagctggccctagttttagttattgtttttaccaaggtattccagtcccagagctacccagacccaaatggaaaagcacataccacaactctcaaaactctcagttaaccctgtcttcctacggtaaggacacaactgaattctgcaacaaggatcagaaaatcctggggtctgccaacatatttgatagattgcaactgcactggcttctgcgacatttgtcacagtcactaatccgtgtttctgtcacaacctaaggatgcccaggatatcaatgtctgggaattcaaacatattttctaaaaacacaaatttatttaaaaacaacaacaaaacaagcagaagtcactaaaaagaagctgagtcccctggatgaaagtctgctcttaatctctttctggctttaccttgagtaggtcttgggtgtatgcacacaggttcagaagtgcaggtgaattaccacaataactcttttcagttagagaaaaaatagcagaaacagaagaatctggtcatagcctagcagaaactccctcatttcaccaacagtatgctttctccctttcttattatgctaagttgaagcgatgacttcactctccatggaagctaagtttctctttcctggatgcttggaatgggcctggtgaaaagctattggagggtaacatcatgtctaaaaaatgtatgtatgtatgaagaaagtagagatttaaagagctcagaccaacatcaaaagaataacagcagtccaaagtgaaatgaatgtggcctcttttccaatgaccttagggactttatatatacttagcctacttcttgagtggatagaccagtagcttggcagatgcctaggatgtctgtacaggttgaaacttaattccgtcctttctatacatctttgtcccattaaagaaaaatatctaatatagagaaccagttcactcctacagccagaattatactttgacactagaccaattgctacatccttgatttaggattttttaaaagatatctattggcaaagctaatcttttatttggcttaataggtttgtactgctgctctgcataaggccattagggtccataagtagatggaaatgtgtttgaatctctataatcatgcttagatttcaaaagtcttccatttcacagaggtgatgtaggctcagccatcattttcaagtgttttaacaaatggtaatcagcagagaaggtcttacttttttttttttaaaaagtgactgaccttcacaatggatgcacacataaaactctgattcatttattttaaaaccattctcccctgctgtaaatagatagctacgatatatacattaatatatgtgtgcacaatcagccttagcaatactgctgtgaagtagatgaggatagatggttttctatttatttgacaaatacactattacacagataggttaagcgatttgtcctgtaaggaagggtggagctgggggaaaaaaaaatcctcccacatctgctcttacatgataccactatggaattgggtatcctttattgtttttgagtgacttgatctaaataatgggtaatgtaattttcctgaaaaaaatttcactatttctctcattccctcttactttcttcttctctctgcttctcctctgagattattataaactattgataaatgtggttgctctaaatttacacttgctcttcatgggctttgatgggtttcagcttctaaagagagcataggggagaaaaaagcttatttctaaaaggttttaaaaggatagataacgctgggacagtttatttgaattaatgtcactataaagtggatactggtacgagtactgtcttggacccttctctcgcaagagctagtccaaaggctctgaagtgataccatgggaaggaagagctttttggaggcagaacctgctcatcaacactctgctattctcctgggatatcagacaaaagccagagctttctgtgcaccttcctgttgaactgctttaacttggaactattctctacattagggctgtcctctctgagtccctgaccttagatggtctttctctattttggcacatatttgcatatcagttacggtgacatatttgataaataatgggcctcactgttttttggccagtgaaaaactattttgctattattttaactctttattatctcttttgtcgattatttgtgtgactaaaaagatttcttgtctcttatcatgcttctggttactgtttctcaatgtcatctggtaaatgcttagaaaatacaattttattttgataaattctaaacaaaacataattatgaagaaaaaccaacagagacaagtatataatgaattttgaagctaaatataataaatagttctgaattttctgccactccggctcatttagaatgtaacattgctgacaaattagttattcatgctgttttttaaaaatcaggggcaaaattataagtttcaattctcctaataggagttataacccctgcagcatgaaagcacttgagtaatgtttgctatgtgaaactggcttcggtgatttctcctgaaggaaactgcactatcaaaaccttcatcaaggctgcttctgtttaagacccactgcactacgaatgtccctgtacccgtcagaaccttggctggctgtcatcccatcaagcacctcatctgcagttgccactcagacatgtaaagcgtgtgtttggggacgacgcgcggtggaatgagaagggatacagagctctgttgtaccactacatttattgtaagcaaccacttacacggcaactgctttgctcttttatattctaggcaacacaccggtgaatataattcataatgaacatattcaacattttttccatcagttcaatacattattcataaatattagagatggaaagacctggaagattacagagtccaaacctcctttttgtaactccctttcccctaactgttgatggtagctcaaaaaatccaaaccaaaaccaaaacaaaaaaaaccaccaacaaaacaaaataaaccaaacaaacaaataaaatacaaacacacaaggaaagcaacaaatttacaaattttataagtaaagtgaaaagctccaaagctcgtgtttggtgggggttgttgggggcaggatttacactgatggagctcgctgaagactaggagtatggatgactctttgctttgaagacaggccaagggagggaaatgtcagtttcccccttttagataacaattcaaggtaaagcccaagaggcaataccaagttcttggccaagtgttaactatccatctctacagcctgttgtggactcaggactcaggcactcttctcttcatttagaacttgagatattaatgctaatgataaaaagaaaatgtataaatgaatagagagtgaaaactactagagaatgctccctgggattatctgtactatcaagataggaaaactttgcagatgctactgtctctctagaggaataaatgcttgcattttaatattctcagcagctggttcctgttgaatgccatcaggatgattcagccacccaccaggaacaccagtaacagcaagtgcacacacagaaatctgcaaaactttcttctcttgatgccaacaccattactctggcaaagtcaaaatcctttattgaattatcagttctactaaatgtgaccttgttcccctcacaaataccagcttattctcaaataaatggaacttctggctgattaaaatgtaacattccttctgacttgagcacaccctgctgtcagtctctcttctgccatgttcatgtgatctacctctttttcgttttcttgctatccactgaaaccttgaaggactggcaagatccatacatactcagagtccactttgtatgttgctctgcttgctaaacccatacatttaatgttatatctctacccttacatgtctcaagttatttcatcatttccattttttagacattttctatttccacagaatgtgtttgtatgtctggaaaaacagaaatgtgtagctgaactgcatttaccattgacctcattaatacagaattaccatgccatattcaagctagataaaaatgctatacttgccctcttcttcaaatttagaccagattacacactaaagggaagaaaatgccaaagatgacagctagctatcaaaaagatctcactgtctcattttcaggtctccaaagtaaaatctaaggacattcaacacagattcaggtgctctcaacagccatgaaaatatatggctgaagagggaatctataaatgtaatgaatacacaattggcttataacagatgcaaccaaaattaaattcgatatcttgacctgctctccaaagtgaaagtttctagtttaggctacagacagaggtgtaacaagctcattaatcacatgaaccagaaatataagctgacacttctggggatgctgcaaagagcagtcttaagctgttgggggtctgtggggaacctgaaaaatcatgtggctctgacagtccacagcaagcaacaccactgcattttacaatgtatgtgggtcaggcactggccataaccaccactattttaaacttccaggacaggatttaaggatctttgtagggaaataataggtccaatatggacttttataaaaagattcaatatatttttattaggttcctgttacacaaaaatcattgtgttcattgcatgagaagacaatgaattaggtcaatctatgacctcgagaagtatataaatgggaaagaatcagaggcaggggaatattaataagtaatagtagcaataacaataacaacaatgatgagtgataaccttgagctagtcattctgctaagcactttatatactacatttcatggaattcttatagtatcctaggaaggcagatatcgtttttctctttacagacgtggaacgtgaggcccagtaaaattaagtacattgcctaaaattatgtagacctgttctttacattacaaataaatacataaatagcttgcatataaaatgaaatatggcaaggctcattaaaagatacaaagtgttgtagaaataaaggaggcagaatgtgtttctatttgggaatactaggagaaaaggaacatggatgggaaaatgtggtgtgtgcttaggaaacaaggattgttccagtttgtaatgttataaacctgttgaatcatcaatgtctcattagaactcatactttgataagatagtaaaatataccaatctgtacaggaatatttctacaaagaaatacttctttccaaaagatcttctgactacaatttctcaaaacttttcttgttatttattttttggtggcgatagagggagaaaaaatgtgagatacaaggctatggaggtctgggcagcagtgttaactccagagtctctagggagtacaatgcatttgggtgcattttccttcattcctcagaatgccttatcctcatcacacatatttgtccctgccacatccgaggtgaggttactggcatagaaatagaaaccctgagggtctggtttcttccacttcttcaaagtgggatatcacttactttttatttttataaattagttttagtggtcagccttttggcataggagtacatcaagaaaacgtgagttagaaaacttgagttctggtcccagttttgccttgctcatcttgaaagcattttatctcttctctgtgtttaagttttcttattggcaaaatgagtagtttaagcctgaatatcatttcttaatctgttggacaaccccctcatcaaattttttttgataaaaataaaaccttgttttaatgtagatccttctattcttctctatttaaaattcctggttcacagaatgcaatatatagtaccattagtccagataattttgtagagctttactttctctattttgttaagtttttctcgtaaattttgttttccaaatataaaacattgtaatatatatgtattttcaaattctacatggtcctcgaccagatattccaatattccattctgaagagttggttaacccactcacccatattgagatatctaaagccccttcaagctccaagatacagtgattatgatgctctgatgctgacatttgctttgtcaacgcttaaagcagagcttttaaacttcaaacaatagcataacaagttgctataacaattacacttacataaatctttaagcagatgtgcataacagctctttacatctactatcacactggacaaccaaagcttatgatgttgttataaatccttgcaatagtaaattctacagttaattataacctataggaaaaagtactgtccatatttagaattgattgactcttattttccacatctgttaattttgcacccagctatagggctttaaatagctcccataactttaatcattagcccccactcagtcatgacttctatgtctcacccttctgaccttgcccactgagttcactcttactgatgtaatcaaacatgtttcattgtagttgcattcgtcacagtgctcattagaattatcatcattcctacagcacctcagtgcaatgaaattgtgtgcctatgcaatttgttgttattttaagttcttcagctggaattttaaaaatctagatggacaattttattttatctgatcgataaatatatatccagttaagtgcctctgaaaaattggtaagaaaattatttattagagcaaaatcttaagtctagagagatttttgtaaacttggacagcagcattcactgaccttgaatccacaggttcaaaatttattagtgtcaagttagtcttttaaagcaatccattaaagcaataagtataaaatatatatggtttacatttatgtatgtgttgaatttaataaattagtcaggagtcaaggtatttttaaagaaatattaaatctgttctatattgatcaattaactgactttctaacttaaaatattcttttgctgtagttaaaacctttttttctttttaaaacaaacagagtacataaactgtaaggtggcaatgtagttcactgcgacaatctatatattccttaacgtttgttctttttatggtcatggtatgtagaaacaaataaatgtataatagtttaagtccaggagtttttgcctgactaaattctaaacacatagcttaaataaagggttgaaagcctggcatctcatcattactgtttatatgttataaggtttgcagggccaccttataaaatatatagttgtttattttcatgttcaataaataagtagtgtggggtttcagactgagaatggattacagattgttctctcctggttatttttggctttaagtatattgatcattttatcattttcttgttttaaactactttaaacacagcacaaatgttattctcatcatgccagaaatgggtttggaattgattctgagtttccatcaattttactctttgctctttgtgagaagttttgcactgcttaaattcgaaaggatagttttgtttaaaagatgtcacagtacaacatttagagaaccttagctgcccagaaaaactcagattttctgctttacaaaagaataaaaatcatcgaatttattaccctggactttattgaaatcagtgaagaatattcatacaaatacagtttcacgaacttcctctctctctttcttcatgtaagtgtttgacaaaagcatgtatcttctgagaagccggcctgattggtccaggttggcactgtttcagtgtttggcctacggcggctgcttaggaataatttcatctcatcctctctattttcctggactgtatcaaactcagacacgtggtatgcaaaggaaatccaagtcttttaaaaatgctatttcttttggtactaaagccaagaccagttctactttggccaaatgatcttatcaagatttaacaagagatattcagtaatatctccaatctgtgagaagacattccactaaggaagataatttattacatacagtgtacatatatttctccacttggtaccaggaagagacatgatcaaacttattctattggtactgaaaacaatgtaacactgacaaaaattctgtggcaattattcatttcaattaatttaaaaagaaataaacaagtagctcttcccccattaaaacagatactggaaatctattttcagttattgctgaaaatattttggcttccacaaaggcaccttactaacacactactttgccctccactgtgctgtcacaattcagaacttgtaacattttattcaggtactctagactaattagatgaaacaactgcattacagtattaagatgcttttgtagaattaaatgaaaggagatctgcacagttcagatagcttggaagatttgcaatgaatatcaccaaaatcctgcatgtgcaatatatttttctacatttacaaattagctaatgaataagtgtattccacaataactgctaggatttaatttcacacttaagaatatcaacaaacacagagagaaatttagataggtaaactccatttcccttcccaccccaccctagtgctcccctgcactgtttgcatttcagaacaaatgcttcatgtctcttgaaaagcgccaggaaatctcttctctagctatgcaggcctcaattttatgtgtgtagtatgacacaccttaaaagagagagccccacaaactagagtgggacgttaatttaaatacagacttaaggagaagagctccatctactgaatcagttagatcatagtgtgtaccctatagttatcccattcactactttcaaccacttagaggctctggagggaacaggaaagttatagacctgagcaaccatgaaaaacagctttgagcctaatgccatttgggatatttctcggataccctgagcccctttcctttgcccctccaatttcaaagctttccatgttgcaatataaaataaaaatggatgttttgctatatgaaccatcccttggaagtagaaagtcattggttgttgaaggaaatgtctcagacagttgaagagaaagctacagaaagaaaatctctagctggcaggttgggcagcctaggtaagaagggaaaagaagagtagcctacttactcctcctgccttgcaccattgctggggaagcctgcagccacccaggatcagctcttctggcctctccccggctgcacagtattgttgtggcattgggaatttgctgtggcttcgtaagattatggggatgtgcttcagcaagccaaaaaagtcacaaacaaaattcaagaggaaaaaaaaaaagtataaaaacagctgatcttactggagaagctcttggcattttcctacatatgccacaattttctctggtatttcctggttctgtgatcagaaaaattatcgtatcatatttattactgttgtttttttcagggttgctggtggtgacgggtggtacagtgagggcaaacagatggatcaaggagaagcaaagtaaagattacttctcccacttgtttgaaagctttccaagagattgcaggttaaaaaatctcttcttcagaatactgaagatgtatagatatcacatataggaaaagatggccatactctttctagattgggaaagaaaaaaacttctaacacagtaacagattcggaacaaagcaaattgtatcagaaaaaacttaaacgttcatatagctgcataaaattcagcagcatataagacttataaaaatacttcataaattaagataaaatatttgaatataaatgggtgttaagtatatatataattggatgaaagcaatagttcagtgaattttttattacagaaaaataaaatataatgaattaacaaaagttttacagtaatgctaaccttttctcttgtaggttaaaatagaattaatgtaactgtaaagtggattcatgtttccctgtgggtgtgaatgtatatatatacctgcccaggtattactgactgacactgaaaggtgatatgttgcaaagaaattcaaactttgagcattattttaaattgggtatttaaaatatcagtattaacctggcaggtttctttctttttctttctttctttttaatacatttaattttcagggtctgttttaaagcacgaaaagaaaaacagattagaaaagcattgcacatcaataagtattttgtaaaataatccatttgcatttattagaatattcagttctcaaaaaacggctaattggattttcttcaagccttttcaagacaagttcagttctgtgtcaaggataactatgagaaatttcacctcaaaaggtaatttgtttggttagttataaaagcctgaaaaacaagattatctccaccataactataacaaaacagctaatgagtaagtacattctggtaagaatcgataagaatggcaaagcctgagagggtcatcgcagacttgagaaaggtaaccaagtgaggaaacatcaaacagagttaaagcattctgaaaaacggaaagtgttaataatcactgacaggaaagaatattcttcgatagcgatgacaacaacaaaacaaaacaaaacaaaacaactaaaacaactggaaatacatatctccagaggcaaactatgactacttattaagcaagaggagaacctgcttctttgtcattccctttggaagcctagctttaaaaaaaaaaaaaaaaaaaggttgcacaaaagatacatgtgttccttttctggtattattacaggcccacctagatttagctttcgattccagatgagatcaggcatgttcagactagcacatctttgctctgtaagcacagagctgctatcatttcactggcaaattctcgtatccccaaatttatgcacaatagataccctttaaaatctgcaaattttctatttcagtgaaataactgattgagttaattttttttcttaatttacgctgctcgtattaagctgaaaagttaaggcaggcaactcctataaaaaaggaaagttgaacagtacttaccctaagtgtaatgtgcaagccttaatggggcaatttacttttgctctatgatatttagaaaggtgtccaggtctaaactcagctctcgcctttttcccttctggaaaactgagtagactcacagaaggtgcctctgcgaaagatcatacaaatcaacagccttacctgtggccattcagaagactgcactttggtgtgtgtttaaaactatgaataaagtcagatacagcgcatgctcagcaggcaatttaaaaatatttataacattgttgtttcaaaaacaaatttcctcaaacaaagcaaaactcaaatttttttatccatgccaagtttaacgttctgagacaaagctgttttggagttttccgctgaaggaaaaaaggcttttaaaattttttgttgaacgaaaaatagttctctcttcccttttgggtacgcttaaaggggtggaataaatttttctccaagtttcaacaaaattcacctctggctatgataaggcattacaaatttaaggtctgtaaaaaataattttagagaaactaacaagaaactaaaaactatgggtttaaagaatgtaatggtcatctgaactttcaaggcagtcttgcatgtaactatacaaaaattatatcctgatacaaacaggatatattatatgtagataagaataatgtgtatacaaccatatgcatacctagagaagttttatttttcttttgctaactaaaatcagaactctctaaagccgaaaaagaaatacaacaaaaatttaggagaaacccagtaataacatcggcacaattcatctgtttttcatagcaagcgtggaaaagaaggcaatcataccaattgattaaattttgagatatataaaataaaaatttgataaaagaaggtttttaaagtatgaattgcagtagaaatgcctgtttcgttcctggttgaaaatttctttctcttccttgaatatccctaagcattccattttaccatctatcaccaaaccctgaacagctcacagatctcacagatcttatttaaatctcttacttaattcttaagtctctgaatgaatttcagctcctgctctactttccaagggtgctcagctggcctcacaaaagctccacagacacatcgttcactatctctgatgctttcaagcttaacagaggatgccaaaaaaaaaaaaaaaatcaacgattaaaaaaagtttattaaagtgaaactaggagtgcaaatttgaagaagttgcttctacttttatttctctctcaactcagcacaggtgtttcctaacttatactgctgtgcatgctgatgaaggggagggttaaattaaggtgagggagtgggccaagggcagaccaacaagcatataggatctccagcctcatgtgttaatggatgtgtttaaaaatggaccccccaaaaagcctagaatgaggtttctttttggcaaataattaaaccagtatactgaaataattaaagctttgtctttaaataaagcatcagatcaacagaacaaaaacaaagataaaaattgcacacacatatgcatgtgcgcacacacgctatgacacacacagatacgcaaaactagtgggtgaggggagaaggaaattaaataaaagaaaacaaacagagtcctaacaggccattctccgaaaaggaatctaaataaaaagtcatatgatatctgatagtgcaggacacgtcgccaagaactggagcggattgcctacaggaagaaagggccagtgtattccagctcaaagagcttttctttcctcctcctctattttttttcccttttctcctcgactgtgaatgtgtcactctcaggtcagatccacgaagaatcccagaatgacagctatcacctgtcactgtactcttggcggcacaactagctgataggagctgcctgagttgggatcaagaagagctagtgcagctttcagtaacagcctgttatcccagtccctctgcccctttcaaagatccccttggtcacatcaaaaacagaccaaaaagaaaaagaaaaaagaaaaaaaagggggggtaccaaatgaaaaattaaaaatgcagggacaacagcccacagcaacaaaagaattcagggagaaaaaatagaacacaagcaaaaaggaaaaaagcaaaaccaaaacaactcttgtcttcaatataaaactttttaaagactgagtttctcttatttggatgacattctttttaaaagtatttttctccttaagcactattaaaagcattaaaaaattctacaaaaatacagaaaagtctgaaagcaattcaagaatattcctaaagaaaacatgtaagtgtaagaagtgagttaccctggaaaattctggatttgccaaaagttcccctacttctaatatctttcagtgagttcaagtgctaacactggccacctagtacttgttttttatctgaggatcattactgaggcaacacatacatagtaaggtttcccgaaaagactccttgttatcaagttacttcaaacataaggcactcacacctcccagccaggagggttttttgatgagcatcacactctgccctgatatgtattacacccttaagaagcagttacataaatgcattctataattatggaaaatgtatatatctatattttcccctacattttccctccccagggatatgaatagattttattttcagttaatagaaaaaaaaagaaaagagtttctgattcttgaaacaactgttgtagctgttttctacttagcaaaacagttatctgtagttaggaatggtacataatatatatttaaggatttttgtagagcttgagaattgttccccttgtttagtttcgtgtctataatgtaccttaaaaagatttctaagtgacaatcaacatataaatgcattaagaggagaactttaagaaagaaaacattatcttgggtttacaaatccaggatattagcataaagatataaatgtacagcatatataaaagataaaattgtttactacattttacacatacagctcacatctgatttctttttgcttttgttggagcattaatttgaaaatgataagcattctgaaatgtttgctacaacacaaattcatggtaaaaatatacatgcataggcaaaaattgaaatggagaacacaaagctacgtggcaatcagaatcgttgacaaaatctccatctagactatattttgcatgaactagtgtatcatagaaggggcaagaaatctctctgggggttttgtcatttacataattagaaacaaaaataaaatacaaatatctgctcccttactaccttttcttaataactgacaagtgacacaagtggtaccttttaaacagatggatgcaaaaacttgtgagatcgaatgaactgatgtaccccattggtattttgggaacccaaattccataattaactttttacccaagtggcaaaagtagaagatgttctagtcaccaaattgattatttgatggacttttgttctttcttccacaagattttggcgacccagaaagggtaaagacatgataagagaagatgcatcctgaacaacttttattgtgagtagaaaaaaaatagcataaagtgagcataagaacagttggatttggaaagattaaaagaggagaaaagagcaacatatgcaacttaactagtctttttctttttaattttttcatgtacatatatgtatatattgggatgatggggagaaaagataactggatttcttttgaatgtctttgtgtctttatagagtgaatgttctgttcctgtctctttctttttaggcgaaaaactaataaaaatagaaaaacatatatcagacattaagctcactccccccccccccacccttccctttgtaaagaactctttgttctctagtgaaaatgctgaaaaatccccgggcagctactccctgaaacaagtgcaaaacacttagaggcttttgggctggctgggagccagaaaccctcccgctgtctggttagaagaggaaaaaaagaagagagagggagagggagagaggggaagagggatggggggcagagagagaggaagagagagaggaagagagaggaaaagagaagggagagagagagagagagagagagagagagagagagaaattggagcttcctttaatagacataggaagcagcgtttttttctttcttttttttcaaaactggcggtcaagcgttaagtaactcccgtctaaatccacctgctagaaatgaacttgggtaaccccccaggggtgcacaaagacagggaagacagtaacatactccatactctttcccaccccccgttgtactgcttccattctttctgctctcatacacaaatgcccacagcttctcacgccgcccctcttaccccccaacaacaaacacagcaaaatacatgctccctcggtctcctaaaaaaaaaaaaaggcttttccatctcggttgcgacacagtgataaggggtagcgaacatctcatacctggtgtgaatgctaatcagtcaggagttctccttttcccaagacagggaactgtttccttccaaatttattagaacctcctccactgcctctttgaaaaaccttctttgtcaccctctcccaagtcccgatacttctttaaaaaaaaaatggcttcggagctccttctattcttgatattgattctctctctctccccccacccctcctcctctctcctgtctgtgtctcttctgagtggtctattgataagtccctggaggcactgggtcagcctgcccgtaggaaaccagacacaatgcacaaatctccgagtgccattctgccatcagcaagcagaccacgtttaggagagagagagaggaaaaaaaaacagtagagcaagagacagagagagagagagagagagagagacaccaaccgagggagggagagagagactgagagagaggaagagagagggggaagagagagaggggggggagagagagagagagagggagagagaggagagacggagagagagagtgtgtgagaaaaagactgattggaacaggagggagagagagagaaaaggagaaggagagagagcgcgagagggagagcggcactgccagtcaggttaatcatccctactttaattagctgttcggcttagacataaaacaattgaatttgaatgatctgtcagcaggctcggctgaaccaaaggggaaaagcgaatattacaaaaagactgttggtgtgttctgataagcaatactgctcgtactgacaaatcctcaaagggggaactattaaaacttacaactaaacaaaaagtgcaaatacaaatggcactagatagaggtctttaaaaaatggagttttctcctctagttttatgaaccatagatatttatgtgcaggtgccaacatattaggggttttcgtgtaatgtgtgaaagtttattaacgatggtctaggagtgtagcagacagatgctgcagagaacaagacaggtacagtcagatgccgaatctagatcttggagggagaaggatgctggaagaagaggcaccgtggcaagagatcagcacagacaaagtcagtgggcagataggcagacagattttaggcacggcacgatctcatctaaaaaggcaaaagttctgatgcaatattaggtacaaaacaatccatccatcctcctctcccgggtgcactccaaggtacagttaaaatggattaatctttgtgacaaacagagctggcaaggcagacactgaaggcgatttgcagacccagagaatacagagctagaaaaagccccagagatcaatctctccccctcccaatttagtagagaggaaactgaggcccagagtcgacactagacactaggactccaggagcccaccaggccagtgctctttccaccacaccagctaacctagagtattctttgaagatctggcccaacaggtatgaaaatcacccttacctcccaaataagaagattactccacctatatagttagtgcacaaacctccaatttctcaaaatgtttaaatagccaaatggaaatataattacatatataaatacatttccactttatatatatgtgtgtttatgtatatatatatatatggagagagagagagagagaccattttgaatgctaggaacaagggatttaagtctttaattcattctaggagaaaagcagaaaaatataatattgtagaggcctcgtctcagcaagatataacttgtgtcacattttcaagctaatgaaggctagtggtttgatctacaaagacctcaccctgaatttacaattcgctctatgaacatcatctgctatatatcaccaagtgagaagatgtggtttttctcatacacctcgtttctaaaatataggcacattgtgggtgaaagagattgagtctttcagcatactatgtagttttaaagcactgatgagattttccacctggagaattaggtatgtacaacctttccaatatatttcaattgaaaatgagctactaaaaaggggaaactatattttccgcccatgaaagtgatggtatctttttcgggacacatatgatcatgttcactaaggattcccttttgacaatgggtaattgaaggtccagtttttaaatggtgaaagaggtgcttatgaagagaacagtgccatcagatgttactggagagattaagtttcttgccctaaaacaagactcaggatgtgtatgaaaccgaaaactatctctcagtcatgcttcagcaacaacattgctacttagggagaaagaagaaaaccgaaagaaatgtcaggcacgtgggagcccactcaaagacaagtaatctgagagaagtcatagccagagtaatttagtttatttgcacaccaacctctttaacaatggctgctatgccatgcctaaaacacacggcctacagttgactgatttggaaagggggaaggaatcagtgattttgataatggcagatcctttggcaagccccaaaatacctgataggccagagcccagaagaaagcagtggagtgcttagtaaatgtctgttggtgaactgagaaaaaagaacaagagctttggagcaaacacatatttatatataacactgcaaaagtcacagctactctgaaagcctcagttttcctttctgtaaaaggtgatgatattggtcccatagagttgtcttaaggatgacatgaggaaacatataaagtacacagctagtcattacacggtagttattatggaggaaggtgtgtaaacaaaagtgtatattatggatgtgctgagtgtgttatattcaaagcatgtaggttcaagacatgaaagcatatagcaaagcaaggatctaatatacagatctctactagaaaggattggcagtagagattataaagtttagaactaaattcctaaaatctaaacttcaaggatgttaggtcatctggggttgtattatttctttgttcccagattttactatatttcctggctcataataataatgatggccaacatattactaattggcttgccctaagcagtctgctaaggactttacattttaaaatcatactttagcatcacaagaatcctatgaatgaggtactaccaatatccgcatttcatagaaaagaaaactgaggtatagaaagattgtgtaacttgctcaagatcacacgcctagcaagtgaggagctgggaattaaatccagccaatctgattttaaagcccgcattctcagccatggtactaaactggcacacagtaggtattcagtcaatgtgtgttgaatgaataagcaaataaaaaaaacactagaatttttatttcattggagatcagtaataatctgtgcaaaaccacttgagagaatcttgttttcgaattatagaatctgtccttcttctgtagctcacttcaggtgtagtcctttgtcagaaaccagggtgagccatgtccctgcatggtgctgaaaatggatgaagggaagagtgctgaccatgaccacccagggcatttaaatatctgacggcattttcagcactttgaggacagtgttagcacaagggttattaattggcttaattccagttcggataattacatcgtgtctctttaattttcccccgactatgccattcttcacttcctgtcacaaatgtgctctttaaaaaagcatacgaatacacacaaacatatagttatatttaaggtttgcataatcatttagggtgcttttttttctaaatgatcagtgtatagtagctatgtaataaatgaatgggcaaaagaattaaagtcattgtaaaataaagataactagttgaagctttttgtttggcaatgaaacagatttttaaaacatttccttggtgacagaattccaatcacatttttttctcatgggcagatatttccagagctgatgacctgctcatgataagctgattttcttacactatgtagtttccagtataaaaaaataccaatgaaaacttcgatattttagagtagaaaatgagactaagtcctgagtggtagagcatactgaacgtacgggttttcagtgaattattaacccatttattagctctgacttacttgacaggttttttttttttatctccaaacatatcactagaataatcttcaaattatgaaagaaaaggacaacatatcctaatttaataagcttaggaaagtttgacagtcataaacagacacaactccttttcctttttccaaagaattcttggcctttgaaatactgtgcctgcattatactaaagaaacactcccagaaaaatatgcttaaaacatgtacacaaataggtaaatgcacccatggtagaccatagtttattaggcctttttagtgtacatttgtatgaataagtcatcaaatatagggagtgtggaaaataagagaataaagggttaatttatttattatgcaggaaggtttctagatctttgctccttcagcttttagttcaaaattccatgcatattctgcacataataataaatgccataattcaacgtatctcataatttgatttactttcaagcacctttttttctggttcagctcttgaagccttccttcttataaacttcctccaagttattttttgtagcgctctgtaaaatatcatttaaagttggtgttcataagataaccctcatgctatagagagatttgtatcaaactagtccatatttccttttgagaaccagtggtcaagtcccatgctcttatctgagaacaagccacaataaatatataaaacagccctttcccacctgtttgacccctgtaataatgatagcagtctctcagtgactgccctctggttagttactcattccttaagactgagctcttccaggacaaggtctttccattctaccttgtatatttaatgtattgtccagcatcacacctgccatggtggtagatgatctcccagaaaagctggaagcaacaaattttaattccctttgttcttcatgagtaaatacaaatttttctctctgtgtgtcaagttttcaacatgtaaaaggggcatactttatcctaagattagtgatttgatgttcagaaaataatattggagggtatagtatttaagaattagctagtgaaaagcacttgttttggttattttcatagtatcgccactatttttatagcaagaagtacttagaaaacatgttttaaattcaaaatttaggtgaattttgaattcaaaagaaaagtggacaagatttatcctgaatattagagatagtaagcacttggtttttaaatgccatttaggaacagcctgacagattttatacaagcagaaggtatttaggaaattctctggttctctcagtttacagagaagagctgagtggcagagatattttatctgacaagcttaaggtaaaaaaacttggtagaagtgaactagtgctggaacccagtctgtctgtccctggttccacactcttctcactcatactttgaaagatggcttttatactcttgactccagatcccctcttttttggacatattttactgacggaactcttaaattctggtgctgataaaggggtacaatattcctaatgtagtctgataaacacactacaaaggaactatagtaggctgaggaatggccccccccaaaagatatccatgtcctaatccccagaacctttgaatgttaccttacgtggcaaaggggtcttgcaaatatgattaaattaaggctattaaaatgaggagattatcctggattttctaggtggactctaactgtaatcacaaaggttcttataagagagaggcaggaggatcagagttagcagatgtgatgacagaaacaagaggttggggttatttgaagaaggggtcatgcaccaaggagtgcagggtcctccaaaagatagaaaaggcaaataaatggatcctcctttatagccgctaaaaggaaccagccctcccaacacctttactttagtacagtgaaactgatttgagacttctggtttcagaactgtaagagaatacatttgcattgttttaaaccaccaagcttgtggtaatttgttataacagccataggaaattaacacagggaccatcagctaccttgatctggacataatctttcaacacagttgaaatatttcttagctctttaaaaaattattttagcagatatattaccttactggttcaaactgagcttgtgatacaagaacccttaccagtcttcagaaaaatattgactaggataagtcaaggagggtcttttctcctgacactaagagcttccttctaagttgacataaagcaatcaatctaatgattattggttaattgatcagttggctgcagatccatctaatcacatttgcccacctcctgtcttatagtaactcttcactggtggtttggcaattgtatctccaagttaatctacaacagtagttctagttagaagcaaagagaagggtttcagtgtccatttcttgagtgccagagacctgaactcattcagaagtgagtgctctcttgctagacccccaccccacatttttttctgagctttcttaacagaggtcagaaaaaagaagcatgaggcagcttaggcaaaaaacaaacaaaacaatctcctcccccccccctctttttttttgagacagggtcttgctctgtcaccgaggctggagtgcactggtggtgtgatcacagctcactgcaacctcaaccacctgagctcaaggaatcctccagcctcagcatccagagtagctgggtgtgaccacaggtgtgtgccaccatgccaggctaatttttaaatttttgtagtgatgaggttttgctatgttgctcaggctggtctcaaactcctggcctcaaatggtcctcccacttgggcctcctaaagtgctggattacaggtgtgagccactgcgcccagcccctatccaaactttaataagactcttttgccatagtgtatcattgccattcagttaccgcttacattctataggatagtgctcctaaaagagtagtccttgggccagcagcatcagcattgcctagaaacttgttagacacgtaacttattgtgtcttattctagacctactgaatcagatgctcagaggtggatgtctgagtgtgtatattttaacaagccctttaggtaattctaaagcctagctgagaacaattgtcataggacaaatctgtgaggctcatcaaggctaatgaaaaaacacgttggactcagagtgagatcacctgctaatctaggtgtcatggtgactctgtcatttgccagctatgtgactttagattatgttcttagtctatttgtctcatctgtaagatggaaataataataattaataataataataaattgctttatgtgaaaagttaatgtagaagttaacaagatcatgcatatgaaaacactttacaacctcagggttattattgtagaagaaacatcaatttggattgcaagtatcctaggaccacattgttggtgatattgccttgatatttcatattaactagggctcccaggtagtaatactgaaaaaaagttcaagaagctccagatgtccaattctccaggccaaaataaaggctggaagtctgtagatgtttaaagggtgtgatgctgaatggaggatctgctggcattattagtctctagaaccaagtgctaaatttcttgatttgaaagtctacctttctatttatcaggtagcagaatttagtgacagctttgaattctgtatgccagtgaaagtctatggcttgtgggattcagaaccacaattttttatcaatttccaatgacactcagttttagtaaagtggcccatgatctcttgcatttccataccatattctcaaataagtaagaagctccagggagctcgctcaacaattgattatggtcacatattttttcaatagaaaatatgtatatcctggtaggtgggaaggatggtcctgatcaggactgagatctttttagaggttcaagtccaaactcttagtaggttgaagggaactcagatgcaaccagattagacacaactatgattttcatggaaaatcatcagaattttatccaatctctgagtaatgaaaatttgcagtatttctcaacagctctatatatgtggagaaaaccacctcataagaaagctaaccatgtcttttccttctttcatgaaataatagtgacgtatgcctcttggcctgaggactcgtccttcctctgaagactaatgtctgcacgtcaccttttggcaacccctctgtgccttgcaggacagttgtgtagcaaagattctgtttgggttgctgtttcctctgagccagtcacactggtgcatcaggagatgcagctgcaccttttaagagctctgtgtccttaagcaagtcatctgtccttttacatttcatagatttttcatttgtaaaatatgaataatatgtgccttaccaatcttacaaattgttctgaagatcaaaatggatgatgtatccaaaatgctttgtaaactaagaatctcattcggttggtgttactgatgttgttattatttactctttagcaggagagtaaagatatatacagacatattgggtacggtagcttgaatatttttagacatctacgttgtatatgcctccaaggtttccccctgaacttacattaatccctttttcaggttacagctaaggtggtaactaaggatgttaatttcctttaggtccctataggatctctattttgatcatgattagtttatacatgaaatagacactgctgcagaatttacaatgtttccattctggccaactcaactttgaacatattccctaagtaagaacaaattcagtactataacactgaagaaaacatagcatccgaagctggtattgagggagtgaaaatatcttcaaaggctttttcttgattgcttaatataaaaaatctgcttagaaatgtccactagttcaacaagcattcctgaaggaaatctgtaacaaagctactgtgcattaacatttaaaagaacaggaacatgtagtctacctcaaaacaaattattattgcttgaattgcccaaactttgttaaccaaaattgaatttcgcctaagttgaattcatgtgaagagctcataatgcattgttgctatttagatagttgtcatagtatgtggtactcagtaagtcctctaaaatggaagggaaattaactacatggtataatttcaacataagtcattaatataattgtgcgaagaatatctctgaatatattgaactgctatttgaatctttaattgtgcatacaattctaccttttctgctatgcatccttaactagactatatgctccctgaggacaattcctgatttacacatctccaaatttcccgctgccttcagtacagtggtttacaagtagcatttgctttcaaactatctgctgtttaattatattcactttttattggcttttcttggggggcaatttatgcacataaagtgtccatagataaatgcatcattatcactgaggtgaaagttgtgattcttaatttttttaaaaaaacatatacattgggccacttatttttcctgtgtgacactcaatctaattatagaagtgaatagaaaaacatgatctcttttaaaaggcgcactttacgtgaaacaattttaggaattcagcttatgtgtcaagtacagtcattctgcacagtgatggtgatggggaggctctatgtactatggttttgacagaaaatattttaacttaaagccagctacccataaaattacgtaaacataaatatgcactctcccacaaacacatttgcacatctttaaacttagattaatgcaaagaaaagatatattcttttgttctagtggaatacaaatgataaagactaataaatgaataaataaagctctaggtaaccaaatcaatgtctgctcaattctggtcaaggaggtgaagggaggtttccctttgagtcagagaatgtagtggataaaaaggacatgaatagctggggggatttcctgaggccattgtagaccagctcacacactgttaagaggctcattttcatgagacttttggttgcatttgtaacacttgctctaggtcccctagagcattgagtgccacatcacagcactacaataacaggactaaatgcaagaaggtacattacaaggttctttttctttcagctctgaatatccaggagtttgtagatgttctcaagactttttttccccttcgtttttccttctcccccaacccccacacactcccttcaaatagaactaagtggaaaggactgttttgtttttaggtaaaaacctaaattcttgtacttaaaaaaaaaaaagccagttgtaaaatctgtaatataattaattatttccataggtaagagatattttattttttataaaacctggtctgactggtaagtttgttctagattaaggatttagctacagtttggtgagtgtttgttctctgttaggcttggtgcatattaattcgtacatattttaacatttcactactgtattaaattattaataatttgaaatcattagcttgtactgacaccatttttctgaaacagtaccacctgtttcttctaagtttggtccagaacaaaagtctgaaatctaatttgtcaagaaaacaaatgtgtagttcagaaaaaggataggggccaggtgcggtggctcatgcctgtaatcccagcactttgggaggccgaggcgggtggatcacctgaggtcaggaattcaagaccagcctggccaatatgatgaaaccccgtttctactaaaaatacaaaaattagccaggcatggtggcacacgcctgtaatcccagctactcaggagtctgaggcaggagaatcgcttgaacccaggagccggaggttgcagtgagccgagatcgcaccattgcactccagcctgagtgacagagtgagattctgtcttaaaaaaaaaaaagaaagaaagaaaagaaagggataggaatcaccaaaagaaggaggtccaaagtccaatgttaggatgattatgctcatgacacggccatttaatctttaaaacaaatataaaagacaggtattccctgtggcagagctgagctttacctcaggtctgtgtgacagagtctcatctcttctcttatacatcctcaatcttcagacatttaaggtctctgagtatccaggatttcctttgcgacaataattaacaaatacatgtatgtacatttgtgtgtgtgcattatgttttaagcatatatatatatatgcaggaaactcacatctggagtaccagagtctacaggccaggactagatacttagatctctagggaagtgatccaaatatctagttgcagctatgtagatttcaagaatgcagtgaggggagaaagagtatacttaatatatgagtacatatacactatatatatcccatatatgtatgacatatgtaactaataatagtcaaccctcactaacacaatgtgcctaatattattgtaagcacttcacaccccgttactttgttctcataacatctaaggtaggcatcattattattatcatctagttttacagatgagacaagcaaggcacacaactaataagtggcacagtccaagttcctatctgtgatcctgtctttttcatggaccttttcctatctgttgcctccatgagaacatatctgaactttggcctattcttttttaagactttgctccctcttaggagataacaagtagcagaactcacatgttacccagccaatagtgtacttagcttgggaacaaaagactaaatttgtggaaattcctcacatttgtacaagagaacgtcccaaagcaagatactatggcctggaaaatggaagagatagtttgggcaggtggatgttttgggtctcccaaatcacaacacatgtgcaatgcgcaaccatcaatacataaatccaatttaattcagtatatatttaataagcacctgctgtgagcaagggactctgctaggacctaagctctagaaagtagctacaaagattagaagcaataatcctaatatttagaacatgggagaaaagaaataccacataactaaaacacgatgcaaataagttaataccgtaaagcgttgctaaaaaaaatctgtaggtttcagtgacttgaggaatatcatttgctattcagcggtggacactgacaaagttacctgaagcaggcagtgtttgagatggactttggaatgtgggaaaattccaacaattagaaattggagagataggttttaggcaagggaaacagaaagagtcaaagcaagggataggaaagcacaaactgtgtctggggtcaatttgactagcttctagactactcaaaggatagcagtaggagtttgagatgttgtgggtgaaacatgtggaaatgtccattgagcagcaggaaacccacatgtgcagtaccagagtctacaggccaggactagatacttagatctctagggaagtgctccaaacatctagttgaagctatgtggatttcatgaaactgtccacagatttcaagaatgcagtgaggagagaaagacagacaaacttacattttgtgggcagataaagggaggatggatgaaagatcattcagatgaacaggagaaccataaaaacagacgctatagagtgtaaaggtgaagaatgcttcaaatgcttcaagaattagagatagatagtcaaaacaatcaaatcataaacaggatacctaggattgctgtgaggaagaggtatatttaagagctagagtcttcatcactgtactcatctttgaaaggaccacctcttattgctttctaccctttccctaaactcaagcatgcatacaatcacacacataaacaaacattattttttcctaggaaaaatgttggcattattaactctgaagcaaaactatatctggaagtttttagagtagttagcaagatccaaactttatggtttgattttaattcaaaagataactgaatttttatatgcaggttaattattccttggtgggaatgtgaatttatttgtattttattcaggaagtatttttgagcatttcctaactccaaggtattgtgctaaacgctgggatcagaaaaatttccataaatgcttggatggcttttacctgggagcactccttcctatggttggcaaaaagctgacgcctttgtgatgatgagtttcagtcctagcctctaagagtttttgtggtcatgttattaagtgcaatgtttatgtgtattttttctgttccaagattttttttaaagttttgaatatttttttatgtcaccaaaaggtgctttagaagaacaaactaactcaaagccaacacagaaactggttctcttgctttgccaaagtggcagtgtagcatgtgggcaagtaagaatacttttctcaagtatttaaaacaactacagaaatcttattcttcattgtattctctaaagaataaaggtaagaaggaaaatcaggttttgatagagaattaaaaaatagctttagcatatgttcaaaccattaggtcaaaagggactaacaaagccctgtagaaggggacccacaaaagctgcccttgggacttacttattcacttatttgtttatattttttgtatatgtacatatttttctgatactgctttgacacatcactttagctctttttctatatgtatgaatattcttctcctacaacataggaatcttgatgtatacatagtttagtaatctgcattcattctttcaagataaacatttttaatcctacatggtattctattctaaggatataccagcataaaatacaatttaaacaatcacctatttttggacattttggttgcattctgacttttattcttttcaataattctttgtccagtatcattgggcatagtctttgcaatgctattatttaatgaaaagaaaattttggaaactttaacaggtaataccacaagcgaggaaacttaatacaacgaccacaagcaatgaaagaaaagtcaaatgcctcaaggagccagggtggaagagcaaatgagtgaagtaggtgtggcataaaatatggggtgatagggactttgtcaaactggagagaacatggtttgtctgaagtgagcagctgctactcagttccagatattggtgccacatgtggatgcagatctaatgttgtcagatctccaatttttcaagagaagcaaaaaaaaaaaaaaaaaaaaaaaaatctagtttttttttggtgtgaaatctctttaaccttaaaggttggctcaaattattttaaatattctgtggaccaaacatacattttaaaaaattctatctgctagctagatgcagctcataggccactgatttgtaactttctaattaaagaaagggcaagacggtgtttggaaatatatttctaggtagagagttaagcaaataaagttttacttcaagttttcctagtcacaaggaatgtaatgtggagagactgaacctcaatgtgcaaatcttgaaagatgggtaaatactgctccccacttaacacccatgaagaatttaatagaagaggggtctaaaatgcttttaatttcacaaagaaacatgctttaatgatataaaactctaacccagtgcactgtatgatgatatctaatgataatttcccttcatttcccatctgaacaaacatttcccattaacatccacctgcactacttcctttcataaagaggaggtggtatttggctatgttctggttctgattcatgagaaatcagcccaagcccaacatttctgttcttaacagattttggtttttaaatctgtagaacacaatgtttccctgggctgagttctagcatgccaagttttggctggccacagactttgacatctgagtgaaaaatctttcaacaatggcatttaaactgaagaatcaacagacctttaattataacactgcttgtaattccctccctctcttatcatgatgttcaaattgcctcaaatcactaactgcatggacagcatgttatttcatttgccattggaaatatcataattttaaaacttgggggcttgagattgtgcattaatttttgaaaaatcagtattacttattcaccataaattaaagaggcatatggaacgaaggtcaaaattactgattcattagaaataaaaaacaaaaaccactcaccacacaatttctcaacttatctaaaatgctcaagatttagattaaaaacaatatttccacttggaaattaagcattaaagatatagaaaaagggagtctctttttagtgagatttcactaaatacctctggtatctctccataaaatgttaggtgatcatttcttaacagctttttaaaaatgacacagtctcagattaccctatgtttcccttatataataacaaaagacacttttatactactaaagtacattaggaatcctttgaaagtttctgttttagaaactgatgttgaaaaagtacttaatttatatttaacctgcctatctgaatatacttagtggaaaaattagggttaaaaatgtaaatgtggaaaatgtttatttccatgttttatagtagttagttttttatttgcttttaaatatagatcttggttatatgtggaagacaggcataatttcagctcctttttcatcttgaagagaaacctggctctcaatttccaggaaatatatttatttagacctaacaatataccagaattttatgcattatttctaatcttcataataagtctacaagttgggtgtcattaatctgttactgataaggaaattgaaactcaaataaatttaatgcttttaccaaggtgatttagttagtgtctttttgtccatggattttaagtggtagaatttgcatgcaaacccagatatgactccaacggctctgctttctcctttagaagaaaaaaactccttcctgaaatactaacatcttttctttgtgtaattgaccatcctttcttaatacaattggttatcagagctatcatattcttaattatcagtattaccttacgactctaaaattcatctttgtccagtgtatagaattcacatcctaaggttagatataggagattaagtctctgatctcctggagcagacctggtttcaaatcttgtcttttattatccccataaatatgcatgtatttataaaattatgtcctaagtctttgttcagaaaatatgtagtgtctgacattattttgtgtataaaatgctgaaaaggtcacatccaggaaactagtcctgaccagcatacaacactcaagaaaggttctccaaggtagaatcaggggagaatcccaattgaagttgttgaggggagtaaagataataaataatattaacaataataactccatgcattgaactcttaatattcttcatcctatctatatatcatatttaatttttacactactcccattttgcgtgtgagaaaacagaggcttagagatggtaaataactagttcaaggtcacatgactagtggcattttactccagagctttgctttttgtactttgctaaactctctcccagaatatgggaacaaaatctaaagaggtaaattcaaagatcaatattaagatgataaatacaagatgcagccaggaatcaggaattggagtgggaacagatgaggaaacaaggtggtgggtccagcagggttgcatggttgaagtcagcaaatgtctgatatatgggggtgtcatgtcacattgaaagtacagctacatcagggaggtggagcgactgagagaatatgtagagggtgacagatataggactgcttggctgatttcatgtttttcctttacaaatgtaaataaaacattgtgtgttggaggtcagagggcaaaggagatataactgaggactctactcaaaaaaacatctcgcttcatgtgtcattaactgaacaggggaaagaaactcagttgtctaacaagatatttttaaaatatttatttctccaagagggttaaacctcatttacaccttggagtaaattactttaataaggttaccagatcacctaactgaatgtaactaaagtcaagaagctgcagtttgaatggggaaaggaaatggataactgtggaactgaagggtgggagaaggggatgatagtgacacaagcaaggataaaaaggatttccttaggcgaataggagggcaccaaagataattttatgaaaagacagttcagggctaaataaatgtaaagtactaacatcatcattatcactagttctactctgcacttatgtctagaatttttgtagtagccagtgtacagacaaaatcactaaaattggttgctaatttctgatttacaagctgagcagaattccctacttagagtaactcctcaaaacatacttgttgagcaaaatgggacgtcaaaattttgcctggaagttggaaactttcagattttccaaattccaacctgtttttacagtctaggttaatccagtctaacctatcaagttcatctaactgggtcctccctgggaaaaaggaagaaagaggacataggaagtgaataaagaattgatacctcagctgggcgcgcagtggctcatgcctttaatctcagcactttgggaggccaaggcgggcacatcacctgaggtcaggtgttcaagatcagcctgaccaacttggtgaaaccccgtctttactaaatataaaacttagccgggcgtggtggtgcaggcctgtaatcctagctgcttcggaggctgaggcaggagaattgcttgaacctgggaggtggaggttgcagtgagccgagattgtgccattgcactccagcctggacaacaagagcgaaactccatctcagaagaaaaaaaaaaaagatacctcactgctctccttcccttctgtgtggcccaatacagcatgctgttgaccctggggaagcttcagaatgtatgatctaggaaagctgaggcaatgctgtaataacaagagctatgtgaaaggtaaagtatgaaatgtatgatggaaaccaaaccaaagagggtatgttaaagataagcccattaaggaaatagctcacctgttggactggaatctcaactggctcttttatttcacgctaaacctgtgctgagtctgcacagaaggacttctgaaatgcttatatatacaacctgacaggtacaatcagaaacagtacaaggactgcgtgcctcaacaagaatagccagagcactgaaatcaattgcagagcacagacatacttcaactgtggctatgcagacagtccccaggtatggctggtgaacagcacgctttatgtgtgctatgtcccagacttcctggctttcttcccttccgtcctaccccttcggcacacactacatatctttcacattttataaaatcacaggagatttccaaattattgtgtctttcaaatactttaaaaatatattgtcctcctaatataaaggagagaggtggagtatttagctgatgaactgaatttgaaagtaagtttgcatttttgatatatttccttccttatgagtgagtcatgaaaaatgcatattttgtctaaatattgataaagctttagaatataagagctggagtgaacctaagaggttttgtagcccggcaatttccaacccaggatgtgtctcagaatcacatagagaggtttcagattcccagccaggcacagtggaatgtggctgtagtcctggtgactgggaaggctgaggcaggaggatcactggacccccagagtttgaggccagcctggggcaacatggtgagacccctgtctctaaaaaataaaaagtaagtagaaaatacaaatcacagattcctgggccttttccttcccctgccttccccaagtgattctaattctatgtcagttttggctgcttgcaaccagttatggagaccagggatcttgatcaatctcttcatctatctgatgaggaatctgagacccagagaagtaagaggtacagtgatttctctaaggttacacagtgtatgagtccatttgcacactgctgataaatacatacccaagattgggaagaaaaagaggtttaatggactcacagttccatgtggctggagaggcctcacaatcatggcagaaggcaaggaggagcaagtcacatcttacatggtggcagagaagagagagcttatgcagggaaactccccttttcaaaaccatcagatctcttgagacttattcactatcatgagaatagcacaggaaagacaagccccctgattcaattacctccctctgggtctctcccacatgtgggaattgtgggagatacaattcaagaggaggtttgggtgggggtacagccaaaccatatcccacaggaatatgttacaagtgaagatagtctatggacactgtaaaattgaccccattagctatatcccaaactagttcattattttagaatctattttgtgtgtttgcatgcatacagcaatgcttcacatatctgcacaccacttatgtggcattccaaatatggttaagaacaaacaaagtgaaaaagacctgcaagcagccaaaattggtactaaataaaccacacataatcctccaagtctttttaaaagcctcttctcttgcttctctatctagtgaggcataggtgactcaaaatctttatctccaagcccggcccttctgctgcactatagtgtcgtgtctccaaaagcctagtggaccactcacagatacccagtcggcaccttcactcagtgtgttcaaaattaaacgtgtgctttcccctcccaacccttctcctgctttgctgctctgtttatgactctactaaggttcaaaatcatagagatgtgtttggtgtcttcctctcccttgctccccaaatataatggattaattctcccgccacatttcataaatcagtttgccatctctgttcattccctctgcccctgccctagttagtgccttcattgcctttcacctggactattgtaatagtctcctgcctgatcttgtgtcctctggtctctccctactccaatccattttactcactgttgccagattaatcttcctgaggcacagctctgattatgttactctcctactaaaaactttcaatagctccccactgtctcctgaataaagtccaaattccttgccctaataatcaagtcctttcactttctggtcccaatatacttttaccgctttatttcccactacttatcttcacacattccatgctcaagttaaactcaattacttctttgcagaatctttaccctttgattcttccatgcttttctcatgatagagtaatgttctttccttctatctctgtatgctcaaatcctgcttgtttttcaaagcccaaatccagtgtcatcttttctgatgaagccctcagttagccctcctctgagctccaagaataccttatctgtactacttttatagagcatttcacttttcactattaattctagcaaagtagacacatgtctcagctccgttgctagattaaaacttctagggcaagacatgtcttatctgtgtatcctctccagtgccaagtatacaagtgcacgactcacaatatttgtcaagtgaatgagttcatgtatgtactttacacacaatcaaaacatgtttttttgttttattgtctaaagaagattagaaataatgcatcagagaaggaatgaggatcttagagacttgcacaacagaaagtaacttaatagctaaagaagaaaaataaaaactacgaaaagaaggcatgagaactaaagatatagcagtcagagggtaaagaaacacagaagcaaataatcttatagaataaggaccaaatggttaattgagaagcttggaaaccataaaataacattcaaatatgtagcattatttttatacttccacaccctcatcaatagaaacaaatttgaattgtagttcaagataacaaccctgaatcatttagaaaagtttgaattatggtaagtatattcttttttttgagatggagtcttactctgtgaggctaggtaaataagctgcctttattaatgaagaaattcatatttttctgaatattagagaaatattaatttttcccaattaagatatgttcatgatatacaatttagaaaatataggagagtaataaaaaatcttaaaaatcctaaaaaaggtgggattataccatatgtattactatgtatgctgccttttaacttaatatatagtataaatagttcatactattataggttcttcataaacatttactggctcaaaattctatctaatagatatgtcgtactatacttaacacagcactctagagttgaacatctagcttatttccagttttataatacaaatatgtctaacaagatttaccatgggctgacaactgttgaagcagagtgaggaactcatgagagttcactatgatattcttcctacttttgtatatgtttgaaatatctagaacaaaaaggtaaaaaagcatatttatgtcttaattcatttgtgttgctgtaacagaatattataaactggctaatttaaaaagaaaaaatatatttctcacagttctggaggttgggatgtctagtatgaaggtactggcatctggtgagggccttcttgctagatcatcccatggtggaaggcagagggcaagagagcacaaaagccagagagcaagaaggagccaaactcacttctataatgaacccactctcatgataactaatgcacacactcctgcagtggtggcattcattcattcatgaaggcagagccctcatgactgaatcacctcttattaggccccaccttccaacactgttgcatcagagattaagtgtccaacacaagaacttttggagacacagtcaagccacagccatatgataaatatcttgtgcataatggcttttgtttacttgtaattattttcttaggttgcagtttagggctagactgcctggatcaaagtcttaccccatcattacctagttatctaaccttgggcaagctgctgatgctttctcagcttcagttttctcatttgaaaaatgggtataatggtaacttataggggctgttctaaggatcataagagaagatgtgcttctaatcccttccacagtacctagaacactgttagtgtgcaataaatgtcacctttgaaaaagcaaaatactggttgcataattatgcgttgtgcttataaagaaacatcacatataaactgaaaaacatacctgaaataacatgcttaagtgtgcaccatttctatctccaggctaaatgcttatttcaaagatacgaccactgctaaaataatttagatccataattaccattacgaagcattttctatgtggttgatattggccttactgggctacatgtttgatgtgtactatctcatttaatcatcataagagttttctgattactttatagataaagaaactgatgcttaaaggtgaattaatgtgcccaaaaggacacagggtctgttttcaaacacaggattgaacctctggaattcatctctaagctactgaaaatgacctttgttccctgcactttttttttttttttttttttttgagatggagtttcgctcttgttgcccaggctggagttcaatggcacgatctcagctcaccgcaacctctgcctcctcggttcaagcgattctcctgcctcagcctcccgagtatctgggattacaggcgcccaacaccacgcctggctaattttgtatttttagtagagacggggtttttccatgttggtcatgctgggcttgaactcctgacctcaggtgatccgcctgcctcagccttccaaagtgctggcattacaggcatgagccaccgcgcccggtccgtaccctgcactcttttgcatagacttcagtctttctttctttcttttcttttttcttttctctctctcttcttccttccttccttttttctttctttctttctttcttctttccttctttctttctttctctgtctctctctctctctctctccctcccaccctccctctctctctctctctctctttctttcttttttttgaggcagagtttcattcttgttgcccaggctgcagtgcaatggcgcgatcttggctcaccgcaacccctgcctcctgggttcatgagttctcctgagtagctgggattacaggcatgcgccaccacggctggctaattttgtattcttagtagagacagagtttctccatgttggtcaggctggtctcgaactcctgacctcaggtgatccgcctgcctcggcctcccaaagtgctgggattacaggcgtgagccaccacacccagcctagacttcagtgtttctaatctttattcctcagaggcagatatgaattttggacaaagttttggtccaattttggatgtttaactggacctttgggtaaagtacctttctccttcccattcactttaatcagaattatttatttaacaaattttattctagcaaacaattttagagaagaaaaagtagtactccataacaagctgctcttaaaaatgcatatctcattctggaaaaactaatagctatcatggttttaaacaataattttccattggtttgattatcttatgtccactgtgaaacaacagttcattattaaacaattcattatcaaacacacaaacacatatacacatttaataactttaaaacagtccatatttacatattttactttaaatatgtaatctgaaatgtgtatgcatatgtgtatgtgtgagagtaagacatagaccccggaagtctgaatttggaaaaaccctgtgaaagtctgaaaaaggtggttttctacaaaccttatgaaaaattaagtcatagaaggtcacaattttaaaaaatagataccaaattaagtattttattctgggtttagggaggcttctcctgtgcaacatactttagaccaaggcagtcaagaaatactaaaggggatgctgcaattcctctgcctcagacagtacatttatgcatctgtattataaaaaatgtgccagctctagcaagctcacagtactgagcaaagtgctatagttacagctggctctgtttactctttttttttctggtctgttcctctattgggggggggccacagtagggtgttttttcaggatggggggaagaaggaaggagtttttgtgagttctattttggattttggtgaataagaaagcagagaatttgctagcctgttactcagttacactgaaacatgatgcaaactgactcaatttggagcacagaaggtgctgaaaaatttttctaaggaggtcttgaaatatctaagtctgccttcaaggaaggacttataaaaaaaaatcaccatgtaaataatagaagtatgttgctacttctcttaaacctgacctcttaagtcactactcacactaatatactctaaaagtagccagcatgatatttcaaaaattactttgtgtcctttatcctcagtagagtattaagaggaagatgcttgagtgtagacacacatgtgggtcttctttacaaagtcacgtctacatatgtacaccgttagaagtatgggctctaaatgattgaacaagctgtatttccatatttgtattgtccaacctattttcttttttcttattttcctgaatatgtctgaatatatgtgttcagtataaacatacaattgtgtggacgtgtctatgtgtgtttctaattctatactatcttgaaaatggctcagcgttctagaaatacagccacataatttgttttgttttgaaaaactgctcagcaaatgcatacaggtcataatggcaggtaacagaccatttattgaagtgctgaaacaaatagaaaacaaagtccaggacaccatcacagagcagtacttcccttgtgagatactctcagctaagtaagaattgagtgagacaacaataaaacaaatacccataggcttttcaaacagtaacaacccgctcagggttagcagcatttctagaccttgatggtacaatgatgttctcaacctttgctttcagacactggatcactgcttaagtagcctttatcttttccccctaatttttgttgaagatgcccttgaaattagattatatttgttcctaacaaagcatatgtatattgtggcatcactcttaaaaccaacaattgggcttagttttatgaagaaaaaaaatccaccaacctttcatgctgagatttctcatgctagttctcagcacagaagtgattttttttttttaagttgcataaagcctagcaaggtttaagttttcccagcaaggagaaagtgtttttcagctgttaaatttttcagatgctttttttgaatttggataaaactcaaaaacatgtttgttttaaaatgtaaaccttttcatgtacagaggtttgcatatagagaaatgctattactatgtttaaagatacttgcttttgaaataaggaggtcacatgcatttaaaaataacaaactgcatgttgctttatgaatgtcctattaagccctaacgtaaatatgatgttctggaggagcactgatgcacacgtttgctgataggatcacttacaacactgcttgtggatgtatttccatgtgagagcaaagggtggtcaggtttgaactgaagaacatccatatagtcagctaatatgctttttaaagaccttttacctcagttgcaacacacttctttgtcctaaacctgctggattactcaacttgttggctggactaaagctgacacaatacatatttcaagcacaaaaatgatgaggaacacatagggatgtcagcaaagaggcaaagaggatggtaagtcatcggaaggctggtcatttttttttttttaaacagttcaatgtctttactgttttctgtaatattatcattttccatttttcaaacaatggaaagaacaacaattagtttcatttttaaaattattagatcataaaggacaagtttaggaatattgtttctagcatactaatagatgaagttagttgtaaatcaatagtcttatttctctgttttaaaaaaatagcaaaatacagtattctgaggaaagttctgacagattggagtgttacaggatagtctgaaatctgtttcattatagaagtttggccaatatagagataatatattttaaatggcttaagtatatattttttgtggattgcacattctgtaagacggtttgagtgccttgagatccaagtctttaggtcaagactgaactctagaaatggccccatcgaatctacaaaaggatacattaaaaaaaaaaaaaacctcatttcctgtaagctgctgatgctactcaacagagttgaaactcaggtcacacgcatcctactactctagtgctgccccatttactaatccaaacgaggataaaccctgagagatccgttatgtttctacataaggagtgtacaagcttctcttgaaaatcattgcattgggagagacacagagaaataacagaggtgagaatccctccccgatttgcttgctaaatccgtattcattcctgaagatccagatcaaataccacctgactgttaggccttctctgagaaactctattttgcaggcaagtattggaacgactctatgcgcatctccagtcccaatgcatcctttaaataatctgtttcctctctgtttcttgctgcattacagacatctgtgttacacatccatccttccctaatagtcagtggactcttttaggtgaaggactgtgtctctatgtccctatgctgaaaggacaatgggaagagatggtgctattgatgcccagaggcctgggtcaccagggaagctggagtcacagcaggtttgttcagagggagtaaaccacaaaggaaatgtggctggtgatgatgatgatgcaaagaacggtgggggaaatctctggcctatgccttctactgaccctcttgccactcacaagtgtctcacaagcaccaaatccaacttggaatctagctgacatgggtcagccactgttgtagagcaagggtagggtgagggttgggtctgagggtaaacacatccacaatgtgggagcaggaagatgtctttgcaggggggtgtctaggactatggacttaagataacctcacagggtcaccatgccccagcatgacccagaagggcccagagcaaggaagacatgacaaaggagcctgaagacttgaggaggccttggagctgggacaaggaagacacatcagggatctacatggacaggaaactaaagatgaggtgggctctcagacatctcagggaatttgagctcagaagacaacactgagaagaccagacaccatagtgagtagactgtatctaactgctctccaccctcactttcatattgcatttggatggcactccaaggaaggggagaggagaccacctagcagaatggaggccaaatctgagttacctcatagataaggaaagaaggcctgtgatttttaatgggtcagtcactcttaaattttaagcaaactgtagattttctgaataggagaagatattatcttaatctacacaaattttttgttgtttttttggcagggtttaaaatatttttattcatgacttatagtagaaactacattttatattgtgacccagtaactgtttacacacatacatggatgtatgtgtgtgttctggaggtagaaagtaaccaatctgctcaaattttaaatattaagattattcataattctttaagtagtttattgtttggaaagttatagaccaaggtctagaaattcagcagacctctaacctctaatcaaggacttttaaaaattaagaacagtacctgattttctgatttagtctttgaaatgccagtgctattcattctttgccttattcactcataattatttattcattctccaaacatttattgagagcttactgtatgctttatactatagacctgcagcacaaatataggcctattacttcacagctgctttaggatttatagcagtactggtcagatagttcttaaaaaggaaaagttttcagagtgcaacaacctgttcacaataattcctatgtagcagtgaagagccttgacagcatctcttttactttctcattgtggttctagtttaataacataagtctatttttacttttcatatttaactttaattaaacatgctatgagtgcaatcatgagattttaataaattagactatttgaaaataattttcccataatgatgtcttcctcatatctttcatgatacacaaaaagaatatttgtacaaatattttgttgcttcaaatatgcagaaaactgaccattatttacagtgattttgaaaataaatgagtgaaagcatgcgaacttataaggagagtaaataagcagcacaccattaccatctgagacagcatggctgctcccctcttggtgagggcagtataggtacagcaagcagaagacagatcataagtatttactatcagaccttctttaagtgaatatgtcctattccagtagaaagtatcatataagcatacggcctgaatccaattcaattatttacatggctctaccagtaaatggttaacactgtagaccagaaatttagaaaatgcagaagactgaacgatatgtaagtgactgagaacatgagtctctctcctcatcatgtaggacatgggtcgaggtcatagacttaattggtaggagttgctactttcgaagagtgaaatgctttgaggcttttaagagaattttaagttgattaactttttatttgggggaattatgatgtgagctttattaaaatatcacaattcggcattgtttcataaacataattataggccaccttttcaaaaattgcaagagtagtactaagaaggtcctttgaactaaggttcaaaggaccttcttagtaactcttgtaatttttatgggtacagttagttgtctgcataaagtcattccattttccaaagctgcttactctttgcacaaatgacaaattggcacatgcacaatggcacaggaaaagaagtaactgctaaggtcacatatgtgaggacgttgcagcctttaagtactggaggccaaagttaccagaaacatgggcagacagattaaaattttcccttcttatgtttgtgcattgtttctatatggaaaattacatttttctgagagtatatgtgtaaatatgcatctgctagtgttttggcaactctaagttacctaaattagttttgatcaacactgtcggatttttaaacccaccaacgtaataaaagcaagtttaaaaaaacacaaacaaaccctacagtacattgtgtgctctgctgttccaagcctcagcttcaagacaaaaggagagcgagactttgtcattcgctagctgttaataatcaagagaagatctgccagacaagctcttcgagggctctgtctgtctggaccaggtatatactgcaatacacaaagggctttgcagggggagaaaaatgagtgttcatggacaatgatgcagctttcttaattaagattttcattactgatacatacattaagttctgcaactgcaagagccaaagcactgtcatgtgcaggtagatgtccctgattccatcttcaggcagtaaagctaaaacatattaaatgtgcacccagcaaatgttgtgggagccaggagagctccagaaatatttttgttggaatgcagagaggccccattataggcagatttgtaatgcatctaataggcaggagaaaagctcatatcaatagagtgtgtgtgtgtgtgtgtgtgcgcgtgcatgtgtgtgtgtgcgtgagtgcacgcacgcacgtgtatggaagtgctttgaggccctggaccacagacaaaggtaacagtagctgatctagaagtaatccccatataataatataatagctcaggtcttaaaaggaactttgatcttttaaatttgccaatgccgattgttgagacaggaaataaaggattgatttggtagcttttggaagatggtaaggactcctgcatacagccagtcctgactctgcccctcctgggtcactcagtctattttccctggatccgcatgctggtctgaaagtcaatgcagtctgccaaagtggtatactgttcccatgaaataatccaactgtggtatggagaaatctttttttcttagaccaagttatttttacaaaaatacttttgcgaagaaatgagaggaaactaaaaccctacacaatcctagaagtggattactgtctagagtgcatgttttttattccatcttataaagcctaactcattttagggtggctagtgcagttaaggtgcagacatctcttggttgtttttctggtgcttttacttgcatgctttcctgtttccaaatctgcatccatattgggggttacccacagagagctgttgtctcctctctgaagaacatctccatcttttggtcactacttgagtagagatgagtgatgcttaatgaaatatcattttattacaacggtcaaaaattatggattcatttcttattagattatatgctctgaatgttcaccaccccccaattcacatgttgaaacttaattgcccatgtgatagtattaagaggtggagtctttaggaagtgattaaatcatgaaggcagagccctcatgaatggatttgtgcccttatataaaaggtgtgaaggagctgtctctctcccttttcctcttccaccctttgccatatgaagatacagcaagaggtgcgatcttggaagcagagaggacttcaccagataccaaatttgcaggtgcctcaatcttgaatttcctagtctctgtaactatgaaaaataagtttctgttgtttataaattacccagtctcaggtattttgttatagcagcaaaaatggactaacacattaggtacaagcatttatttgacatttaaatgtaatccctcattttctaagaaggaataagccagaatccaacatcaaaatgtttcaaaaggaatacttcaaagtgttttagctgtagttctttgtcgattaaataaaaaaaaattccaaataatggtggtcagtaagagtgtgtgtgtgtgtgtgtggggggggggggcggtgtatgaattcctgtgctaagattcagatctttgaaactgttttctagaatgttatcctacatgtctaaaactttttttctaagtgtatcagagatttgggatggagtggtaaacacataggttactaggaggtggcttgcctctgtacccattctagatgagtaatgttaatgactgatgataatgtaatgatgaaaaaattggttctttttaagtaaatagatagtctacagacaccctgtcaacagatagtgcatgcttactgaggaagttaacagtgttaggattcttcctaacctttactgaaaggtactgttataaaactggtagaggagtatgtgaaagctactggtgaagaaccaatgcagtgaagattattcaagcatggtggtgatggataaaagcatagaaaaaaaactcagaaaattattttgactgaagacttttcattacttttcttatgtgtccttgagtagcttataaggactaggctgaaggctactattaaaagatttaggtgtacctttcactcatgttctttcatgagacacacggttctctcattcaaagtacaaggttaattttaaattagaggtgagaattattcttcatgtatcaaaaagcctagaaatttaccagggattaaaggtagaacccattttagcctatcgaagtgtgagaggtaaggtgacctgtttagatgaatatcttgaaatgattctctggagcatgcctgatctgttctcaatacccacacattagaagaaatgaagaataatatagagactacacaaagagaccatgtaaaagaagaaccctgataaaagaaaaaaaactcttaattttatcactgcaaagacttcttgtacaagatgcctctgcaagtgtcctagtagcatgactccttaaacaagtaggatgcgtgtatgtggaagatatatatatgtatatataacatttaaaatctccctcgaaccccagcttctgagtataaactatgttacagaagcatgtggataatatgtgaagctttctaggagcatcattaagaaaatgagacatttgacactctgagccctaggtacactgagtcagtggcatggtctccaagggcactgctggcagcactaaagcctggctcataaccatatgtgcacacctcaagaggtgtttgactgttcaggtagaggataagccatttcctaggcctggttccttccattctccttagcttgtagttggcctgaagggacttcctagactctaacatgtttgcctctcttttgcttcctttctggacactgtctaaggatttaaaacacacatgactttcatgtccacaattttctgccaaagagggggaaaaatgccccagagcatgtcatcccttaccatctgcaaatgaacttctgtggtcaaggaatgctccaattaccacccagaacagctttgtacaactcctgaccctcgggaagactcgaggaactcactcccagaacccagatgctccctgtcccagaacacagggaagacgccctgtcatcacagtttgcacggcagaggcggaggtgatgctgttagtgtggtatttccaattctctagcgtctttcactttccctgaagttgctgaagaatattccatttcattaagtatgtagtaatacacatgggaatcagagagcggggaaagatggaggacgttgatgacatggcctctagcactttatttatgagaacatccagaaatctctatctacatctgggagaagaataatgtcaatcctgccctggagacatggatcaggcaatgttgccagtgtgtatttttcccttcccaataatttactgattctggagtctaaggcagagcgctgatgataatttttacattcatgtgagtgagcctggccctttgagggctggtgatgccaaataaacataaatgtatgtaaccaggtgaatacttaccacctcccaacccagaaatgtcataggtctctggtggtgctttgcttcccacaacactcccctgaagggcggtgagggtaggtgttgccatcagagcataagaagcagagcttgaggtggccttggaggacttcagggagcactgcctttgcagtaaagaatgagactaagcaaacaaacctgttagacggctcatttgtcttttccaatttttttattgtgttattcatcctttcatcattgatttatagctattcttaaaatattagggatatatcacaaatatttttcctagtttaaaaaatgattttctaccatagtaatttttattttcatgtaataaaatttaaaatacatgtattttttaaaaagttttcaggctttggttttatgcctggaaaatgcatctcatacctccagtatgaaaatattcatgtatatggcaaaaattatcactgaaaattacagaattagtgaggatgcagagaaatgggcagtctctttttttgttggtgaagatattaaccaatgctagaggacagtttagtaatgcattttacttttgcagttccactataattaattgatcctaaggaaataatcatgtaagtgtacaaacatgtgtacatatgcatgtgcatataaagacagttattgtggcattgtttagtaagaagaaagttccaaattcccaactgtccatcaataagtgattgagtcaataaattatgcatatactgaagtgcaacgttgttgtcaaaagataatgtagatctatatttattaacatggtaaatgactattacaatgttaagtgaaaagaatagaatacaaaacagcaagtaacttctcctttcagtctggaaagagaaagacaaagagaaagaaaaagagaaagataaacaggactgtatggaaatataatatttcctaagttattaatagtgattatctctgggctgtgagatttcaaaggaatttaaccttgctctttataaatactatcaatgaaacaaattcaagcaaaactaaatgtatacttttttagaattaaaaattagaacttttattttgggggaaaaagaacttacctaaaacctgcaataaatacttaaaaattccaatatgatcttcagtcattagcaattactaactagctctcttagtagggtgacatcaatgtctgcctcaagtttcccccaagtttgacactttgagatgtacatcatagttcttcccttaaagaattttaaaatataaaatttcaagtagtgaatataacccaaatatttttatctagggcatggttaggtaaattctgggggctttatgtgatattattcagatgttatagtgctatttataaagagtttttaattataccaggaagtatttattatataatattgaattaaaatgggatacaactgtatacatgcaatgtatgctcaggcatgttaaaatctagagaagacactagaaggtgatctaaaaaattattaataatagttggttctgtgtagtggaattatggatgtttcccctttactctatactttctaaatatttcacaataagtgtgaattatagaatcataaaaaaagtaaatattaaaaaaaagctgttttgctcgacagctgccaaattttaccccagatgtatcagcaatttagcttttagtcaaatgaccctaacatcatttcctaaagggaatatcacagaatggaatgtgcccaaataaagataagccatcacggccaccacctctttctaagctatcattttataatgcttaaaataaatctgagtaagggatctttcttctgttggaagttataaacttccacctccttcagaccctctccatatcttctcttgcattaccagcacctggaatttataattaacctatagtaccctggtacgtttctaggtctggaagctgtttttggaggctgatggtgtagatcaccattagggatggaggattatttattcattttaaatgggagttcccttgaataacaaacagggatgagctgctatataagatcttgtgtagttaatatgctttcttacccttcttatatatatatttattgattgattgattttttgagatggagtctcacactgtcgcctgagctggtgtgcagtggtgcgatctcggcttgctgcaatccctgcctcctgggttcaagagattctcctgcctcatcctcccgagtagctaggattacaagcacccgccactatgcccggctaattttttgtatttttagtagagatggagtttcactgtgttggccaggctggtctcgaactcttgacctcgtgatctgcctgcctcggcctcccaaagtgttgggattacaggcgtgagatcccgtgcccggcccgcttccttcctcttctttccatccctcccttctttcttcccttgttccctctctcacctgtctacactcctgtctccagccctcttaaataaatagcttttctgtagtgttagatgccagctcttaacatttagagacaattcacactataccaataccatacttcaagtagatgatctaattgtttctaaatcatcatattttagcaaaaagataatgggagaaatcaaagttgtctctcacatatgtatgatgcatactagaggcttggcaataaggcagagagtagatattttttgagaaagtaaataacaaaacaaaacaaaaagccaaaacacaaaaacaaactgggtattgtgaggacagggcagagggaaggagcaggcataagaaagaaaaggaatgacatcggtctcctggtccttgcaaaggttattcaagtccctgttcctggtgttttggaccagatatcagcctacaaaccaccctggactgtgagctatttgaaggcatagatggtgtcttactcacctctgtattttctgtaccaaacacagtgcctgatacaatatactcaacagatgcctggagaatttaactaagccctttcactgccctttcttactggcctcagctagaaccaaaacaagaagctaaaactcctaatgccacaaatgctaggtgaaaccctatcctaattcaaactcatttcttctgattttgcaccttggtccccaaactgctggagaaaatcccatgacagagcagataggtatcaacatcaacccaccagactcacctgcaccttccacactgccaaggagagtcctactgtatttctctggtcaacttgctgtcccatttgtctcaagaacgatttcaaatctctactttccttaaatctcttccccgcttattcttagcaggaccttgcccctcagtgcccatcacttgggaaacctcttaacctttcagtaccaaatctacacgtgggcttgcatctgctcctttcctttactcctcctttcttacaaaaatagaagatgtgtccctccttccatctctccacttgtactcaggattccatctctctggccttatcagtaatcttatactgccagtcatcctatgctcttctctcttctgcacattggatctctcctctctacggtattcttcccatgaaaatacaaaaaatactagtgtttccatgcttttccaaccttcttttgacctcacttcccccctcaagatattgcagtagctcattttcctttccttcatagcaaaacttctgagtggcccacatttgctgtttcttcacttctcattctctcctcatcccattacaaacacgttattgttttgaccacttcaacaaaacagcttttgctgaggtcaacaataagctcaaaattaatataagcaatatatatttgttagtctttaacctacttgattgctcagtaacatgtcacatcactgaccactacctttgaggcactctcttggcttctgtgcctatgttttctgattttcctgccaccttcttggtggctccttctgagggtattttatggcctcatttttttctaccagcggattaaatattaagagctcttcaagtctcagtttaggtcttcttctcaatctaaccctgtccctaggcaatgttattcatgccaacagattcatttaccactatatgtcgattaccctgaattcatgtctccagccttcatgttacttctgaattccagttttatgtatataaatacctgtgcaatatgctcactatgtatctatccaaagtacctcacactcaacatctcaaaaacagaacttacaaacttctctccactccagtcctcctttggtgtttcatgtaactgtgaatggtattatccttcatatagtttgataagccccaaaccaggagtcattgttgccacttctctcttttatttcacataaccaaccatgaaaaagtccaggaatattttacttctgaattatctctcagttccatcaatttcctcccatttccactgtcaatactctagtctgcctcttatgtggtctactggaatagctccctcactggtttcctcatatccatttttgatccttccaaattatttaccaaagttaagctaccttgatatatatttttaaatttttaatttcaagataattttagattaacgtgcagttgtaagagataatacagagagatttgttattctttttacccagttttgcccaaatggtaacattttatataactgtagtacaatatcacaatcaggaaattaacattggtgcaatccatctgccttactcaggtttcatcagttttatatgcacatgagtatgtgagtgtatatttagttctgagcaattttattacatccatacactcatgaatactaccacagtcaagctacaggacagttccatcacaaaagatcccttgcgttatcctttatagcaacactcacctccatttctatcccaactccctaactttgtcatccacaagtatgttctcaatccttacatatttttttcatttcaagagtgctatatagataagaatcgtaacagtacatcatcttgagattagctttttcacccaatgtaatacccttgtgattaaaaccagttattgtatgcatcaataatttattctgcttagtgctgagaggtattccatggtatagatataacagtttgcttaaccactgacccactgaagaaaatgtgggttgtttccagttttgggctattacaaataaagctgctatgtacattggtgtaacataatgtacaggtgttgtacagttatgtttccatctctctgggataaatgccccaaagtttacccttttaaaaaacaacaatgatcatgccacagtccttcttaagtttgctcctctactgtccttaggataaacacaaaaatccttaacatggcctaccaaggacctgttatcatcaggccttacgtatctcttcaacctcaacctgggctgctagtcacctttttctctctgtgcagctctcttcagggacttcatgctgttccctctgcctggaatcctcttccaccatccatccttactttttgtttttaaccttcaggtgtcatctcaaatgttactatttcagagaagcttctcctgaatttccagactcagttaaatcttcttcttttatttgcccttagagcacatggtacttttattatatagtggtaagcacaatttgtaattacaagttatattgtgagaccatttgcttagtatctgtcttacattccccagattataagctccagaaggagagagactatgttaatattcctttattatatatacctttagtatttagtagacactcaactttgtgtccagtaaaatttggctgaggcttttaagacatagtcctggaatcaagttctatctctaccatttattagatgttcttataaaataaatcaaacatgttaaatctcagttttctgatctgcacaattaggattatagtagcatctacttaatagggtagttttgaaggttaaatcagatagccatgaaaagtatttagtccagtatctaaagcaaggcaagcactcaataggtatttcttattgttattattagttgaacaagaaactagagtttttgtattttttttcctaactaggcttttgtccattatcttcatttcttgcctgttcccccaggttctgattcttgtaacttttgagactctgaaaaggggcccttagtttagatcttggataaccagtaggactactggttcttaccccaggtatatgctctcagaccagatgtggctctggttcccattttcatctcactcagtacttcctcctcttgttttccagtctatggatgtcagtgtgggtaagaatgcctcttccctactcctagtttccagatgttttctaaacactgctttcctcttgtctcattccttataattccccatggaggcaaagtatcccattggtgggaaagcccttggtctatatttctcaggtaggtagaactgatctatccaaatttgtaagcacaggagtttaacctctttgtccttccttttctactgagactatcgggaggtgatgacctggaaagtgttgctcatatgcagatccacattttcctgtaagagagcttttgaaaggtttgactgaagggaagagagtcagcaaacccatttcctctttacactaagctatgctcttcaaccaacctttataaaaattttggttccctagctatcagttcttttgtcttatttttcaataggtttagaattcaagtggggaaaagtgatgctatttatgggccccctcgaagattccaacactttggtatatgattttgcttggaatatgattctgtttctcttcatcttttttacattttagccagttttcaagactcagctgaatcagttttacatgaaactttctagcctgcaaggctctttcatgaatgaaaccctatggtacttcctggactgtatcattccttttggaacttagtcatttattatcttatgtgcatacacaacgctcaacaatataactgtttttcctaactcaattttaaattccttaagagcaagaaagggtcatgtacttatggtatatttatgctttaactatccaataaaaattattctttgtacatagcatgtttttaataatatcttaaagcgtgaatgtgggggagagtggcctactgaccaggctttgatttgaaggcccaaggtacaacggaaatggcttagtagctggatggttcctgaagaggttgtcgcagtgcagtggtgaaagaaagaaaaggttactatgggcatgtccctgaggtgtgtatcagtgcaagtctgtgtatacacacacacacacacacacacacagtctctctctctcttacatatatatgtaaatagaacttaaatctgtcttgtgctgtgttttcgccttagtaatactttatttctcttattaaaaatacatggaactcaccatctgataggtagaaaggctaagagaaatgcaaccagagggaggtaatattcctggctatagtcgattggtgttcagagtgttttgattctctgaatgagtcaaaagattgaaaaaaaaatagccactcttatcactaggaaaagaaatgaggaggaagggtcctgaaaatggtgtctgagcaatgaaagacagtgaatattttaaagatcacaaaatttaatttattcaacctaaatgcataaaagtacaggtggggacattatttatgcaggtatatgcaaatcactttataaaataggcaaagcccttctgctttttataagttgccaaggtggttcctgatattttaaaagctatgcacctttaatgtaatttcctaagagttggaatccctctgtcgaaatcatagtcattgtcagagcaagttgatttttttttttcctatcctctgggacatttacaaggatcttataaccatcacaaaaagagtggtttccacagagatgtgactggaaaaatcccttggaaattgctgaggagcaagtcacagtgttcaaagcaaagaacataggctttgaaaacatgaacccatctgacctcttgaatttagtacagtgaattcctgagctctgaaacatggggcccggctgtgcatgccatattggtgctataagactggcagtaggttggctgtggcatggtctatttcaaactccttcacagtgcccagtgttgcatgttcccagatgacatttggttggcagaagctgggcttccaaagctggcagcctggaatgcagcccactgtgttttgacaaacacataattgaccatctgatcaccagcctacgttctgcactcaggtcactgggggacctgggctttcaataggtccctactcctcgtcttgttcatcttcccaaacctttctccagaaagcaatatagagaaggcttaaacacacccacgcatatcctcccatttgcaaaagagaacatagtacatgaaacataagctgttgaaaatttcctttaaattgtcctggcagcccaaagtgaacaagagaaaagcacacttatggtgaactctaattcagagagaaggaatgaatacactgaattgtttcaacacccggctgtgcataagttgcaattcagttcaatggtttggaaattttgcttagaaaaagggagcaatgagaaaatgataggaaattggggcattgattgactttaggggggcattatttagaaactgtttcattttcaggtgaaagaagagacaagcaggacactgggaatgtcttctccttatctgcctgctcctccctcacacccactatgggcagtaggaggcacgcgagcctggtgaccagggggcagtagctcaaagtgaggtcatattcaaattgaggtctttgctgaagatcccataaggatgtattttggtctgaaatttgactccacacaatgtttcagcctttctcctagaaggcaaagattatgcaataggccaagatatgctggaattacacaaaggttaatgtctatttcaacactaccaaatagcctctccctccatcctacccctactgcacagttcaggcctttggcttttacctttgacctggtctccctattctgagtcagcctctccactttcaccaagtgctctttctaaaacatacatctgcttacaattcttcaaagcctccttgagcctgcaggatcaagtccaaactcctctgcacggcatacaaggtcctccgtatggcaggcaaggtcccctgcctgctttccagcccaatctcatactactctttcaaccaccatgtttcaatcacactgaactattcactcctctgaatctcgctgctacttaacgcctcctgattttgtaaatgctcttacatttttcttgattatgatccccttttctttctgctctttcatatctacctggtaaactgcaatttactcttctgactttaagacccagcctggtcaccttaccacatccaagtgggcactcctccttcattcctcttactacgtcttgtatatacctgcatttcagtgcctatcatatgctatagtctttattcacttatgtatctcccctatcagactgagatttctaacaaaagaaagcatttcttatttatcccggagtttccagaaccaagcacagtgactagctttccataaatgtttgttgaatgaaaactaaataaagagctgtacatgataattaatcaaaacgaagccaagtagtagtgttagcttttataagcatagtaggagcccattagcaatctaatgaaggcagaagatcccagcagtaaggcactttctgatgggtatggcaggggctggtgactggctggggtgacagtaagagtgagggataaattctgtgatggaggaaggtctttttaacagagactgccactaaggctgtaaattaacacccttttcaagacttaatattcaatactgaaagatattgtcctgagaataaatctgaatctgaattgtatagagacctaacttataagaaccaagtttcccaaataaggtaagtctgtgctacctgcttcaaggtagcatggcagattatggagggttcctctttgtttctgctaaacagtaatggaatgggaaattcttgggggaacatctgagagctcttcagttcctattgaaatccaggtcaaatacagattgtgatactggactaaatgcactgctaagagaagatcgaacaagcagaattctgtacctgtttagaggaggccattgaagaggcacttggagtcaaagcactggggagataatgttctgatctgttctcaagggacattggacatttcttttccttttgtcgagcctctggggcaccactctggagccatcaaccatcaactgtgtctatgggatacttgaggacagtaggactgtcataagcccggtcaccctgctgatatgagggcagcttcaagatttggaacaagccaagcaaacatgaagcctggcccagggatggcacaaggtcatgggtatatgaacggattatctgctcattataggtcactcccccagccttatgtgtggttaaaaaataggatatctctagaagctatgcaactgatggctgatgtagcatagaatcagatttgcattttcctatgagccagagacagcctttcaactacactttttatctcaaaagtctcccccttgattcctaattggtgacacaggtcccctgtactgcttgtgtctgaggctcgccctatagcactgacgtcacaatagctgagccgtgcgggcaggagtgcactgtgctgactcatcccggtgatgtgaggattaatgccttgtctaacacagagctattatgtgaactgtttttacacaaaagaactgtaacaaaaatgatttgccagtcagaggactagaaatatgcagtgctaggtaactgaggggagggctgtgcagatataaagtggtaaccataagcatgcatattgacatcctccaaagcatttacagacccactctatcaacactgaaatagagaataacaagacttgtcagggacaggtaggacccacccctgttgtataaatgcattacacacagctccagtctttggggagtttaatcaatctcctttctctgtcaaataaactgtcacgttacactttagccttagcatcctttggaggattctgcctccctaaatatatttgccactatcttctaggaatgttagtggaaggcacgcataaacaaaatagccatgggaacctccattctgtgcaaatgattataatacaagaaataccttggagtgaagagtcagtgaagcaagatataatgttgtgaataaggaacagagctcaccagagagtgagaagcagccagaggataccgataattatttatcacattaggtgactatcactacctgtaggatcttttgggtggtgtctcttataagtgactttgattatttgggttcattggcctagaatctttttcaagcagttcaaaataaaatttatttaaacccattcagtgcagcctggtttgaattttaaataatgaacgttctcttttttttcatataaaatcgtgtttttttttccccccgaatacctttccatcttttctaaaaaagagtggtacctttataaaccttctggcacacgtgaatctgggatttctttttttcccctgtagacttcataattttgcacaaaagtttagtctatttattttacagtcttgtacttcttagtaaagggatattagaaattttgtcaataaatgaaagctctgatctagaagttaaaattaaaaactattggacctagggatgggtacataactgaagaatacataattgcccaatgattgacaggggagcaaaagcccaactgttgctggtatttggctgaataatgtaagctatactttaaaagagcagtgacttttgcaaacagcagctgcagccaagtaaagggcagcctttatagaagtacagtatctgggccactggtattttctgcaccctcatggatagcaacttagtattaccaccaacagcatacactccaaacgcaaaagaaactaatacacactacagaagcactagaaaccacaacaaagtcaactaggaaatatgccagtgaaaaccacaatttcctaaatctgacacttttttttttaaaggtaaagaaatcacttttacttacgtaaagagaaggggcaggtcacagactgatggtcaaagatctgaaaatcaaagaaaaaataaggaattaaaagcaaaccgatatatgatgcaaaaccaatatataaaagcaaaatgatacagtgggaagaaagaaagcaaatctaggcatagatgggactggttgttcctaaaggagcctattttgtcacttctagcctcaaaataaaggagacccagcttcataaaaactttctaaaggtatgaccccctgctatgatgaccaagacagtacttcccagcacaaggagtgcaaagacctttctttgttcatttcattctaatctgtatcatataggatttggtagagctatgttaccatttaacaaaatagccactagccacatttgtctatttaaatttaaattatttaacatttaataaaaagctaaacatttagttcctcagtcttgccagcttcatttcaagtgctcaatacccacatgtggctggtgactgccttactggatagcacagatagaaaatgtttctattattgtagaaacttctattgggcagcactgactagaataggtaaaagctttactatacagtacatgaccaattttagctaattttgacaaagatgagtcaaaccctgataaactttgtctcttttaaggtatatttagtatgtttaatgtccagaagttcctctgaacaaattcaatacattcgtgtgtagctaagaactcagtcctaagtttgccccggacttgccttctaaaactgcctctaccccttctcaccagcctagaatgtcccctctatggtggaaaataatctgataaagtgattttaaacaaagcttctctcccaccaaacacaactctgtttggtgatgaaaatttcagatgaaatgatgaaaattttagattttggagaagctgaccctaacagtgttcttgttctatgtttaaaatctgatatttcactctttaaattacaagccaggctaggcgcggtggctcacgcctgtaaatcccagcactttgggaggccaaggtgggtggatcacttgaggtcaggagttcgagaccagcctggccaaaatggtggaaccctgtttctactaaaactacaaaaattagccaggcatggtggcgggcgcctgtaatcccagctacttgggaggccgaggcaggagaattgcttgaacctgggaggcggaggttgcagtgagcccacatcacgccactgcactccagcctgggtgacaagagcaaaactccgtcaaaaaaaaaaaaatcacaggccaaaaaaaaaaaaaactattataggactggtctgcccatcattgtgctttgtttttttttctttcttttttttttttttttgagatgaactctccctctgtcacccaggctggagtgcagtggcacgatcttggctcactgcaacctctgcctcctgagtttaagcgattctcctgcttcagcctcctgagtagctgggactacaggcacgcaccaccacacccagctaatttttgtagttttagtagaaatggggtttgccatattggccaggctggtctcaaactcctgaactcaggtgatccacccaccttggcctcccaaagtgctggaattacaagtgtgagccaccgtgcccagacccatcagtgttttgatagcttctcttagaaggataaaactgaagtaggaggagagccatgacaaattaataaaccaaaaaaagatactgagaaaacaaagcaggtccccctacctctagcccacttaaatatatcaagaatttaatacagggtgattcaatcttgcctctctgacaccatgattttaacaacttcacataaggcctccagaaatatgcaaaacaaacttcactaaaggagatcaagtagaaggacctgattaagtatctttgcattgaaaaggctaaagcagaaaaccagcaattaaagacatcacccttcctggaaagtttctgggacaactgcactattgtagagatttcttcaaagaaatgatttccctttgtggtcaatgtgaaaccttgctcaagtacatgcaggtgtacttgatgcaggatggtgacaagacgagttaagatgaaaatctccagcctggattattataatgctaatacaagagaggctggagatctccaatgctttcaaattgtttcacaaaattcatgagtttaatgaaaattttaggcaagagaattagattatgtatgattcattgaaagcacatacaaatttgaaatatatatataacactgactagtcttcaaagattttaaagctctaagttttgctatattctagtcttctctgcaagccaggatattagactatggcacaggggcatattttcttaccattttcctccctccctctctcctttcttccttccctccctccctccctcctttcttacattcctctctctctatttctctttctttctttccctctccttttttgaacttgctgtcttctctaaccttggggagaagaagaaaatattattagcaattttctatgaaatatgttcaatgatcatttttctgttgcatgttataaacccaataactctcaacaatattatgctcttctaaaattatacctagtgtttatgttcttatatctaaacacataactttcttttctaaatttcaaggtgcatttattcataaaattagttaaaattaaatttttgatgtgatcaaaagagatcaatgtaagttgtacccaaattgactaacacatccaatgtctggaatgaaaaactatctttcctggatgtcaaatgacacacaggatggctgtcaatgataggaatccaaaatggagagaaaaattacagtgtgtatgtcacagtctaaaacaaattaaagccaagttagatggaagttttattggatataattgttgtacttatatgttaatataaaatgataatatgatcccaaacttaatagtatggctaaaaatttaatctcagagttcttacacaattcataaatgttcataggcatcaaaagacacctacttcttgactgaattataatctgctatgtaattctgagaatatgtattaatctacatagatttatatttgctcaattcaaattgttatttcattgatacatgctctttccacctaagtgatattcaccttatatgtctataagttgtttttatctgaaatgcaaagaattatctataaaagtttcacagaggattaaaaacatttgcattaagcacactttgttcaaagcataaatatatctagcaaagagtataaaactgtaaagcccaagtaattcaggacgttaaaatatcagggtggaaggtgggggatgagcagagagagggggatgacgaggggtgaagtttaatcttcgtattataatgtctgagtggaaattattatatagtgtcaatctccaagaatcaaaaatattattaattataactttaaagtcaattctagtgtagtttatgtaaagttctacagcagtggttttcaacattttgaagtgataccgatccctatgagaatctctttctccagaaaactcctcaaaaacaccaagtttcaaggaactcctagactccatgaaggccattcatgaatcccaggttaggaacccctggcctaggcagacaggggagaaaaaccctctttcaatcccatagctactcacctctacagagttttcatgaaatgctataaactaaagccagcagcaaagaaaatgtataaaaaagagttctaagtgggtaagggtatgtggttagagccacacaggcttctttgaaggcctgccagactcctaccttcctagtcctttataatttcttttttaaaaaaatctacaaagccttagcaacaatggagtagaggagtaccgagcagagagatgataatgatataagaatcactatctactgagtccttcaggtaccttgagaaataaatccttcccaaatttggatatgagtatacccaggaatgtgagcagtgtaacgggagtagaaaaagccacaaaataaatagtaaatacatggctgtcttcctggagggtcagtattccttgtgggcaagtaatttaaagtcttatttgcacacgtgttcatttatccaataactacttcttcaatgttataccaaaaagaaaacagatactgttcttgtcctcatggaacttccggttgagtgaaacaaacaagaatatattgaggagctgaaaggaaaatctgtgtatatattttttgggtgaaacctgagacttcactgaaaagtcttgtttgtggcagactacttcaagcaatgtcctggcaggcacccttagtattggatcactcactctaacttgaggatcacccaagtggaagagtttgagaagcatggttagcagtgtatcatttaatccccactacaagagaaaatactgttacttccaatttactagagaaaaaagagaaatttgagaaattaggaaacagctcagatcataccgctgctggcgtctgaataagtgtgtgccattccaaaatctacatatttttaaccactaaattacactacctttaggagtttcccactttatgtttccccttgaatctgggctcattcaggattacgcaggctagtttaagcttctctttggaagcagacaggtttggcttgatttgcattctaaatatttcacagtggtaagcgaaagctattattatacccattttatggtgaggaagctgaaccacttgccagctgaggtatctggctgggttaaaaacagaatctgggtcgtcagactctcattcctcttgactaactccaagcctaggcactattactgtccatgggcttttctgaacatgagattcacactgggtgataaagagtgagacaaattctgctaagagaaaacaataatagtgcaattgaaaaaaagggaaaataagtaatcataactcacaccaaaattggttactttcagcattgtgaatagaaaagggagagattattcatcacaaatgagtcagaaaattagaatgtgtcactgcactgatgacagagctgaggaatttggatgaactgaagtttgacacttatccttctagctgaagagggtaaatggtgtgacaacaggacagaaatgacctcttatttccaatcttaattaatatttccaatcttttttccttaactactctgtctaaaagttagatgggtttatatgtttgttttctatcggtagagataatgttttaacatccctttaacgttctagaagtattgcgttaattaattcttatgtgggagtcattccaaatagtaggatgatgatttttaccttattgattttcctaatacctttctggtttccagtgttttcaaaggatgaggcactattagatttttagatttatatgtctctcaaaattaagtgcctgtcaactgatattccatctttactctggatacatgatttcctttatctgacagattcaaaaaaatttgtactagatttaatgacatttcatgcatcttgaatttgggagtttttaattctctattttctatttggcaaaaggtttacaggagaaagccagatgcaagggtatttatatgtgcatacagaacctgtgccatcactctctaggtactttggggtttcctgcaggacagattcttgatgtattttcattccttttggtcaggaagaagaagactataaatgccacaaatggtcatacatatcttggggtctgctttccaaaacgcatattattttggatccgtctcaagaagaacaataagagaatgatactgagatctttttttcttaagatgctatgataacaatcctaaaaaatggcctgccttcaaaattttgatgatgaaataaggttataatcaataaagagagaagattttaaagttcagcaattaggtctgggactgcttctgcgcctgagacattgccaagatacaatgtaacactccatcccaccccatatgaatctccctgttccttcttgattcttacggggatagggtctgacagactagaatgaaatgaaagcagtagtgctgggaggggtggcaaggaccgaatttgtttaatacatttaggatggttttttattgctgctaaactagacacaattccttagcatgatgacattcaggaatcctttacaatctgattccaaagaactttctcttctatatcttaaactactgaaattgtagctctataaattccaaagggattgatgtaccaggacctttgacttatagtaaactgatcttaagggatgctgaaaaggtttggcactgctatcatgtggtctaatcatttagacttgtcactaccaactatttgcttaagagcctccaagacctttcacaatctggccccggcccacctctctacttttaataaaaaattttcccactgctgcttctttatatacggtgacagcctatttgctcttccctgaacatggcctgggacatctatgtctctgagtcagctaacggttcacacttgaatctcccaagcctagcatagtgtgtgaaacacagcacgacactccaatgtttgttgaataaatgctgtccgtctattttaggagacagagatgacagaagaaagttgttaaatcagtaaataaatagcaccagagagaggtcaaggaaaagttaattttagtgcattttaggagtgggggcaagatgagcttgaagattaggaaaactgatgctctttattcttgggtctagccaatgctatgagtcagttactttttcgggaacaagtttaaacctcaaggttaaatgaacacaaatgccctgtccatcagcatataatgaaaaagttgtggctatttccacatcagcacagtgaaattaaaatatgcagtgcctctctaagaggcatcacatatgacagagcttttaaaaatagtcccctttgccactcaggtatagaaagagctatagaaacaaaagcaaatgtttgaaaaactgagataatttagcttagggaagaaagagctgaggtgtgtctttatggttttttgactataagaaaagttgttacaaagaggataatgatcagcatttttgtcctagggcaaaatgacattaaaccgtccagtgcagaatttaagacttaaagatgaacattctaaatatgcaagtggtaaataatcaaatagattgctaagagcagttctgaaatttctttcttcctgactctcttaaaataggaaaaatcttcatctattttggataaaataaatgcagctctgcctccagtcaggagaatgaattcaataacttttctagtcttgtttaactctgtatgattctataaaattctataaaatgttcaccctaaaaattatacagaatcacaatacagttgagtaaaatacattctacagtttaaaaagaaataagcaatacagatagttgataagttattacattcaaaatagtaatatatggtgctcacgttttttattcaatttgccaagtgcatataacacaaataaaattgggaaaaatgtacttgaatctactaaggctttaacatagcgattatctagagtaaaacagtctaacaattaattctttcatgtctaagaaatttgctgaatatttcataaacctcatattgaatatgtatataaactcaatttccaattaaagaaaaagttttttgaaggtccagaaagtaatatatgaactcactattattatttcctggaccatcttcaaagacaacaggagaaccactaaacaattcctttaaatgaccaaaatgtgccccatatgattaagaatgtaaatctaataacagactcacagataaggtctaacaggggtggcaagttactggctttctttgtctatttaccttttagctttggagctcagcagaagtgtccattacatacagcacagggttagatgaacagctccaatgaccttgtctgaaccaaattcatttaaagcagtttgccacttttcttaaatagaagatgagtccattctatctatggcccagatttggactggatcactgaactattgcccaactcttataagcaaagcactaacatgtaccaatcaacaggcgaaggcatcaggaaggtaaaaatacacatacataagaaactggcagtagattaaagaagaaagctatatctaaagatggactttggcttttaaagcctttgagtgttattcgaatcttgttaacaaaaacaaaaacaaaatctgcattccaatgtaacttgtagagaagatccagtaaaaaaatgaattcaagagagagagagaaagaaatgtagttttattttgcaacccattatttccataagaacatgaatcaaagagtcagctatgccaatttcttcatagctgactagttataggatattgttctagtcttcactaatgacttcttgaggttggttattactgtgatcaggagttgggaggatagaggtctaagacctttcaaaagaaacgttttgtttagtatcactacagaaaataaagtcagcattaagctaactttgacaacctaactaggataatggttggtgcatgtagccattgcttatgctgcttcataatgaatggaacagtaaaggtgtcaagttaaccagcaacttgaattttgaaaagctgtggcacaataagctgataacataggttgttagaattagcaaaacttactttctgcttcccccaccttctagtcctacttatttccacatccacattcctatcaccaggcagttaaagaaacagaaacaaatgcggctgagactgcttctttggggatactcttagtgagctctccatctccccaaccacaacttgctctcagtttgctaaaaatatattcatttaattgttttaatgcctctacttaggggaatttgcattttcttaactgttgatacaagatctacattcagtttttttcacaggtaataagcaaagtatttggggagtgtgtgtgtgtgtggtggtggtggtggtggtggtggtggtggcaaattccgtcctagatgcttcgagttttccaagtatactgctaaaaggggtcatttgcttccccacctcaagaagccaattgtgcttatagttttacttcaaataaagatatatacctataaatgcacacatcatacgtgcacacacacatattcttcttctcaaaagtcataaacatttggtgactctctgtatactccatgaagtgctgttactactaaagtcagagtaatttaggcagaaacataagaaaccccaaatggtttgcactgaaattttattaacatatttgtcagtgttttcctcatggataatctccattggttcctggctccttgtcagcatatgctccaggagcctctcacaatatctttctgccctagaaatcctggcctgtgagatttccttgtaaatatctgaattcttgtattcacctattaatgatccagggatcgaggatgttttctatctgctccttaacctcccacttcaaggattagattgtaaacaacctagtgggaacccttcaggccaaaccacagctgaacgaatctcagcaggcagggaacccgcagcagtctgtgaaataccgtgaaacacaattacgaaaatataaagtattcacccatactttggggaagaaattatgttgtttccaagatgagacctcaaaaataaggctagtatcctaattgagaaagacatgattttaaaaagtgtcagcagaggtaaatttttaaaagtaccagatttgccaggtccttctcaaaccatagattcattttcagtatatgacagtggcctgagccgacacttcaagggaagtccattcatctctgaccaatgaagcccaaagtactcactgcatgaaagggttcctttcttgtttccaaaggcaatcaatttttgtcctagagtctgaaggttcatgggctttcttttaattttgtcagtctgcacatgcatggttcctcctgcatgatttggtctggaggaagtgacccacccacaacgccacagagctaattaaccccacactgagcttttttttttttctcatttcacacatccactcaatgctttaaatgacccagcagcagcatgatcatatgatttcttccccctcagtgaggaaagcatggtgatgggaggagcagggatatatctgccctaatcaaaacagcagtgtgatcctaaaatattatctaattgcattgcatccgagggtgcaaaatactaagaaatccctgaacgaatctctttcatgtcattcatttaacttcttgcagtgtccatttgaagtagcaaataatacataagaaacactgaggtagagaagtttgatctatactcagaatgtttaaaaaacatccgatcttacagggggtaaaagaccgagagctccttccctatcccgaatagcttcaagagaagggccttttttccatttgaaggaacagactcatgtttttccagatttattttttccaaagggaatgccttgaaaactctaagatgatcactgttttctaacttttcaaaaaagaaaaaaaaaagtgaacatgatggtggtgggtgatttaatggaatcagcttgtcaacatgatgaaactgaaaaaagcttttatagactctgtccacatgctaaaaaaaaaaaaaaaaggcaacctttaaagttatgtgtatagtatagagtggtttttgtcatggcaaagaaaagaaatataattatcttatgcagtaaatgtaaggctctgctaagaatctcattggataaatcatagaaatacatcctggccagataaatggagccagacaagttctaggtcttgtaagaagctttcaaaagaatcatcatattgtaagtctgtcatctctgtaagtgacaagaaaaattctaggctatttccctcggttctactagtaacatggcttcagagttttaaagatttagacttaaatggacaagaaaatgacttctgaatatcccatcttaggcaaactatcggatttctctcattcttacaagtaagtgtagcaaattggttcaccttggaaggacttggttagagatcatatatgtcttatgtgaacttttaacctctctttcctttgcaaagtgatttatgcatacactattaaatacacaggaattctataattcttagttcagtgaacagttagtacaagggaaaatctatctaatattttaaatttttgtttagtgtcttaaatcctacactttagaactggagaccttatagataagttctataaggtcttcagtgtgctgaaaaacacatttgctactgctccctaagcttctcttaggtaaggctgccaactggggtaaattgatggataaaactagctcaataggcaaaaaacaaaggtccagtgaagcacagtttatttttatttatactggtcagaaatatcacagttaacaaatagcctaaatcaagctcttatatctagggctccagcctttggctgaagtgtctcatctggtaattctgaaaaaaatagggttgttgtgatttcaaagactctcctgcccagtagactttttcaggctcactgatgcttaggattctaaagcctttactatggtctgttagaccaatacagtatgtcccttactatttctctgacttcatctcctaacattttcatgcaaaattggtccaacagacaataaaatagacagggataggaatatgaatggggactaaaaggaactaattaataaaaattagttgctttatgtccttgttaaatatcaactctttcatgacagcctaataaagtttctgaacttatcttgagagttggttaagataggggagaatatacaaagtatttccaacaccatgcattcattcattaattcaacaaatagttttcccgagtctattattgattactctgccaactggattctacttctgccctcaaggaccttccactctaatgtatgttttggagagtttctgtctctattatcactgacaggttattagcccactttagacaagttataaatataaccacctgccatgatgattcctcttcttgttctttatttgtttttattcatttgccctgtaacatccattaacctttcatgaatgacctgatcctttgtgagctatactatcaacacagctaatttttatataaatgagaaaccccttctccactcccaactaacttttctttctcaaacagccatgaaaatataaaagtctacccagaattatttaagtttttgaaatgagtccttacaatctgatctgaagcaccatttttttcctttcttttttgaaagagggaatggagcctcagcccctaagatacatatctcaagttacaggcaaattacacacaagttactggtctcccagacgtagtactcactactctctggggtagaacaatttctgcattgaacagaggaccataatctagctcaagtaatctcaatctcagagaacagttaaccaagtgcatatttctggtccctatattctcttataaggagttaccctctccactatattttggtattttctgaacctggctaccttaggtaaatgacagtggacatggtaaaaagaacactaactcttcctcaatttgttaaacttgtttttcctcctcatatgctttataaacaaaaatgggagaatttaatgtatgtatagagcagcaaatgttctctctgttgctttcagacatttttatcttatataaacagtggtgatgaaattataaataccattattccacctctatgttaatactcttattatcttgcatcaacagacgtgaacaaatacgtacatgacaccaatcaatcccttttctaaaaatgcagtttttgtatttctaaacagtggaggaagaattttatgaattcaacatgtagtttacctatttatattttgaattttaataaagtaaaaccaaattatcgcttatgttctttcacacttacatcagccattaacactctccatgctggcatggggtagggggtgtgtagaactaatggcaatgggtccaagtcccctgggtcaggtggttaggggcttggcaggctggagaggatgtttagatgctggggcaggatatttcaacctgcttgacaggtaagagatattttctggcagtaagaggaatattttttatggaacaaattgctagggagaggtcattttggggcactaggtgagagaaatatcaaaaccaaacctaaaagcagtctaagggaactcgggaaaagaaaatcactactttttcaatctcctcactggtttcccttattccatagtgtgccttctccttccatcttctagcacttcatactcttttctcctccatttcttcaggttttctttctcctacctctttattataacaaaaaaaagcatttaggaagaattctaggagacagggagacaaaaaaaaaaaagaatttagagaagacataataacatactgcataaatatgtatgtatgtatgtatgtgtttatgtatgtgtatatgtatgtatatataacagatattcgatttaccaagaaggataaactgggacttttgagatttaaaaaattcatggtatgtctggtcatattaatctccaaaccagcttgtttttagcattgctagagctataacagaatcaggagtagaaaacaaaaggaaaaaaataaaatttaacaaaggatttatatttgcaaaggaaagaggacttatttagagttgtttattgaaattcccccaaagctattttttgaacttatatattgacaacatcaagagaaggagcttaggaattctcatagggtttaggaactactaaaccttgtatattatgttcatctcagtccactcaagcaagtaaaggataactagaggatggtatctcacagtgcataacatggttggttactttgctaggctgacatatggagacagggcccataggagcagagcttttcttacgaataccagagagagacacccaggttcatctaaatgtatagggcatgagggattagtggtacagtgttatctgcaaagtacctaaaagtgttttctaaacaagcactaacttcttagcccagtcttcttggggattaaacaaaatccaatagtaagtaatggggaatactttatttggtcactgggttggggagggttgctgagacatatgacaacattcaatccattaagataggaggaaatgaggagaaagagaaaacaaagaaagggagagcgagggccagaaaagaagagtgtcacctctgtagactctctaacagaataaatcgataatcttaagaaaagtaaaagagcatgcctagagggaaacctcagcacacttttggaatccaaggcaaaaaataaaacaatttgcttcttgtcaagtttattgccattgacccatgggaggttcctatttattctgctcttacatgcacaggtatttcttctactcttacattcttttcctaaggattagcattctgtgataatggtggtaatgacagctgccttaaattagtggcaagttaggaatgaaacactgaccaccaggctatgttcttgaatccagtctatgccctgtaatgtgttcattctactttctgcattttctctgagacctgtcgcataagacttgttttgtaaggccgggctccttacggggacacatatggctccagaaaacaagtactctactttctcaccctgactttttggttttcttgttttttcctcttttctcccagactattattttccagtttcttctctaccagtctggacgcccatggttgttaactttagagatacccaccagctccatcaattccctcatctacagttctcaactgtatttacctagttctggagctcagatgaacccacatgtatgttctcctcagcttccaggctgctgatccttgctggagaaaaagcacaaaactgtacagcttgatgctcctgcagaattacggtttccagcataagttcgaatttcagaattagtttgcaattttaaaatttgctcctagtcagtttcctttttcactccacagtttcattcattactctatttaactggttataacccatcccctacccttcactctcagctagtaaccttgcctccttttgcatagagaaaacagaggccatcaaatggcacttcctatcactccacctttgccaccaatgaatccgcctgtaacatttcagagatctttctgcctagcactgataacctcatccaggatcttattatatcagttacttttcctttcttttgtattttcaattttcctactgcctgccaacatgctttagctgtcttcatttaaggtaacaacaataacaatgataataaactaacaaacaacaaaccatcttttgcagactttatctttccctcttttgtgccaccttcaagcttcctaagctcccgtttattcctcaaaccattacaatctggtttctctagctgtgtttctaattaaacaatttttttttttttttttgccaaagtcaccaaacacttctgaattgttagcttccaaaatccattcttcaacctcattgttttctttcttttaaaggtcaggttcactgaggtataatttacatacaataaaattcatccttgctatactcatttaccattcaataagttttgccttatatgttggaggcctgtaaaatgaagcccaacccccaagccgctttgcttcatatacaaatccctttggcacctctcagcagtcttccccacataacccattgtctggtgacaccacactactcagcattcaaggatatatgccatgtacattcatgccccttgtactttctttatgtttcctctctataaacatatatgtcttggtataacacagtaaatgctatttaatattaccacatcaatttccatatagaatcataaatctatacgttattttgagaagctgaggttttccaaatagaagtcatccatcaaaatgctactacctgaagatctctattattttagtattatgggttgattatgttcccttaaaattcatatgttgacattctggcccccaattctttagaatatgaatagatgtgtgaatagggtcattgaagatgtgattaagatgaggtcatgctgtagagtgggcctgcaatccaatatgactagtgtacttataaaaaagagaaacttaaacacagacatgcacacagggagaacatcatgtgacgatgacggcagagattggggctgatgcttctataagccaaggaacaccaaagattgccaggaaaccaccagaagctgggtgggagtcacggaactcacagccttagaaggagccgaccctgttgatactttaatcttgaacatctagcttctataactgtgagacaaaaaatttctgttgtttaagccactcagtttgtggtagttcgttacaaagccccagaaaactgatatactcagtaaaagaaaaaatcttcagtatattggaatcagttctttcactcatcaggtacttactgagtgcctactatgtgctaggaactgctctaggatattgaatgaatgactaagaacttcatcacgttactgcattttttgttcactaataagtaatcaatctatcaatcaatatattaatagatgaaatgcctatcatttattttatcagcaaacatttgttgagtatctcctatgtgtcagacatcgttctaggcacagaggataacattattggcagatcaagttctccaccttgtatagtttaaattccagtagagggaacatatattaaacaagaaaataagtaaataagatatgtaattttactctgtttctgacactgagagtcataggcatttatcctctaaatcactgaacaaagcttggaactagatagcgaacatgttacttcacagtttacaaagtaataaggaagacaatgaggtctcatactagaggcacgttaaaccacaggcagtgtgcaggcttaaagtgtttgggaaggacatcccaaaagctaggtttcttagtcagttcgtcagtcaatcaacacatatttcttttttttttttttgaccaaatttctctctgttgcccaggctgaagtgctgtgacacgatctcggctcactgcaccctctgcctcccgggttcaagcaattctctgcctcagcctccctagtagctgggattacaggcacctgctaccatgcccggctaatttttgtatttttagtagagatgggatttcaccatcttggccaggttggtcttgaattcctgacctcatgatccacccgcctcggcctcccaaagtgctaggattacaggtgtgagccactgcacccagccatttgacatgtattttttaagcgcttactgtataccaggccctatgctgaagatagtagaactgtggacagagccaacatggtactattacccactgagctcacattctaaggggaaaaatttgaacaacaaatctcacagtccgttctttatcatatatcctcataagaatacataaagggggttaggagatcacctgggtcagaggactggcccatgaggggtttccaaggggccttccttgaagatgtggtgcccggacactgctttagggctggggtatgggtattggtttgagcagggtcatgaagttttcggtttcttcttcctcatcccctttcaaccatgtacacacatttcaaatacttaaaagcattcttcaaatatactaagaacaccaagaactaaacacaagagaaggactctccagaggaaaggggccaaaaatagaagagaaaaaaaacccctaatctcaccatttgttttgaaaacacccaaaatgattaaaacatattataaactaaaacatatgaactaatcacttgccaagtttcatttttaaatcaaagccgttttgaggttcataaactgaaaaaagaatcttcaaatatgaacttgtgtttttcttttcttggccctcagttggcttgaagcatttgctgttatgctgtgtggagggaaggggaacctgctagttaggaacatgtggcatgcatgtactagaaggtaagctccacaagatcatgactcttcacagtggtatccctggtaagtagaagagtgcctgaaagataacaggggctcaataaatacctgctgaatgatcaactagtgaatattctgggccctttaagggattctccaactctcttttcttacccaagctgcatcttgctttaggccagtggttctcaacctggggctaatttttgcccccagtcaggggatatctgtattttttgttgtcacagttagagaagttcctactggcatttagagggtagatgccagggacgctgctaaacatcttacagtgcacaggacagccctgttccacagagatttatctggccccaaaggttaatagggccaaagttatgaaactctgatttatgccctttgtttctattgggctgtacctgggagtcagatcctctgcatatttggaatgaagttcagtcctaaaggaagcaccccagaaaagcctcattgcttcatcctcattcccttcaagacctaatagaactgcccccactctaaggcaggctcagagagagccaattttgccttttgtcctccctgggtcaacaatgcaattgctagggaaatcatctgaaaaagtctgtctctacaatgcaagtaaataatttttacagtacattggtaatttccctgagcttacctaagcatatatactaatttagtaaaattctcttgtttacaaactagtcatgtatctgcaggaaaaaaaaatctcctcaagttcaaccagtttatccatgtctgctcaggatcagtacatgactctagctttattcatgataaataagatcaacttcaagaattccatcaaaccccagtaatgtgcctttagagagactgggcttatagcatttcctctgccaccctccttgccctgcatattaaaatacaggtatctgattccagtttcaatggggaaacttctgtcgtgccagaggagggcatgcgctgatttccccactctgatggttgctctagtaatcttggtgttgtggcatgtttcccagttaccatagagactgcatacactaagactgcagcattgtgattggtgggaaagatacattttgcagaagcttttctggagagataaaggtaagacacgagaaagaaagtgagactgccaataaaggggcagagcacagagaagtcccaaacaaccatacattctagaaaactgggacagcagagattacaactactgctataaaactacataaactgttcactcaatggctgcctgtcaggaaaatttcaagtattgtcagacagaacagacacaagatattctagaataaaaaggtaaacaagtaaacctactgaggttataggggtgacaaaagggaaatggcaagaaaacatttaaaaatgattcaatgctagaaaaaaaaaagaatctcagagagcaataaaatttaaagttacatttaactttaaatgtaggctgacctttggggaattatttaaattctgagtacctctgcttccttccctatgaaaaagaaaaagaaaaaaagaataaagatggaaatagaaagaataaagatgacttctctctcactgtttaacaggagtctctttaaatatctcaataatttgacattatatcagttgaatatgatgtaccccccacacaaaaatcagacaaaaacacttaaagggggtgataaatagggggacgtcattaacaatgcaaattgactcattccatagtttcttagagtaatgagtcaactgactacgtgatctcatgtacataattttgttcggcatgagattttgaggtatacaattactacagaaatcaaggtatacctgcaatgtaaagggtaaatcgtaggcattttaaatgaaagctggggataggatgtgtgttggtttgagggatgagtgggagtggatttaagagaaaatcagtctaggaaaatatcacataagtgtttgtaagttccttgatattcaggtctgtatcttgtaatgctttattaaacatatttcagactaatatgtccattgcctactggacattcatatctccctgtttttaaatacctttcaaatctgtatcttgagccattacttatctcttgacctctaaccctttatatcaaatgaattactagacaattacaattagatattccaaaagcatcctaaattcaacatgtcaaagctgaactcatcttttccttcaaactttctcttcctcctatgttccctatgtgagtaaatattaatagtattaccattcacccatctgccaaagttccatacctaggaagaatcatggttgcttttatctcaccttcaaataatcacccgtgcatatagatgtgcaatcctaataaccaaaggaggccttttttgaatagaaagcaatatttacagttaattgggttttgaactaatattaatttattaaacttacaaattttaaaagcctagttttctttacacctttacctgttaaaaacacacatatatttttctatgtcttaatatagcaatttttgcataaaataagaaaaattactttcaggaagggtgagattactagacaaaaaaatttgggacctcaaactatttcaactgtcagtcagaatgttaaaagaatgagagttagggtctgatctgggaacacctttcaaatgattttgccaaggtcaccagtagacacactgaatgtttttatagtcactctgaaaatgagaaattttacgtctataccctacaaaggaaaatttacaatccaggtcctctatgtttaagtttcattcttatctaactcttttataatcactttccactttatagcctgataaaggtagacaatattttgtgtctccactaaccaggtttcttgaatctagtgccctttcacttcataacgtttttcacatttctacctctctcatccccattgcaccacattagctcagagcatcattatctgtcacttgtaatattgcgacagtacattgtactatattttcttaagtttctgagtctttgcacatgtcaccacctgtgtctagaacacccatattccctgataaacatttactgaatgaaaaaaaagttaataaatgctttggatgttgctgctttgggtgctgaacagaaatagtggcctatctaagattctggataagcctgcataaagcactcttactttcaaaattaattttgaagaataagaaaattttgccatggagaatcatggagcctatgccacaatattatgttttgcatttaataaaacacctccaaacccagggaaagaatcagttattacttccttcaattcatacaacgaatatttactgaacactctctatgtgccaggctctgtactaggcactgaggatttcttagagcatagaacaggcaaaaaacaaacaaacaaaaccgaaaaaaacctcacaatcatggggcttatattccatggcaagaggaaataaatgtgtaaataaaatatatattttgtctgaaggcagtaggtgctatgaaccaaaaggggtggaaagctaaatgttaaatacagtggttatgaaaggccttacttagaagtgaaaattgagcaaagacctgaagatgataagcaaacaagccttatctggggaaaacatttaaggcggtcagaaaagcaagtgcaaatgtgaaatcatgcatggtaggctggaggttaggaagggggtcaatgaaggttgaggggagtgagctagggtggagcgctaaatgaagacagagaggtaatggggaaattgaatatggagggtcttgtgaactactgcaaaggcttttcttccaagtgagatgttgagccattagagagttctgagcagagaagtgatgtggtctgactgaaattacattacatatattgcaaagcatcactctggctatcattttgagaatagactgtaagtggtaaggccagaagcagggaagacaattaggaggctactgcaataatccgggtaagaaatgatagttgcttggattagggtagtagtggtgatgaggatgaggagtggtaagattctggacttattctgaaggtagagctgcaggatttgttcaatggttgggtttgtgagagaaatacaggtctgggagagaaataaatttttgatttgagtaaccctaaaggtggagcgttatttaccaatattggggaggctatgtatttgcttggtaaaataaggaattccatttctggtatgtcaagtttgagatgctcattagacagacgtggagatgttgaataggcagctgaatatgtgagcctagaattctgtgtaaaggcctggactagagatacaagcttgcaccataagcttgggtgcaaatattaagagagtgaatggagctgaagagaagagcttcaaagattgagctctagggccctctaatgtttacctgcttgggaaatgagaatatgctagcaaaagagactgaggaggagtagactgtgaggcaggaaaaaaatcaggagagtgtggtggactgaacgccaagcgaagaaagtgttttaatggagaatgaataatgggccatgtaaaacaattctgagacatcaggaaagacaaagactgccgaatggttaatggatttagcaacatggaagtcattggtgaccttagcatcaacagttttactagactggtaggtgcaaaagctaactagaggggcaaaagagaaccagagcataggattggagagtgtttatagtgactatacgcatttcttgagaagttttgctgtaatggaaatcaaagaaatgggacaggagctgctagggagtatggtttataagggtatttttaggatgagataaattatgtgtttgtatactgataggaaagttttgatagaaagagaaaatttgataaaacagaagaaagatgtgagctttttcaggagcactgtttatgcatgtgcaagaggagagagattctaaggcacaatgagggatgggctgagccaagggtacacagagtttatccatagttgcaggagagaaggcaaaatacatgggtacagataaatatgggagggtaggtgtgctggacagcaagtatttgtgaagttgtcttttgatggtttctattttttcagtgaagtaaaaagaaaggttctaagttgagcgtaaggatgggggaggaggtgttagaaatttgagagagggaaaaatatgaaatattcttgtacagatatggaagagtaaatgacaaggaaacatattatatttgctgggcagcattaacggcctccttgagggatcatgaatttaaactgagagtcatacatttgcttgtgtgtttttctccagccacattcagctggcacacaggcatgaaatagatggcgagttgcatatgatcagtatagttgagatttgtcaagagagcacagttaagtcagagaaggtcaatggtgttaaaggcgcatacaaggaaatgattaaaatcattgtccatggaatctacgctatataatgaagtgagcatatgagaagctatgggtaaaatcaatgaattaggggtcctagtgggtttaaggaattggtgtattaggggtaacaaagggattgaactaccaagacattaggctgtggttggaaaatggaatgcttgaaattgagattgtggaatattgtaattattagtaattaaaacatcagaaatgtagccatgggaatgagtagctatggcagagtggagaatcaatcatgagaagttcaagaaattgagaggaggtattagagggagcgtgtatttacacagtgaataaccaataattgtaatggggtagaaatggaaagagtgttagtgagctaggggctaacgttttcaaggaattgggaaacttgcctggtagacaactgcatcaagggggagttatgggaacacttagcttttctactacctcctcaatgtttcctctctctcactttccatctttccagcttatatactggcattacaaactttaatttcctagactagatagctacatatcacctgtgtctaccctttctcctccctatccaaattatctccaagtcttgagaatttccaatttttttttctgagatggagtctcactctgttgcccaggctggagtgcacagtcatgccatctcagctcactacaacttccgcctctcaggttcaagcgattcccctgccgcggtctcttgagtagctgagattacaggcacgcaccaccacacccggctaatttttgtattttagtagagacgaggtttcactatgttggccaggctggtctcgaactcctgacctcaaacaatccacctgccttggcctcccaaaatgttgggattacaggcatgagccactgtgcctggcctccaattttgaatactctctactctccccctttgggaccatcactactctagcctgtcactctctattttatcactcagattaatgttcttcatggcactaatcgctctctaaacttaacttgttcatttatttgtttgctttttttgttggggggggtgtctattttccttcattaaatataaatttcataaggggaaaagttttgtttaatttgtgcctggaacataatatgccctcaataaatactttcaggatgaattaataaatgccccctataacatgctgatgaatccttatattcttgggttcacacaacagctttgctttactatcctaccagcttctccctcctttcctgctcaaaccatccatttcaccgagtaaagtcatttcactactcccccaaaacaccatgttcatttctattcagatgatttcatcatatttctcccttgtttatgtctattccccacataccaattctttgagtcccagcttaggtcttacttctcggatggtttttctatgattaccatgaggcctgctgatttctccctcctctaaaatcctgctatccctaacaacaccagctgctttatattttctaattgtttcatatgggttattcttaccttttcactttaaaataggtttatttttggcctaaggatcctgacttacaactacagtatactcagtaaaaactaacacagtgtagggcagataacgggtattcaaaaaatactatggcctccttagatagcttcatagacttccatcttcctcaacaaacattttctaccttttaccctgctgttagctaaatctaactattcttcctgctctatgatactgtctttgagaccagaaccaacccctatgtccactacacagaattctacactcttgcactgcaattcccacagctaaatcattgtcattgccattattgttcctggattctcttggcaattttagtatattcaaggcatagctgccaagatcatcatcctccttgattgtttggaatctttatttttttaaatccctgcattttttccatcaaactttaagtgttcctgtgggatttgtttttccttggctccatccttggcctggttcttctccactttcttatgttcagtcactcgatttgccctttgtctcatttgaaggaatcagctttcacaccttcttttaaactaccttgcatatttagaatattttctcaaataatataaaatttataatatttatgaataaatgacacaatgccaagatattctgtctcttctttcaaataacatctgaagatgcacctgcactagtgagttctatatttaagatattgaataagtatcattcacccatctgctttcattctgtcctgcattttttaggacctgcttcagagttgtattttgaggtcttttggacggggaactgtctggcatagttcacaaactggcctttgctctgtatattcatgttcctttgataaataataaataataataatagcccactgtgcatttttacattccactcataaatccctggaaaaagaaaaactaacaaccagggattataatagaaacacagaaacaaaactaaccttttaccaggttttgctacagtaatatatacttccatagacctatattctaacaaataattacctgcttaagtcatttgtaaattgttcctttgccaacattatgtataatagcaaatgtctacgtggtttataggacagggaaaacaactagaacattacagctatgtgggggatcagtgcaaaagcagcaaaataagaggtttactctgttgggtgcacagtttggaagaattagtctcacaagtagaactacttgacagaatatatgcctgctctccagctcccccttctcccctcctccagatcttttttcaataatggaagaagacttactttcttttttcaaatccaggtgggaagtgtatcattttgcgtgaaaaatctgtttttctttgaacataacaaatggtctgattgaagctgctctatgaaaacggcagcatatctaaccagggaggtgggaactatagtttaatgggtggagcacctccatatttagctgcagatgagccacatttaactttaaaaaaaataaaaatttaaaaaataaaagaaggccaaaatgtaatgattgtcttgttactgcagtggccactagatggcaggtccaaaaatctgatgggagtctcacaggagggcaaatcttagggagcagaatgtttctggcactcaatccagtgttggttcatcaataagccttggcagtttgctaaaatatcaggtgggtaagacaatatccatgttatttcacagggctgaagggggcaggaagccctttggtatctaggtttgtagagtattgtcatcacatactcacacatccagatactgctacccctttggacttctgtccacagacattcttggagctggtttttatatatgttcagctgtattccattatctaatggtctgtgcaatactgagccataatctcaggagtgtaaaaggtagttgtctaatctgcctccatggaaacaaatgaaggaggctgtcaggctagggtaagggaacatacagctgtactgtatttaacaacatatatttaccagtaattgcaacttcatgttaaatatgtgtatttcctatactggaggctgaccatatattcatgttaattgttttgaaaaagagaatgttgatatataagagacttattatttaataggataaaataactaaggcctatgattaaaaatgaaatgagtaaatttagaacaaattatttgttgtacacagtagagttttcattttcttttactaggatgggagacttctagatgtgggtcttatgagactataaaaaagtcattcttggaccaattattctgaagatagattgtgtctttcccttcataatttttttttttttttggttactagattatcctgataaaagtgatttcactacatggacaatgcctacttttctttatcttttaattaaagaactgaccttatgatttttaaaagtagagaatcacaagctctgagataatttatcattctcactaaagaaaatgtgctctagagtcaaatttatctttgtacaagagctgtgacatgcattttgatatacatttaagcatctatgtcaattaaaatattataaaaataaaagcaacaaaaactcaattatagccatgcaactcagtcatcactcaccttttgttccctttttctttgaaaatttagatagaataatggtaaacatgttgatttcatctattcttgctctgtatatttggactgtgaaatgtctacatgagacacaggaagagggcacgggtcttcaggataaaaaacaaaaaaaaatttttcctaaagaagaaatatgggctatattgaattatgatagatgttttaaatcagtaccgttttcctttagtttggagtaaaatttaaaatgagatgactgaaataatttacgataaaatatcatggttatttctacatatttaaggtttaaaaatgctcaaacttatactttcctcatagaaagagcactggaatgggaaactgagaggtctgggttctattctggctttgacagtgactcactgtgtgacatccagagagcatgacctccccaggctcctcacttctgaaatgggagggttttgaggacaaagtctctctctgctttaacattcaatatccaagtaagtaaattgctacgtattgcagatttttttttcctcagaaatagactaatttcctccgatgaaagaataatactgttaagaagctgatgttgaaagctaacatgtccctaccaacactgtgggctctacccatgcaggtgaagctagagcttgttcttccttcaatcccccctttccctattctgcaccactcttccacacactcccccatcatctttaagtctaaattctacctgagaggtcctctgtgacccctaggtagttacttgctaattattactaattattcaataactgttttacttttcctcttgagcacatagctaagttccatttcccagccttctctgcagatagctatggccctgtgaccaaattctggtgagtgggatgttggtggaagtgacatacgctgtcccaggcctggtccattaaaagttcctgtgtaatcattgctctctcttcaccagatttctggctggatgtcacacccacagcaatcttggaagctatgtactgaagagcctctgtcaacctgggtccctgaccagtctttacatgagcaagagagaaactcatgttgaaatactgagatttgggagtgtgcgtattatagaagctaatgttaccttaactaagaacactcctaaagcagaaatttgttctctctccgagacattatgtctcttttaccacattttccacctttaataatttatttactgatatgtaagctccttgaggatagtacatttgtttcactagtgtacccacagaactctagttagttgaatgaattcagaatagaacatagctggtttggaaagtacagaagttacagaaggtagtaaaagcagtttgatttttaaaaattctagctttgtgttttatcctataatatttaggtagaaggtagggatgatgggttggggttttgttggtgtggaaatgtattgtgacaaccacagccttttaatatattttgtgtactgcatccccaataaacatgttttccaaataaagtgtaaagtctttttctaaatgctgtatggcttgccttttttatatatttgtgtaaagaaattcgtagtagtaattctctgacactgagttaaaggaagtcctattttttttcacaattatgtgaaaacacaattatgtgctgtataatgacattttagtctacaatggaccacatatctgactgtggtcctgcaagattataagataactgaaaaattcctaatgcctagtgatgtcatagtgatcataacatcacagcacaattactttttaaaacataaatttagtgtagcctaaatgtacagtgcttataaagtctacaggagtatacagtaatgtcctaggtgttcacattcactcatcactcactcattcactcacccagagtaacttctagttctgcaagatccattcattgtaagtgccctataaaggcatacacttttgatcttttatgctgtgtttgtactgtaccttttcaatgtttagatatgtttagatacatgaaaacttaccattctgttataattacttacagtatccagtacagtaacatgctgtgcaggtttgaagcctaaaagcaataggctatatcatatagcctaggtgtgtagtaagctctatcatctaggtttgtgtaagtacactctatattgttcacacaacgatgaaattgcctaatgatgcatttctcagaatgtattccctttgttgagcaatgtgtgactacattttgaaaagttaaaataatactaaagggagggacaagtgaagagctaacttgagaaatctaagaactaggtaatttaaaagaagtgcttttagttacatagggtttttaacatcattaccacctatgaaattacaggtattaactactgtctcaaaatgatcatcgcccttttgatactttactctcagtgtcatggctgacctcttttgagtcaagtttattggacattttcagttttattttttaattctcatcactgcccctccctgaaatacttcatccctggtttccttaataatactggcctaatttccctattctctatctctagttttctctcctcttttgtttggctcctctttctcatctattctttaagtattagaatttcctagtgttctgctctgagtttttctttctctcataatttttccttgagtcatcttatctagtcttatggctttacctactacttcctcacaaataactcccgactcttgatctttagcccagacctttcttcggagcttcaaaacctgtattgcctatagtatcctgggcattttaagaaaatctaaatattttgtgccaccttaaattcaagtcccaaaccaaaagcactccttgccctttcaagtcaaaccttcttcctcctgtgttccagctcttggtagatgacatcaatttagaaacattaaactctccttttctttctttcttgtcccttatctaaattatctaattaagttctaaatcctgtagtgcttttatagtccatttgagattttagcctaagtttgaggactagataagtgaagacagattaaaaataagacttcttttaactcagtgtcagagaattactactatgaatttctttacacaaatatacaaaaaaggcaagacatacagcatttagaaaaagactttcatacccttccatcataccagagttccattatcagcctgaagagaaccaggagagctgtcctgagagggagctttctcacaatcaggactggattgaaacaaaatagaatcaatggaaagaaagatttttggggaggggagagaagttttgcttgctgctggtcctttggtaacctctgcaaaagaaaagtttaaaaaatgaccctggctggcaagatggccgaataggaacagctcccgtctgcagctcccagcaagatcaatccagaaggcaggtgatttctgcatttccaacagaggtacctggctcatctcattgggactggttagacagtgggtgcagcccacagagggcaagccaaagcagggtggggcatcgcttcacccaggaagcacacagggttggggaattccctccgttagccgagaaagccgcgagggactgtgccatgaggttcggtgtattccagcccagatactatgcttttctcaccgtcttcacaacctgcagaccaggagattcccttgggtgcctacaccacgagggccctgggtttcaagacaaaactgggcggccgtttgggcagacactgagctagctgcaggaattatttttcataccccagtggcacctgcaatgccagtgagacagaaccactcactaccctggaatgggggctgaagccagggagccaagtggtctagctcagtggatcccacccccatggagccaagcaagctaagatccactggcttgaaatccttgctgccagcacggcagtctgaagttgacctgggaccctcaagcttggtggggggaggggtgtccaccattactgaggcttaagtaggtggttttcccctcacagtgaaaacaaagccaccaggaagttcaaactgggtggagcccaccacagttcggcaaagccactgtagaaagactgcctctctagatttctcctctctgagcagggcatctctgaaagaaagttagcagccccagtcaggtgcttatagataaaactcccatctccctgggacagagcacctgggggaaggggcagctgtgggcgcagtttcagcagacttaaacgttcccacctgccagctctgaagagagcagcagatctcccatcacagagctcgagctctcctaagggacagattgcctcctcaagtgggtccctgacccccatgcctcctcactgggagacacctcccagcaggggtcaatagacagctcatacaggagagctctgggtggcatctggtgggtgcccctctgggatgaagcttccagaggaaggaaccggtagcattgtttgctgttctgtagcctctgctggtggtacccaggcaaacagggtctggagtggatgtccagcaaactccagcagacctgcagcagagatgccagactgttagaaggaaaactaacaaacagaaaggaatagcatcaacattaacaaaaaagatgtccacacaaaaaccccatccgaagatcaccagcgtcaaagaccaaaggtagataaatccacaaagatgaggaaaaaccagcttaaaaaggctgaaattccaaaaacccgaatgtcgtttctcctccaaaaaatcacaactcctcaccagcaagggaacaaaactggatggagaatgagtttgaggaattgacagaagtaggcttcagaaggtgggtaataacgaactcctctgagctaaaggagcatgttctaacccaatgcaagggagctaagaagcttgaaaaaaggttagaagaattgctaactagaataaccagtttagagaagaacataaattacctgctggaactgaaaaacatagcacgagaagttcatgaagcatacgcaagtaccaatagctgaatcaatcaagcagaagaaaggatatcagagatgaagatcaacttaatgaaataaagcatgaagacaaggttagagaaaaaagaatgaaaaggaatgaacaaacctccaagaaatatgggactatgtgaaaagaccaaacctacgtttcattggtgtacctgaaagtgatagggagaatggaaccaagttggaaaattcttcaggatattatccaggagagcttccccagcctagcaagacaggccaacattcaaattcaggaaatacagagaacaccacaaagatgttcctcaagaagagcaaccccaagacacataatcgtcagattcaccaagattgaaatgaaggaaaaaatgttaagggcagccagagagaaaggtcaggttacccacaaagggaagtccatcagactaacaacagatctctctgcagaaaccctacaggccagaagagagtgggggccaatattcaacattcttaaagaaaagaattttcaacccagaatttcatatccagccaaactaagcttcaaaagcaaaggagaattaaaatccttgatggacaagaaaatgctgagagattttgtcaccactaggcctgccttacaacagctcctgaagaaagcactaaatatggaaaggaaaaaccggtaccagccactgcaaaaacacaccaaactgtaaagaccatcgacactatgaagaaactgcatcaactaatgggcaacattaccagctagcatcataatgacaggatcagattcacacataacagtgttaatcttaaatgtaaatgggctaaatgccccaattaaaagacacagactggaaaattggatagagtcaagacccatcagtgtgctgcatttaggagacccatctcacgtacaaagacacacataggctcaaaataaaggaatggaggaatatttaccaagcaaatggaaagcaaaaaaaaatgcaggggttgcaatcctagtctctgataaaacagattttaaaccaataaagatcaaaaaagacaatgaagggcattacgtaatggtaaagggatcaatgcaacaagaagagctaactgtcctaaatatacatgcacctaatacaggagcacccagattcataaagcgagttcttagagacctacaaagagactttgactcccacacaataatagtgggagactctaacagcccactgtcaatattagacagatcaatgagacagaaaattaacaaggatattcaggacttgaactcagccctgggaacaagtggaccaaatagacatctacagaactctccaccccaaattaacagaatatactttcttctcagcaccatatcacacttactctaaaactgaccgcataattggaagcaaatcactcctcagcaaatgtaaaagaatggaaatcataacaaacagtctctcagaccacagtgcaatcaaattagaactcaagattaagaaactcactcaaaaccacacaaccacatggaaactgaacaacctgctcctgaatgactactgggtaaacaacaaaattaaggcagaaataaataagttctttgaaaccaatgagaacaaagacataatgtaccagaatctctgggacacagctaaactaatatttagagggaaatttatagcactaaatgcccacaggagaaaacaggaaagatctaaaattgacactctaacatcacaattaaaagagctagagaagcaagagcacacaaattcaaaagctagcagaagagaagaaataactaagatcagagcagaactgaaggagatagagacatgaaaaacccttcaaaaaattgatgaatctaggagctgattttttgaaaagattaacaaagcagatagaccgctagccagactaatcaagaagaaaagagagaagaatcaaatagacacaataaaaaatgataaaggggatatcaccactgatcccacagaaatacaaactaccatcagagaatactataaacacctctatgcaaataaactagaaaatctagaagaaatggataaattcctggtcacataaaccctcccaagactaaaccaggaagaagtcaaatccctgaatagaccaataacaagttctgaaattgaggcagtagttaatagcctaccaaccaaaaaaagcccaggaccagacgaattcacagctgaattctatcagagatacaaagaggagctggtaccattccttctgaaactattccagatcatagaaaaagagggactcctccctaactctttttatgaggccagaatcatcctgataccaaaacctggcagagtcacaacaaaaaaaggagaatttaaggccaatatccctgatgaacattgatgtgaaaatcctcgataaaatactggcaaaccgaatccagcagcacagcaaaaagcttatccaccacgatcaagttggcttcatccctgggactcaatgatggttcaacatacacaaatcaataaatgtaatccattatataagcagtttagagccaatgacaaaagccacatgattatctcaatagatgcagaaaaggcctttgataaaattcaacaccgctttatgctaaaatctctcaataaactaggtattgatggaacgtatctcaaaataataagggctatttatgacaaatccacagccaataccatactgaatgggcaaatgctggacgcattccctctgaaaactagcacaagacaaggatgccttctctcaccactcctatttaacacagtattggaagttttggccagggcaatcagacaagagaaataaataaagggtattcaaataggaagagaggaagtcaaattgtctgtttgcagatgacatgattgtgtattcagaaaactccatcatctcagctcaaaatctccttaagctgataagcaacttcagcaaagtctcaggatacaaaatccatgtgcaaaaatcacaagtattcctatacaccaataacagagagccaaatcatgagtgaacttccattcataattgccataaagagaataaaatacctaggaatacaacttacaggggatgtgaaggacctcttcaaagagaactacaaaccactgctcaaggaaataagagaggacacaaacaaatggaaaaacattccatgctcatggataggaagaatcaatatcgtgaaaatggccatactgcccaaagtaatttatagattcaatgctatccccatcaagctaccattgattttcttcacagaattagaaaaaaacaattttaaatttcatatggaatcaaaaaagaacccatatagccaagacaatcctaagcctaaagaacaaagctggaggcatcacgctacctgacttcaaactatgctagaaggctactgttaccaaaacggcatggtactggtaccaaaacagatatatagaccaatggaacagaaagaggcctccaaaataacaccacacatctacaaccatctgatctttgacaaacctgacaaaaacaagaaaaggggaaaagattccctatttaataaatggtgttgggaaaactggctagccctatgcagaaaaccgaaactggaccccttccttacaccttatacaaaaattaactcaagatggattaaagacctaaatgtaagacctcaaaccataaaaaccctagaagaaaacgtaggcgataccattcaggacatagtcatgggcaaagacttcatgactaaaacaccaaaagcaatggcaaaaaacccaaaactgacaaatgggatctaattaaactaaagagcttctgcacagcaaaagaaactatcatcagagtgaacaggcaacctacagaatgggagaacatttttgcaatctattcatctaacaaagggctaatatccagaatcaacaaggaatttaaacaaatttacaagaaaaaaacaaaccccatcaaaaagtgggtgaaggataagagcagacacttctcaaaagaagacatttatgtggtcaacgaacatatgaaaaaaagctcatgatcactggtcattagagaaatgcaaatcaaaatcacaatgagataccatctcacgccagttagaatggcgatcattaaaaagttaggaaacaacagatgctggagaggatgtggagaaataggaacgcttttacactgttggtgggagtgtaaattagttcaaccattctggaagacagcgtggcaattcatcaaggatctagaaccaaaaataccatttgacccagcgatcccattactgagtacatacccaaagtattagaaatcattctactataaagacacatgcacatgtatgtttattgcagcactattcacagtggtaaagacttggaaccaagccaaatgcccatcaatgatagactggataaagaaaatgtggcatatacacaacatggaatactatgcagccattaaaaaaggatgagttcatttcctttgcaggacatgaaactggaaaccatcgttctcagtaaactaacacagaaacaggaaaccaaacactgcatgttctcactcataagtgagagttgaacaataagaacacatggacatagggaggggaatgtcacacactggggcctgttggtggctggggggctaggggagggatagcattaggagaaatacctaatgtagatgacaggttgatacgtgcagcaaaccaccatggcatgtgtatacctatgtaacaaacctgcatgttctgcacatatatcccagaacttaaaagtataataataataaaaaaaagatctaatggctaaacctatagaaactctagctagacctgtggtttctattccttcctgggtataataataaaggctcacatttattttaagtgttacatttttcattgacattgaaatgagactcccttttcgactaatcggctgctttgatttcttcaccctaaaaatcactcttcaatgttttccacaattcttcaacattagtaataacttcctatatagtatctgtggtcctttttctttccccagtgtgatatatttatcatctattacacaaacttcctcttttgcttcctcccttttcaccaccagctctaacatcttaaattttcatttgacatactgcttacctaaattatttcatgtgtgttcccatccatggaaattcatttttgtgtgacataaatccctaccctactctatttcacagtaataaaactttatactgaattgccaaagagataggtaaccaaccacgcagtttaaattaagtgcaagatacacatgtttgaatattctgctctctgtctaagatgtgtagagacaggtcctgtttgtgtctgagcattctgtcatcttattcaaactgttggagttaaatcacctaagaactgttttctcactttgattcaaaagtaacttctgctatgcaaaaaaagcacagttatgaaataatatgtgtattaaaaaatctcaaaaataatgattagagtcacattcagtctgtgaaaggagtagctccatgacttgagcacatgccaatgagattagaactcatcgggggttggcattctcattgattgttgtccctctgtaccttcaatggtttccagtccttgtccaagttaacctttgctagttgttgtagccatggtaaatatcctgtttattggattttattagcgttttaaattttgacatttggaaaagcacaatcctccttctttttcatcctgtcatctttagtgtataagtgtccaggctccttccaattttaagtttctctttcctagctttagaagattataattttggaaagtcacaattattctgctagttggtggccagaacatatcaattgcatgtaacaaaattttattcagatgcatcattcatacattttaagtctcacggtttacttctttcataattatttgacatttttggtgaaataagtttagttctgaatcacccattttgttatgttgattctccactatttttggcgatacaatagtaataatgttagacatttgtatagcagtgtaaagttttcaaagtgcttccacatacacagctcttatttgcttctctaccttaggacataagcaatgtggtgttatacccattttacagataaagaaacacaggaacagagtattactttggatcacacatggtaagcctcgaggacagaatgagctcctgtgctagtgttctttccattgcatcgtatcattagtaatgtttacttacacctacatacttactgcttttcaaatatccagacgtcatctcctctactgtaccactctattatcactcgtgtcatattctgtttttatctctttgctaaggctatacccacccttccagttccccactgccctcattagactctgagctgctcgagaaaaatgattcatccatctttgtatctctagacccaagtaagatcacaccacatttttgccaagtctctcttgtgctataaatgttcatcttctcttagttgtaaattgctttcaacccaccttttttttttttttctaacttttattttaagttcaggggtgtaagtgcaggtttgttatataggtaaacttgtgtcatgggggttgtacagattattttatcaatgaagtactaagcttagtacctattagtaatttttcctgattctctccctcctcccatactccatgctccgaaaggccccagtttgtattgttcccctctatgtgtccacgtattctcatcatttagctcccacttataagtgagaacatgcggtatttggttttctgtggttttctttggttgctgtgttagtttgcaaaggataatattaccactgaccccagagaaatacaaacaaccatcagagaatattatcaacacctctgtgcacataaactagaaaatcaacccataatttttaagtttatgttataaatattagtattatctgagaggaaggcattacatccataagcagaaaggtggaaaaatcaggagagtgagtgatttatttgagagtatctggtttgttagtgaaagagatatgaaacaaacccagggctcctcatacctaggctacatctgtaacaccaaagtccaatgtactggtaccaaacagactggcacttgtgggatgctgtgtaagcagcatggacagtattcccttatccccagtgcaggctacagttgcttaaaagaactatggaaaaccggacattttgttcccttctaatttatctgtgttcctgtagccatgtctccacttctaaacgctaatcacttctctaggtgagcttaagtacctaattattaagagccctccaaatttctagtgtcatcttcaatatagttagtgccctttctgtcccatttgccccctgtgcttggcactgaatcagtatagcaaatatccctaatgaagaatcatggtacagggttaaatttacaaattaagcaattcctttagtttttatgtcaattccttttatccttgtatccccaccctgcatttgcttaaaattcatcccactgagaagctaaaaaaacaatgctactatgacgatttaaagagaaatactgaaccctaggactttttcctgagattcttgttacctgtaaactcttgaatataggatcagattacctaggcttccagggaatagtaagaccatacattagcagatttaatattaatctctagaatcccagatttacttcttgtccaggttaaatgcccttttgattattttagcaaaaaataatacaaaaaattgattacaaccattaatggaggcttaaaatgttaactcccatagctttaacccagtatctatgattaaatgcaaaaaatctaagttaatgcaatgttaaggttgagcttctaattgcacaaaagtcatgaaatttaaaattaaggtttctagtgctactctctgtcatttctacaacattcctccaatggttttctacaatatatgtttcatttaaatgtgtgtgttgtagagttcccaggaaagaacataaagcacaacagatcaggattcaacttgtggatacctagttttacataatcaatatggctggaaaagtgtgattcttttttaaactacaatgccctatttgagtgataaccatattcctgtttacaaatttgcccatttcctctaaaaatccttgaatcttcacttctgattacacactagccatcccctagagaaggaaagagcatttatgtaataaacaaaccaaacaacctgtggactgtgatagtacctacagaccttttcttcaacatatgacaaagcatattcatgtgggattaatgttgaaagagtaactcagaatatttaggtttatgggtgcatctagcagaacaagcaaaggtgaatagggactggaatcctgttaatactattaataggactagctgaggaaactgtcatcaaattattaaacctctctgaatgttattatcagagtaagaatacctgcttgtaggattattaggaagaacgagtgaagtaatatatgtaacacatgctctttaaaactctcttggagtttatagtaatagatcaactattactattaaagaatgagtaatcataatttaatgatcatctggatgtctacaggtattttggaaatatgaaacaatgataatttaaaattcattttattgaaagatacctagaattatttttttcacaatagtttcattaagttaggtatttgtttatagcctactatggaatgcccagataacatttaatacatgatgcactgagctgcatcagctaactctgaaggcaggtgagttaaatgaattcttggatattgggctgccatgcccaatattttcttcaaattttatgaaacatttgtgtctaaatagaaaatgtgcttgagaaattctagcccaacatgcaatttagagagaaagttataaatcataaatataagagcttagagctaaagtgccacctcaaccataactataataaaaactcctaagtgcattctggcaggaataaataaaaaatggcaaagcctgttgtggacggtgcagagcccaggaaggtaaccaagtgagtaaacagctaaggcaggattatcctcatttgggaggactccattccagacaggaattaaagaggaggggctggggaagggagaatggaggttgtgggagaaagtgtttttgcatttgaaagcagctaagttaccttgtgtaatgaaaaggaaatttgtttttttcctttcaacagtaatctcatttgaggtctagcagactgctacacaaaagatacatgtgttctacctacttggtttttctcctctggcagtgaggtacacaggaagggttcaggtgaatcagaaccattcagaataacatagtcaaattcctttccaaaggtttaaatacctattctttaatagctttcttcaaaagactggtaacttactgcactgttcctggcacattcacaaccaaaatttgttcctgggagtactataatacgatgcaacaaatgggtttaaacgaaagctggaaagatctatactgaaactatgaatcacaattactgaaagcaaaaaaatctcatacacatataatatccagaaaaacatacaactgtcccttggtatcctcgagggactgattccaggaccccactgcagatactaagacttgcagatgctcaagtccctcatatgaagtggcacagtatttacatataacttatgcacatccttcccttatacttctcaccatctttaggttacctataatatctaatacaataaacactaggtaagtggttgttatagggtatttttaatttgtcttttttttggtatattgttattttttattgttttttttccaaatatttttgatgtgtggttgattaaatctacaaatgtagaacccataaatactgagggctaactgtataaccaataatttctgagtccttttgtctctccctatgttaaagcaatggtgtagatgagatttctctgaatagaggggagcagctggaccaataagctgcattatcacttagagttatcaggactatatcaactgattcaagccttagcccccatctccgacttgctgtgatatgcaccaagttgcctttcttcttggtactttcctttcttaacaacaactagtaaattgactataaaacccttggctactataaactctattagaaaactggctgtttccagcatgagccaaggactctagctttccatactcaaagatttatatttctcaagtttcttaacaacattggcatatatttattacaatacagtttatacttttaaaatcaagcaaacagttaagattttaatggtcataaaaatgaagaacgcattggctattttctgagtagtgaaaaagttctcttttataatagcttaactcaagaacttttgaagtctttttcttcaaagatttttcatacaaaaattacctttgagagtaagcatgaaaaaatctcaggaagtaggtaagtattgttaatttaaatgcctcccttttcactccaggaaacataaaaccaaatgacaaagtacagatgatttattccacaactattcattgagcacctactattctctggcactgtggtaggcagtgaacaactctgctttaacagtgagaacaacattcttatctcctgtgacccttaaggaaagactagctgtagttagacttactggatttggtcataaagataaattaaatataaagcagtgaccatttaagtttaattatgttaaagaaattttgaaacaatagcttatttaaatcatttaagtatttgtttacaaatttttaccttctttctaaaatgccaagaattgccaaccatgaaattatgaaaacaaatcaataaaaatacaatgatttgaagaacaaatctatttaagataaaaaggcacataacctaacaccaataaaattacctgtagcactcttaaaaactagatttcttctttctttctttctttctttctttctttctttctttctttctttctttctttctttctttctttctttctttttctttcactttctttcttttctttctttctttttttttttttgacagggtctcactctgttgcccaggctggagtgcagtggcatcatcttgggtcactgcagcctctgcctcctgggcccaagtgatccttccacatcagcctgtcgagtaactggaactacaggcacatgccatcactcctgcctaatttttgtatttttttgtagagatggggttttgccatgttggccagggtggtctcaaactcctgagctcaagcaatccacatgccttggcctcccaaagtgctggaattacaggtgtgcaccacaacaaatggccccaaaactaggttttcaaatatgtgagagtatctctcagctatgtcaaaaatcctatgagtcattcattcagtgtttatttaataccaaaacatggaagatagtatgtctaggaactaattttactccaacaataaatctagaagaatgagtacctatttcatgtggttatcatgaagaaactctgtcagaaaactaaaatgaaatggctcatgaagttgacatatgtatgaaaatataagaattctgctcacacctcttctttcttcctgggggcattatccatgagcatcatctctgtatatgaaggacggaaaacccgctttggatatgtatgcttctgggtagtctagtcaaaaaggaatatgaactcttttatctctgaatgcttccaaataccagagaagaatgatttatggagttctgtatatgactaaaagagctgctagtacttttagagtattcattctttctttattccttcttcagggtgatctggaaattgcccttcccaggactttctgtctctcatataaactaccatttgtataccactttttaggttgcaaaatgctttcacatgtattgtgcaatttagttaaaaggcatcagggtgcgaggatcaagaacactggctttggtaccagagacatcagtgtttaccaaagctacttactagtggtacaccattgtgtgagccacttgatcactttaagcaacaattttctcatttgtaaattagggataacaatatccaccttgcaatataaggtagagattagcaatagggcagttaaaatgttattatgattaataacccatagtagggacaccaaggacttctcaatagtctgtttctcttcatcaggctggaggagggggtcttcacagttacttatgagtacatattacaagcttctagttaaagtaatggcctcttcaaatcttagatctgaaccatcttcataaaacagttctttaattcatggccaaaaacatcgtttccatatactctcagagacagagtccttttggagcaagatataaagtttaattctaagtctttttttaaccccgaaactattttccctgaagcaatccatgtgctgccatcagattttattaggtgggctaaaatagagtcagaaggagatttctttacataatagctgtccctacagaaacttgagacagtcagcttaaaaattatttttaatgaagaatttttgagatccataagtacaggaaaaattttgatggtctttctcccttactgattcattgataattctcaaacattgggctggcacaactagagtaaatcggtacatcttacacagtggaaagcggtgggtgtagatgtttttggagccagtcagtctctggcagcggatagagtcacacttgtgctttgttgcccatttacatcttcagaaagcagcctgggtgggcatgcttatcaaatgtgctcatttaaggataaacccatttgaatattataacaacatttggcaaacttcctctaccgaatggtggacctggcccactacctctgaaaactattgcctggccaggcaacataggtcctttgactttctttacatggtagaacacatctgagaccttccaatcaaacacccaggaggagtcctgagtgctttacctgttcctcaagcattctgaaggttctagtctggactagtgggttatggatatatggatatgcagtgagtccttccttttgcaacatacaccttttttttttttttttaatccagactggagaattcaaatgccttgttaatatctagtggtcacctttggcatgaagaagtcagcaaacatttactgaaaaagttgcacgtggagaattctgtatcataattaaggagatgccctccactccctgaagatgtttataattcttgctgggaatgagggaaaaacaaaacctatacaggcaaaactgcacagcacttatagaccaacacaaaagtgtgtacacacagtgtacaaagacttaagcagagcaaatagggttaaaaaaagaatttggaagaaagtaatggatatacattttccaaggtgagagagaagaataccatagagtggagaaagcataaacaaaggcatggaaatgggaactggaaagcccaccaacttggctaacatagagaaagcagagcagtaaagagtagggggtaactacaggggcatggggatgcatgaggaaccagtttgtaaagattaccaatgctaagccaaagctcttgttcattccattccagggaaacagaagttgatggagaccttggagttgggaaagaaaaggaggccaagaaggataactggtagtagagtggccttacagctagatgaggaattcggattctagtcttcaggtagaaaagcagcagtataaaatccaaggccaagaaatgagacatagaaaattatgtgtgggagcaggtatcctagatgcttaaaaaaattgttttgtgaagatagtttgaaggaagggtggcctattcaagcggttcagaaaggagataaggggccacttggtctagtgtcagcccttgaaaataaataaaagaaagaggctgaatgaagagatattactgggtgagaactggcagaatttagtgactgactgaatggtaatgaagggcaaaagaagaaaagatttaaaaatgatcgtagtgctggggcctcaggaaagggtcctatggacagtaattgaaaaagaaaactggtggctagagcagaagatgctctggtcagtggtagagcatcccaatgattaaggggtgtatgcatgtgaatgcatgtgtgttactataggcacacagatttaggagtaatacctcctttgccctaatgttacataacagcttacaattttctttcaattgaaatctttatttcaagtatttattaagtgcatactaggtgtaaagtttacaataagacttgtgcaaggtttacaataagaaaacataaaaaagttctattactgaacagaaactagtttaaactttactgcaacattttttaaagagtgtattttcatttttatattaattttctattatttgtaattcttaggccactgacataacagtgctttcattagtgctagatatgccaccttgacacaatttaaaaatcaataatttttcttagtgtacttggatatcttccttttcctaaatagtggttatgcatttggatgaagccagtgaataagatggcttttggtttaaatttgcacccagatcagtcctgatagaaggccatgtgtttctctgtaagagacacatgtgcatgtgcatattctctgcctcactcagattagccttatggccatggtatcagaactgcaaatagttatattgtggattctttcttgtttgtgggtgacaggagaaaggaaaactcacactttttttgaacaaagcaccatgtagatatccaactgaagtgggctctgttcatcctcaattcaggtgtgatgaaaacctacagggagttgaccttcagtactgaccttttacattatctcatttctctcatgcaacttctgtctaaggatgggaagagacctaagagatctattagtctcagaattacattcatctacaggtgtgccaaaaggatatcaagttttaaaaacacaactgcactatttcttttgtttttctttttattttctttttttttttttctttttgagacagagtctcactgtgttgctcaggctggaatgcagtcgcatgatctcagctcactgcaacctctgcctcttgggttcaagtgattcttctgcctcagcctcccaagtagctgtgattacaggtgtgcatcaccatgcccaggtaatttttgtatttttagtagagacggggtttcgccatattggccaggctggtctcaaatgcctggcctcaagtgatccacctgcctcagcctcctaaagtgctgggattacatgcgtgagccaccacacttggcctatgactggactgtttcttaacattaatataaagcaaaggttgcataaacaatggatgtaggaagctcattccttcataattattaagaactgaaaaggtacattgaagaaaactagccatgaataagaaaataacttcttcacagtggttaaagagaaaaggtactgaaaaaagtaaacaaacatatgaaagcctcttaatatactaaggtattactatatatatttctgacctttggctactgagaaaatgtgaaagatgacaattctatagctattctatataacggcagatgctcctcttattccaggaaacaaaatccttttatgacatttcactaaatatctaatcaaagagtattttatgtgctcatttcagatagtctcattcacttgcccttataactttaaatgagttcttttcttaagcaggccagcttgtatattatttatgataaaatactttctttaagatggattcagtgttaattttgtactatatgacttagtacagtgggacaattacatataacacttcttctatcagccctatgtttctatgttctttattaagatattatcaaagtaatagcaaaattctgttaaatgttcaatgtatatctttactgctaattttttttcaacatggtaatattactggtaccacagtgactcctcatatcttgaatatatgcagtacaattcattctctactagcatcaatttctttttgtaaacagaaatttggctttaacacagcaatttccaccaaactatataagtgctaatgatgaccaatttaggacataaacagtttactactgtcctttgagcctctctcttttttcatttctctaatcatcacactaaggattttttttctagaaagctatgggcagagttgatttcacagagttacaagttgacctttttcttttttttttttttttgactgatgctgttaatagagttttggtgactctatcagttaagaggtataccttgtacctgacattttacttgcttgagcaactggccccaactaactgatttttaatattttgcttttctgtttcctcaattttccttccataaaatattttttctacttctatataacttcttttttatttttttgagatggagccttgctctgtggcccaggttggagtgcagtggcgcgatctcagctcactgcaagctccacctcctgggttcatgccattctcctgcctcagcctcctgagcagctgggactacaggtgcccgccaccatgcctagctaatttttttgtatttttagtagagatggggtttcaccgtgttagccaggatggtctcaatctcctgatcttgcgatccgcctgccttggcctcccaaagtgctggaattacaggcatgagccactgtgcccaccctataacttctttatttattttttcttcccttatcaaattccatctcatttttcttacgcaattaaaatatttcctcactacagtttgggtcagcggtcagtcatatttacatcactttttccatagtttggttgatgatgtgcatagagtatatgcactagccaaactgatccacattcactgtggataggctgaagtccaaattgtaagctgatttgtcaacagctttgagtaagcctgatgccagacaatattttaattcttcagtgatatttcctcttcacttatgaaggaagccttgaagatggcaagttaataagtgcattgttttaactctgtaaataatgctttttggggggttgtctttaaagattctcatttactttttataaagaaagttataatttcttattttctggttccattcttgatctctttattttccttcagtttgtggatttgctctacttttaaaaactcataacttatgagtaattttacagatcccaagatatagtttgtttgttttttgagacagggtctcactctgtcacccacgctggagtgcagtggcgtgatctctgctcactgcaacctctgcctcctgggttcaagcgattctcgtgcctcagcgtcccgagtagctgtgattacaggtatgtgccaccatgtccatctaatttttgtatttttagcagagacggggttttgccatgttggccaggcttgtgttgaactcctggccacaaaggatcggcccagctcagcctcccaaagtgctggaattatacacataagccaccacaactggccaaaataaatttttttaaagaggatactgagcatctgaaacaaggggggtttgtagactcacaaggattaaaaattatttcgattgtctttaaatcgattgttttttaatcgattaaaaatatattcgattgaatatagtgatgcatttatcagtctatcattctgtaaatagtatggaaaattctggaaaaaaattcctgttcacaataaaagagattcaatttgcgtaacgatatttactgtgtgcctactgtgtcctgtcctaagacacagtattaaagttctttcacttaaagagttcatacctagcagagggattagacaaatttatagacaattatgcaaattaagtaataagctttacaaaagaagtgcacaaaaatttattgtgggcgggtggtatatacaagtcaatgactttcgttgcatgggagagctaaagagaagtaagcaataagggcctcagaaagttagaggcatttgggatgagcctttgaggataggtaatatttgatatatggaaatgaagatagagatatacataagcaacaaagtgaagaatgatagattggaagtgggctattcaggaaaaaatgcttttctttggaaaccatggataatatttcagcttctattcttataaattagtctcagcaaagttgccacttatcatatgttcaatatgaagtattttccttgcctataagaaacactacaaggatgtgagtagaggtgaaacatagagtagacgtgtcccaattgtaccccagatgtgtttgtaaacttctaggtatggtttccaaagaaataaagctcacagaacttttattaagaacacttttatttctataaataaatggaaactcatcttcagctaaaaatatagtggcggctcacatctataatcccagcactctgggaagcccatgtggggggatcacttgaggccaggagtgtgagaccagcctggacagcatagtaagactccttctctacaaaatattattttaaaacattatttgggcatggttgctcatgtctataatctcagctactcagggggtgaggtgggaggatcatttagcccagaaggtggaggctgcagtgagtcatgatttgtcattgcactccagcctgggtgacggagcgagaccttgtctctaaacaaaacaaaacaaaacttggaaattctagatatccaggtatttattcactaccacatagcttaactgtatttccttattattttgtctctagctgaagttctctggaatggtcatgaagagagaaaacatcaaagattaggaaatctatcccaaaaagatcacaaaatcaaggacagtgacacctttttgagctttttacttgactcttcctgtttttttttttttccacttcccttagtcattcactaatcagttctgctttagaaccattaaaataatagaaaagttacagaaacttggtaaaatgtttctctggcctatttccaaaccgcccaaaattaatgggaaatggttaaagtcaaaaaagctttttctctgacatggatttctaaacaatataattatggttcactccatggttatgagctttgggagctcccacaaaaaagtctttgctgcagatgtggccactggctgctataccaggcaatttgattcatgtttgttgttgttaaaaaaatatataaaactctcttatgttggattaagaggcttttaagaggaagctagacagaaaggccaggtctctctctatttgctcattcatgacaaaggtggaagcttcaaatttgtgatacatgtgaagaaggtgtctgttacttcgtgttacatttttgccttcagaattattgttttcaatcattctattttatataaatgcacaaaaaataagtccaagctaaactagtgatgctgggtcactccaagaagtgtcctcaatatagcttcacaaatttacccttttctctccaaatccacgtttatttcttgagacagttatatgatgttttgccaagaaagcaactgggagcaatgccttatgtttaactgggcttttagatttgagaagcaatccaatccaagacttcatgataagacttccacagcaattggatattagtgacatataaggaccttaagaactccaccattttatactctatataaatgtatgatgtggtacacaaagtattaatcaatacttcatgagcatagtagctctgtttataccaatttctagcaatgtacattaggcaattttgtagaaaaaatataataattgaaagtataatttaacttccactccatgaacacttagcctcttcataccatcctcttccaagcatttctttggtccttggaaaatcagtgaaaaatctgaaaaattgggattttgtgtttgattatatgtacatttactacaagtatactgggctttccttttctgatgctatagagatgaactatagctttcctaactcagtcttattattagccaggtccagtttatattagttaaaatgaacatcataaatttacagtataacttatctggtacattccttctattgtagtttgaaaatgtgccattcaggactgaaatgacttaaacataatcagattttatttctagagaagtaaagtctatacttctataattctgtgaacccatcagcaattaactttgtcccagtagaattaatatagtgttcaagttcaggattgagtagatgagaagaggaaggaacaataaaactcattcactcccatgctaggttctgcaaaatagcttccatattcccataatgtgatatttatcttccttataatagcacatttaaagtcagtaaccctaaaaatctcctacataaaggtttgcatctttccccttaaaaatgtacagatgagcttgtgataaagagatgatgtctcctgccaaattgtaatatcatatagaccagttccaggcaaagtattgaagaagcagtcaaaacttcatatacctatctatccttgtcagcctcacgtattcatggatggggtcacagcttatccctttattctttttggttagaaagtctttccagatgaggtcatcattttcattactctgtttcttcctctctcactagagtgtctttctaaaggaaaccaaggaccacttcagtgaaatattgaaggcaggggaggccctaaatgattaaaagaaacaaagctttcccatagcacgtgtccttttctttgtaaggagatgaggtaatatataatcttcccacgttactaccacaagggcattttgtggcagggagagatggatttctgggagtgaaatccaactgcaaagcaagggctattttcagaagggcttatcttcaatatcctcatttcagaattggtctctttgctcagagcaataccttgggcaacactgagaactcccatctctaaggtaagaataaaagttatttcctcattgatggaatatctgatgaagaaaaaggaagacaaaaaacaataaattattctcataaaaggtgatgcatatgaataaatgtcaaatccttctagtatttctcatgtggcttgtacacaagacttctatttgatctttggctctgcagtttctaccactagatgacccacatgtgtaatctggataggcagctagtttgcttacatataaattaaatagcctcaagtgtcagcagatctctgtatctttttaatatcccccaaactgcttcaagtaggaacagctacaaagaaccttaccaaaggacatggaattcacacttgccaaagaaatcactgcacgtgtaaattagaaactaatcatcacttcctctctggttacagtggcagctttgcctcatagtttatgttgaaatatacatttttatgaaatatttctcactgtagtcagcatcaatttaggagtatcaaacactaattcccagctccagcataccagaaaactagagacagagaagtgcagacaaagggaattgacaaaggcctggacttttcttatacttgaagaagctaattgtatttgtaaatttctggttaaaaacctgacaattatcagatctgccactgcaaggctattcctcaatttcttcatcatatatttttccctaaagtctctcagagaagtaaagggcttctagagatgaaaatgaacttgacaatcacgttgcaactcaaactgatcttgattcttttcgtcactttttaatttattgcagatggtgtaaatgggatgtttactggttggcaggtaatgagtcttgttgtagataatagtgatggacagaatctcacgcctgtcgacatcccagcatctcagcagctatatatggttatcatccattgctttgaagcacatataatattgtgacaggatgcacaatatttcccccatagaaacgatgattggtacacctgaatctcactagttcacatgtcatttgtcctgattccatcctcactgtccacatgagtagacattctaagatgtgatctaatggaaaatgtaatctgtttaaacatccaaacactcctcttccaaggtatcaccatttatcacaactgtcagtgcccctgtggaagagtaatgaccctcaggcatgggataatgctccatagaggccttatgaatgccactgtgaaacacagaaattgaccagttttcagttgggctggtatgtgcatcatgaaagatctgcacttactcactaaattacaagtggctgtttaccctttatacaataaagtctaggttgggaagccacagaccctgctgacttcaattgtcccaaacatgtgagtactagatttggacctgcctttgaaatggacttaagcagcttgaaactggaagttggatcacagtcattcaaaaatacattgggagataacataggtgtcattgccttccacttttttgcctttttaaaaaatcctctctatcaatggaggataacaacatctcactatccactattagcaattaaaaactaaacagggtaagcatgccagtgaaaagttaactatttgtttccttcttgtaagcttcccttcatccagaagaaaatctggatctggatctgttcatatattgtttctacaaagcagaacaaaggtgaacagttatgtggtatgaactcatgattttcaggtccctcccaatgggtccatttcctcattgacgatttccttgaagtcccctgtaccttcccaatcttatctacattttctatgaagtcaccttagataataggatcacttgcactctaagactgtttacatctcagtaaatgctctatcactatgaaagtttcatctaaaacatatctattcctcagtgctcagacaccctgaagatacccttcaggatgtagcatccatatgaagtcacaaaataccagttgatcttcccgtggaaattgttttccaatctgtatgaattgaatggctcaactaaataaatgaagaaaatgaaatattttactcacagtgattcattccatattaagaaaatacactaagtaatgaatggcccctatgaaatcattacagttatgagcatcttttctacttgacagatctctgttcccctcgcagatgagttatgccaacctaactatacttttggtattcacaatattctgattattagtatctccaaagatgggacttaagacactttcctgagaagagaaatttacaattagatacatcttaacaattaataaaattaatgagataatgaaataagaagctctcagtatactgctgaggatgcagaaatctttttgagaattaggaatgttctagaagacaataaaaaagatcagattgtgaactgagcaaaacaacctttgatgtgaagtgtcagccagaaatgtcaatccaattcaagactgcatacaaaggggcactgtgtctttgagctgagaggtattatgttacctgattatcttctctggaagaatgcattatggtttagacacttttattacctgaaagatgtagacaaattagggaagattaacaaccagttttattaggaagtagcagatgagctggtgtgaatggtactggttgttatgagttctgtattctcttttcagctttgatatgctctcatgtgggaatagtcatccttgaaatttagataggataatttatattcttttccccagagaaaagacagtttgggaatgaaagggaggggaagtgtttaaaacagcacaagaacctgggataacagaagggtcagaaattctattatagaatttttcaactcccatttacaaaaatacaaccaacaataaccagttcttaagcctttatttgaataagctcagtacatttagtatttgcagtatgtttttcatatatagtacctaattgtttttggtccacagaataaggctattctatgatactatgttattatgttcatgttttcctggaaatataatttgcaaggtcattctaggaactctgattatgaaattcaacatcactttaagtcagttaccctgaactctaatgcagtttcttgtctcttcatacttaccctggagctataacctatagtcttatagaagtgcccttttcaaaaaggctcccactccttgccttctgaatgactgtctagatatattttcacctgtaattgcatactacaccaaatttgcattatatatgaatgtgattgagaaatgattaagataattgtttagtttattagtgaaaataagtggtatataagctaaaataaattattatttttacacatggcattattcctagttgtatttattatgatttaccatttactaaagtatttcagttggttgacaaggaataatagcactaaacttccttcaagcaatactggtgactcactacagccctaatgttaatacattccctcagacttaatcttttaattctattgggaaacacctataaacacaacagaattttttccttttctgatgttcattcaaattacattacctatttccaccattcagtgtagtaatttctgggaactaccttgaggggtggatggtggtaaagaatcaggacatttaaacttctattaaaaagggacagaagaagactttaggtcacctgtgatcttaggcagctttcaggaaacagaggaagcacacttgtgatgaaccttcataaaattggcccatattcccaataattcccttacctattgagattcctggttgctaaggactttatcagttacttcaacaatcctccctccccgctaataacagtacctcatttgcgaacaatactggactgtactcacaattccttttccccttcctttcagaaagaacacttttacgcccctaaatagtcctataaatggccaaagacataggacatgctacatgattcatctcatgaatcagtttctgttctcttggctgttcaacaaaagacatttcaaattctccacgaggcaatgtattacactgccatgagattaatttctgtcttcaactttggacatttcttaactattaactgggattacttcctttttgctcctctacaacccattctctacacagaaactgtagtgatttctttcaatgtgacattagattctactacaaaaatcaccaatggctgcttactgtaactagaataaaattcaaacttctcactctacagcctatatagtctggttcctgattccttctctgaacacatcaccagtatacttttccttattcactgacctgtcataattcacatgcctagctcacttgagcctcaaggcctttgaagttgctattccaatttgcctgaaatgattttccttcacatcttcatatggctagtttctaacatcattcaggtctcaaccaaatgccatctccttacatgccatccgtgtgagattttactcttactttcttcatttcattcttcattgtgtgttagtgagtttacatgtttattaactatctcccttaactagaatgttccagaaggaaggaggactttgtgagttctgatcactattgtatttccagtgtctggaatagtaggtgctcaacaaatacttgctgagtgaatgaataaattaatgaccaaacagtaaataaatagtaaacaaggccaatatcaatgctctttattacagtagttatttaaatgtacctcaaaatgctctaaaaataaatatgtgctttccctgcacattaggattaaaagtactcattttactaattaaaagccaggacctcaatttacattaatgactggtccaagatcatatggtaaatacgtattgcacaattctggtctgaaatcttgttagcccagtcagtcctacagtgatttacttagaacacaattgtgaaccaggtataattaatctgaggtccaccaataggcttgagggggtttgtgaatcctttgaaaaggtattgcaccctcttttgggaagagggtccatagctttcatcatattatcaatggaagccataaactaaaagaggctgggaatctctttaagcaataccattctgaaacaaattattcttaacctccctaggtagattggaaggctgctggcttcaacattttctgtagagaaggaacacctatgaaaatcctatcactggctgagtagacatattttcctttccagcaccaactctggggaatggtgggcctcacaggctggctaacccttcttggagttcacgggaaaaagatgtctagttcaaagacgatgagaagggaggtatcattctaatcatgtggaaagcccactgtgcttttagtttgtgtttgtagcattcttagcttaatttcagggatgttattgtagctgtgaagattagataataataagaaaaactaattcttaggcaccagacagacaatatgaaaaaaatatataattctaaatgtaggtcaaattttatatttatcagcattgatgcagtgttgttttggtctgttcttaaatttttgttttatgaaaaacaatgaatgcaataatcttctaatacagtgattaagaaacagtgtatatttttccacatactatcaaagcagagtaaagagtgaattttgccatgggaaatagtgtattgctacagtaagtaagaatattaagtttaccaagtttttctagactgaagacttaacaataaataaggcacatcttccctgtaaggtttctcttgagtctgttacttttcagtagatgatgatgatgacagcaacagcagctaacatttgttgcttattatgtaccaggtcctgctctaagtgctttacatttattacttcacttaatcctcccagcaactatgtccatgaattaggtattattattatctattcttagagatcaggaaagtcagatgaggggttatttaacttggtaatgaggggtaaaaccaagattcatatcccacctgtctgatgccatgtccaagcctttcaccactacactttcctgtctccctctgtggtagtgcagggatactttggagatgtaacacatcttaattaaaaatactttattgctgaaaagtgctcaccaccctctgagctttcaagattaccatctgagtggtaatctttttgctggtggagggtcttgctttgatgttgatggttgctgactgatcagggtggtggtttctgaagcttggggtggctgtggtaatttcttaaaataagacaacaatgaagtttgccacatgattgactcttcttttcacaaaggatttctctgcagcaggtgatgctgtttgatagcattttacccacagtagaacttctttcaaaattggagccaatcctctcaaactctgccatcgcattatcaaatgagtttataaaacattctaaatattttggttgtcatttcaaaaaatgttcacagaatctttaccaggagtagattccatctcaagaaactcactgctttgctcacccataagaaactactctttacctgttcaagtttgataatgaaagtatgaaagtacaacaattcagttacatcttcaggcttcacttctaattctagttctcttgttattttcatcacattatgtacagttacttcttctactaaagtcttaagtgcctgaaagtcatccatgagggttggaatcaacttcttccaaatgcctgttaatatttatattttgaccttgtcccatgaatcacaaatgttctttatgacatcgagaatggtggatactttccagaaggttttcaatttactttgcctatgtcgatgatagaaatcactatctacggtagctatagccttatgaaatttattttttaaatataagacttgtaaatcaaaattaccccttgatccatgggctgctaatagatgtcgtgttagcaggcatgaaaacaacattagcctctttgtacatctccatcagagtttttcggtgaccaggtattgtcaatgagcagtagtatgttgaaagaaatctcttttttctgagtggtaggtctcaagagtgggcttaaaatattcagtaaatcatgctataaacagatatgctcttgtcctggctttattattccatttatagagctcaggcagggtagatttaacataattcctaagagccctaggattttctaaatggtaaataaacattggctcccagttaaagttacctgctgcaccagctcctaacaagacagtaagcctatcctttgatgctttgaaaccaggcattgacttctcctcaatagctataaaaaccctaaatggcatttccttccaagtagaagactatttcatctatattgagaatctgttgtttaggtcagccaccctcatcaattatcttagctagatcatccagataacttgcttctctatcagcacttgatacttcactttgcacttttatattatagagatggcttctttaattcatcttcatgaatcaatctccactggcttcaaacttttcttctaaagcttcctcacctctcttggtcttcatagaattgaggagtcagtgccttgctctggattaggctttgtcttaagggaatgttgtggctggtttgattttttttttttttttgagacggtgtcactaggctggagtgcagtggtgccatctcggctcactgcaacctccgcctcccaggttcaagcgattctcctgcctcagcctcctgagtagctggaactacagacacgtgccaccacactcagctaatttttgtatttttagtagagacggggtttcaccatgttggccaggatggtctcgatctcttgacctcatgatccacctgccttggcctccaaaagtgctgggattacaggagtgagccaccgctcctgtttgatcttttatctgcaccactaaaactttctccatatcaacaataaggttgctttgccttcttttcattagtgttttcactagagtagcacttttaatttccttaaagaacattttctttgcatttacaacttcattactgtttagtgcaaggggcttagctttcagcctttctgggccttcctcactaagcttaatcatttttagctttttatttaaagtgagagataacgtgactgttcctttcacttgaacacttagaggtcattgccgggttattaactggccttatttcaaaattatgtctcagggaacagggaagtcccaggagagggagagagatgaaggaacagctagttggtaaggcagtcagaacatataaaacatttattgattaaatttgtcatcttatatgggtgtggtttgtggcacctcaaaacaatcagaatagaaacatcaaagatcactaatcacaaatcactcaaacaaatataataatgattaaaaagtttaaaatattgccaagaaccaccaaaatgtgacacagagacatgaagtgagcacatgctgttggaaaaaatggtgccaacagactcaatacagggttgccacaaactttcaatttgcaaaaaatgtaatgtctggaaagtgcaataaagtaaagtgcaatagaaagaggtatgcttctatatcctattttcaatacaaagatgctgggtagccaatttctaccactgtctttgtctatttgacaaaactttcccatgacttttatactgttaacttttttgaatagcagatgagacacatacttgcatcctcaaatctgcaaagacaccttgggccagtttgaaccgaatcccatttttaactgaaaatgatgaaaataaggtacattattagcctgaactttgcataactctaaaatgtattaatcttcggtaaaaattttaatcttagttttagaatcctcatgaagtacttagaatgtttaaatgagataacactgggtatattaaacattatgaaattgccatttctgtagcttaaaaatggtcaattgttgccacagtcaagtgattaaacctaaggtaagtaatcaacttaccttattaagttaactgctattgttgtaagataaattattctcactctacaatcctccctccctgaaaacttttctagtctggaatgtactgctgataactagtgctagggacatagggttgaacttgcccatgattttaatttgtaatacataggcttttaaaattcatatcatagcaggtatacctccaaatgatgccacaaagacagcctagaaaatgggccttagaagattaagttaataaaggcttattatttttcctatagctggatgtactcttaactagataactttcaatagaaatcaagttcatgaagcaggttcatgggaactgtattagtttcctatcgctgctgtaacaaattagcacaaacttatagttctggaggtcagaaagtcctaaaatcatggtatcagcagagttatgtttttttctggagtctttaagagaaaatccctttccttgagttttccagttattagaggccacctgtattcattggctcatgatctattcctccctcttcaaaaccagcaacgcagcatctttcaatctctctctctctctgacctctgcttccatcaccacatctcctctgtgatcctcctgcctgcctctttcctttaaacggcccttataatcatattaggcctaaccagataatctggcataatcttcccatctcaaaaatccttaatttagtcacatctgtaaagtctctttgccatctaaggcaacatactcacaggttctgaggattaggatgtgaacatcttcggtggggtggggaggggggcattaatctgtctgtcacagagaccgaaatattctaggtacccaaatttcaaatagcaagcaagatggtatcttatttctttaaacctcatagcatggtaagctgcacagacatttttacatataccctcataatttttaaggagattgtgatgtacaactctccagtttctcttctggcacaagtgtgtggaaatcatggtcttagctttggtttgtagaaccagattttactcctttacccagttttagtcaatcccatttatatttaaatttgtcctttttgagcattcatactgctatccttagccaaagaattattagtacagtaagtgctttctgcacttccttctcctaactctaggaataaaaggcacacgtgtttagctgagaaccaaccaggacagaattctagcacttctcattacatctttcttgtgctcttccttcaggcactacattgacatctcaataagcaaataacaccagcgttgcaggtgttaacaccaatgactataccatgagaaattcccttatgtcacgccttgcatgggtaaagttaactcaaatgtcttccttctcttacctaaaatatctgcttgcctgacctacatctcccttgtccattgtttccaatgaacactaacccttaaacatttaagcctcatcagcacatgcccatcataacagcataacatccttgtcctgctggaaactattcagcatccagaggaccatctttatgctgataacactaaaatataaaataatgccaacagctggtgctacaaatggcttttaaaaacgatgttcattcactaaaattcctcttgctacttttgacatgaaacacgcagtctctaattattctgatcaagacggtgaaatacaaaaacaaactttaattgtgtttaacagatatttaatcaggactcactgaactacagattaaagctgaaattcataaaccataattacccgattgtcgcaatcttttggtccacattctccttccgtctgggcgtctggcaccttgccccgaatttcttttactgtcttctcagcttcattactgttcatgttttccagcagagatttagcacagattacaaaatatctgttcttggcaactttcttcattagctttttctccccccttgcaaaaagtttattttcttttttctaccagagtagctggaacaggcatacgtttagggtgctttgatgacacaaactaattatatagttatcaggagataatacggtagcgataactaaagttactacagttatcatgtaggtatcatgcaatttctccagtataccatgcggtgtgtcccagtcaccacgtaattacctaatgtcactactgcattgtttcatggaaaatgcttatctcaccccaacaaaaccttttctgccacatttagagaaaaaaaaagaagtgaaattcttagttctcatatccagtactgctcattcccagtaagatgttgtcatgcaaatgtaagggaaacacctgccctctcctgaaaatttgctcttacagggagcaaatggagcaattattattattattttttcctgcttcactctttccaggtaaaagaagtaattaccaacaatacatacattttttctttttttttctttttttaaaagaaaccaatccccctaccgacccccgaaagaaacaccctatttacttaggattcgtttagtctggcacttcccccctatactctttcctttcaaatttcagtcactcacatttgtttttcctagaattatggtgtaaatcattcttaacaagctaacttgaaacttctctcactcagtagaaacacaaaatgccactgtaattgaaacacggaagcttgaaactctttctaaccagttcttttgggccactcttcagaagggcatgccgagtttccctcacagtgcggtaacccctgggtcacacagcgaggataacatcacagaccaaggcaagaggataaagagaaggcactggctaaagaagaggtgggtggttcctttattccccccagttgggcagtcaaccctatgaagcaaggactgtagttgctacttatttatctcaagttgatggcttgaagtctgacctcactaagacctttagatgtgacataccacctgagagttccagtttaaaacaggatgtagcagcttcctttgcagcacaagttgaaagctatttccaattctgcttttattagtcacctcccaatctaagagctgcccattcaattgtacacttaactcatgtcggggtaaaaagcacctccagatttagaagggccagaaaaattgctatcctatcctagcacattgttcttcaatcacacagttcctctaaatacagttgacagcctttgagatgcaaaatgtatcactttaatgtagtagaggtccccttcactgcattgccaaatctatttagcagaatcttcttggaataatctgtccctagacctgaggatgcacagtgatttcaagcattttaagctaatgataatggttagtgctgagaacagatgtacctggctgtgatgtgatctattccagtaggcttttatgagctgttcattcctattgacttagcattttatgtctgtgcttttgcctggtgtgatggttgcataggggtgtcatgtgtgtattttcctgatgtgtgatggctgcacagggggctgtgtgtattttctcagtgcaatggccacacagggtgttatgtgtgtgtttgcctggagttatagctgcacatgttattgtgtgacttttctctctatttgatgcttgctcgcagggtcctatgtgtatctttttcttagtgtgatggttgcactcaatgctgtgctaatgatggacatttctagcaattatctatctacagggtcctcgggaaaaaaattgcagtgaaatcaataaacagtgctagacaggcccttgtaaatatgaaatgacaccatgcataaatgccgtttcctactatagcatgttaaaatccaaattctgttatgttattggcattgggataaaatttctatggtccctccatctccttcatatattgcaatcttttgggggaagttgagattactgctggttggagggcttttacacatgcatctatgtaatactactttttgctacattgtcctacacatcatctcttatactccattctgacttatcctggcataatagctgatattctaaaagtgaatatgcctttcatttattccttcagtctcaccaagccctcccccatataacccctacatcacacatacaaaaccccctcgcttgcctccctctctctagtttctccgtatccctcctgtgttcaccaaacggaactgacaaaggaaacaaccaatgaggttaaaatcttttgaaacccctggaatacagatgagctgggaggcatctggaaacaaaaccagacacttgaaatcaaagagacaagtaaattactatcctaatctaggaagaataactaaaggtgtcagtggggttccattgatagcacttggctctgggccagaatgccaagggttcaaactccacaccagctttgggctcaggcccaagacttgctactgcagggtgcagcagcatgtgcagcagtgttaaaggtgtcagccttctgcagagaggttaagtccaagtccttctgcctgtttgtcattacaccccagagagacggagagataaccctagctttctcttcgctgcctttctcaatagaacaggctgaggaggaactagtgctcagcagcagtacttgctagtatgagtactatacaactaattagtaaaattcccctctactgataaggctgcttgaagtatgcgcaagaaaatccactgtccctctccccccacgaaaaacctgatgtttgtcctaaagattcttccatcaatgcaaagagctaagtttggaaacctaaaaccatgtgtctaaaagaaagaaaatgttttcattggaacagcttacatgtctggtacacttgcataaaaactatcgcatagcattttagagctaaaattgctataaaatgcttaatacagtaagagtaattatgagattttgcatgcacagctggtatacaactagagtctcagccacatattcaatggagcatgggaaaaccatttataaaaattcctggtatgccagtttaactcaccatcaacagcctatcaacacttcattctttaagtggatagggaagatatttacctaccaaatgctttatttcttctctcatggatgttatcaatacttgattcaaggaatttgagttattacttagagagtataaatataagctgttaacaggacatgaatgacctgaatgcaagccttctccactgagtgaagaagttacaatgatagtagtaagtaatgaaccagaagaccaaatcattaaatctacttgtatcttccctttttaacctccgctttttgctatatcttcacatattcttatctctcttcatttctctaagattcaaatcctcgggtgagttcctgggtactctggactcccctgccatagcccacctggccttgccttcccctgagtaacaccctgaagacagagctcttcgtttacattttcccccaatcaagttataacaggtatttgttctccattccctttagttccagctacatcacttgaaaagaaactgatttgggtgagttgttaatggttaataataatttaataaagtttatttcttgatgaaaacattgattttaagagtcaaatgaagaacctctttattgtggtcttttaggctctatggaaaatgccataataggtgagatgattctaatcagaagcattgatggatgctccattgcacattttttagccataggagccagtggatagatgggaattcccaggtggacaggaagtttggggtcacaaaggcagcatgacacaatacaaaatgaatttgaacagaatcaggaaactcaagttttaggaccaacaaactttgccacgaagtgtttggcagacattcagtttcttaacctgagaaatgaggcaggccctgggatcagaaactctccatgatcctctctggctcttacattctatgactctctgaccgcagatcagtcaggtctcctggattagctaccacctccagttaagaactaatagttctgaataaagatggcggtcattccacactgagccaacctaactaaagaggtgttgatgtccataggtgagttttacctgtctgcctacaacctgcatacactacttttgagttggctcctttatgctatacagatatttcttagcattttgttttccctcatttacttaattcagcaaacatttaatgagcactttctatacatgaaacacagagtcgatcactaaggacaggactgaacagggcaccatctctgttgcacagatgattttattattcttgtccattctctctctctctccccaccttcacttttatgcataaacacatacttctagaactataaaagtagtatagaaaaaataagaggaattagacttatctgagccagtctgaaatactgtttattttaaacaaaagaatatgataataatttgtgttggcaaaatatatgcattcaattacgcacttcaatagtataaagggtatttctcaacatgtattttgaggtcagtaatttgcaataaggataacaatttgggggaaagaagattataaaggtaaaacattcccttctgtagaatcctgataaagtcctaggataaaatctgtgacttgtgtaaataacctctgggaaagtgagatcatagaattttttttttaagtttttgtttttcctctaaggattttgggttcatatccctccaaattttatttcctgacttaaaaataataactgccacttattgagtaaatattaaattccatgcacttcaaatacattatttttataaatacagtatgaaatacaatatattaatatattgtataatacaatatgatatattataatacattgtaaatattaaattcaatatattattaaagcaactctgctagatagatattattactctaacagacatgaaaactgtgggtcagagagctgaagtaacttgtcaaagataattcagacagtgtgcagagttagaatttaaactcaggtctgtatttgtctatgcaatatggctccataaccatttcttggttctgctgaatctaactttattttaaaaatgaataatcttgcttgaatgctttgttagcaaataaggaaagcaccctttttactcttccttcacattcattcattgcattacatatagtacaatgaaaacaggagatggttaagattttttcaatgcagatctggttgccttttcatattgatttggactgagataattaaatttgggctctcaatcaaagtgaaagaataagctatttgctatctgaataagtatttcttattaattgatcagacatggataaggtgtgttattacaactatatttgtaaggtatgatttatgttgttctactgcatattactctgtgctgtttttcattttcttgcactttggactttttgttttgtttttatgaatttagtcacagttggttgtgtgttgaactttgtaaaaatgtaatactaaggaaattaaaaaaagaaagaaaatattttcaaaatgatgtcaaaatcaaatctacccctcactaatttgatttgtaggaaatggagaacaaagtattagaagcagaatgcttttaaataatcctaattacttcaatgtgcaaatgcattgactaaatcgaagcatgcgtttaacactttgcacttcaattgtgcttattcatctaagttctatagatagcaattctataaaaaacaagagatatagccagccattccatagttattgggggaaaactattgttctaaaattcaagcttacctctcaagtcagcccacttttggactaacgcagatcattaggtcaaagaactcaaaataacataatttactgtaactactcaggttttcccaattgactctgccttccctattctttttttctgccttcagcggggtggggtgaggacgtggaggaaggaaagcttctgttaacaaagccacagagtggaagcagcaaggcttttggtagtcaagccacacagcattaagcagggccaatcttaaggaataatgccatggggttagagtggtttgtgatcaaggctgagatggagtcatgatggcagggtaacttagtacctggtctaggaccagctgcatcagaaccacctgctgagcatgttaaaaagacacatttcagggtctcactccagagcaaaccaacagaattagtatctcttgaggtggaactcagatctccattttaaacaggctccccaagtaattcttatgctacttaagcctgaaagcactggcatatgcacttaagctctctaattctatatccagcgacagccctgctgctacacctgtatactctgtcccagtcttcaagacatatgtgcaagtccaactacttgtcctgggaggcattaatgctaataataatggcccaagggcttagctaggcatgatgttatttgacatgcagtatctcatccaatccccacagcaaactacgagacaaagatgattactattctcatctttcagatgagaaaactgaaattcagagagacttagtaacttgttctgggtgccacaataataactgaaagagctctgaagaactatactactgtactttaactcagccctgcagaaaaatatcttgaaagatgtttacttctaaaggtgttcataacttggtgatatcattattccaaagaaacttgcctagatgctagtaagatagattatggaataacacacaaagtgtaagcatttctacccaaggaacttttccttagattatttcatagagacttaaactctcaaaaactaggctaagaatccttcattagttcgttcaacaattatgcactttgccagaacctgaggtatacaaagataaacaggacatagtctctgccttcactagacttacagttctgaaaaagagacaagcttgtgtacaaatggttctgggttaacttatacagtcagtggaggcctgagggagagagagtagttcattctcctggcagaaggaaaagagggtgaggtctgtaaagttttagttactccagcactatgccattggctaatgtaaggaacttagattttaaagattatatttttacttgtacagttttgttactaaaggggcagactaagttacttgtatatttcgagccaataaaactttatctggttcattctctctggcatcaaactggttttcttttttgggtaaatttctgggtacagagccaagtaagttgttatgtttattcattcttacacagagcaaccgagattctattcttgaaatgagtgcctaataaattttatcagtagtactttattccacccaataaaagtggttcttccttgacatactgtgtcctttattttcacttgtttcaattactcagaatgctattattagatttgcatattttcataagagaaatttagaaattacaaatgattgaaaacaaagaacaatctagattctttcctttgtgataagagaggatgatcccatatacatgtaaatgtgctttgagtatgttaatcttagaaatgactgaagaaaatgacattctaaagaaaatgagggccaggcatagtggctcacgcctgtaattccagcactttgggaggttgaggcaggtggatcccctgagctcaggagttcgagaccaccctaggcaacatggtgaaaccctgtctctactaaaatacaaaaaagtagctgggcttggtggcacgcccctgtagtcccagctactcgggaggctgtggcacaagaattgcttgagcctgggaggtgtaggttgcagtgagccaagatctgacacttcattccagcttgggctacagagtgagactccaacaaaaaagaaaaaaaaaaaaagaaagaaagacagaaagaaagatgaaagaaagaaaagaaagaaacagagagagagaaagagagaaagggaaaagaaagaggaaaaaaagaaaaaagagaaaaaggaaaaagaaaaaagaaaagaaaagaaaagaaaaaaatgaggttctggaacatcgaagttcaggctaatcacttaaggcaaaggtacaaggatccaaaaaagaaaaagaaattatgaaatatgatatgattcagtttggggaaactgaaaatctatgtatcccatattttagtaactgaataaattggaatcatacatgtattcttttctaagttgaattattaccaaatttgagattcagtgtttagattatttactgcttgcttaaaacttttatttttcaaattatcagagtatttttcaagcattaagaaagttcaataaaaaggcaatagaaatatcaagtaattccaccatacagagataactcctctttacatttgaatgtattctcttacatcattatcgaatactttcatttttatatttgggattgttttaggtatatatatttatttgtatcttttggaccaggaatttttagttgtgttattttataaacttttcctaataaaatattgtttaaaataactttaagaactatctaatttgcatatatgatatgtggtgatacatatggatattcaataatttaataatttctcgaattttgtaatttaagattttaaaatcttttttctcttttataaatgacattgtgataaacacctctgtacctaaatctttgtctgagattctatttcctctagacagatgcctagaagtaaaattaatgggtcagaggacatatttttaaagcaaggttctggataacataatgctacattactttgcagaattttgtgtcaatatatagatatccactatcactatgagtgtctatttcactgtaccattaccagcactgaaaattactatttttcataaatcatgactttgaatcctagtgaattatactttttcatgtttattagatatttgtatttcctttcataatttttctctttatattctttttagccattctatttgactgaacatatatctcaatatcttcatatctgttgcttcaacttcatttctgattgtaacaccatagtctgagctctccttaccttgctctgaatgatggcatcatgtctgcctggtctgtattccaggtttctttgattctgatttattctgcacactgatgccgaacagttattttgaaaatatgctttcatcatgtcagtcctgatcaagaacctatgacagctcctggttatttatctatcagctacattcaactgcctcattcaggggaaaattcatcccattcttggatattcccttatgagttctgttgaataatttaggttattgctatatggaccctatatgcacttacgtttttataagtgggtatttctatataaagacagggagacacaatgtggagtactagaatacaagaactggaaagggctttaaagtacatcaaaaccaactgtctacatttataaataaaaaaaagtggcctacagagtttaatgaactacccatggtcatggagccaattaaatgacagaactaggactagaaactaagttgcattattctcttttagtgacttttagatagagaataataaaagtcatttttacaatttaaaaaatagaaacagctaggaaggcagtttaatttcaatctgttgttatgtataaaagattgttaaaatcatgccacatagaaggcttgagtgttcttttaacatgaataatatgtacttcttataaatcaatcaaatgtatcattagaatttccataaaatttgcacatctgcaaatgacctagtttatttatactttgctttttcccttgctaatctatattgttttatttaatctgctttgccacaataaaagcacagtattttttatcctagcatattgcagattttcactaagtttcttaatcatatcaataaaaaatccaattttcccagcaaattcatataaaagatttcttttgactatagttagggatttgaagaactacctttaaaaaataaaaaaaaaaaaaataggaactacttcaaaatgcctctatttaaatagtaaacaacacgaactattgtggaagaatgtgggctgtcatccatttaatatgatatgatgattgctatatatattcaagaatcccactgtatttgccaaatgaaaacttaacggtagtcactggtttagaaacgagagttaccaaatatatttattatttgtggaagaggggtagggcataagaggtaaatgtggaaatagccatgaatggacctaactttgatagaagctcactgatttcaaagggctgattaacaaagcatgtgtttgcctaacaaaataattgacagaaaaggtatttattaaatcataaggtgattcaactgtttataaaatacaaggtttaaacaaaatggtagttcatcagcagcaatgagagctcagctatgttttctttctccgtgtgtgcatgtgtgtaaccaaacaggtccaccattcacttaacactcaaccaatatttattaagcacctactttgtgctagaaaccctctactatccaaaataagtaaccctgttattttgttacagaatactcgactactctggactgctgtaaaataaaaattaataataatttagccgggcgtggtggctcacgcctgtaatcccagcactttgggaggccaaggcgggcagatcatgaggtcaggagatcgagaccatcctggctaacacagtgaaaccccgtctctactaaaaatacaaaaagaaattagccaggcgtggtggcgggcgcctgtagtcccagctactcgggaggctgaggcaggagaacggcgtgaacccgggaggcggagcttgcagtgagtcgagatcgcgccgctgcactccagcctgggtgacagagcaagactccgtctcaaaaaaaaaaaaaaaaaaaaaaaaaaaaaaaaaaaaaaaaaaaaaaatgtatacctgatataaggtgttataacaaaaataataaattgagtgataagaggagacagatgaaacagcatcctaaatttctcatttcatgtaggatactacttcattaatgacaataattaaacaggcttgaatgtttttcagaaaaacaacagtgattattaccgaaagaataaactgtactttaaaacttcaaattgctagattgataaaagctaaaaaggtaatcacacatcaaaaaagacagagagtgagagtgagaaagtgagtgagaatagaccaagcaagcataaaaacatagaaaatataaaaaagatttatgagatagtactagatatattttttataaaacgaatattagttaatttaattaacattaaaaataataaccataataatgttaaaagataacaaaacataatttaaccataggatagcagtttaaggacactagctttggtagcaaaaacaggattcaaatattatttctgctatttacttgttataatctctttcctactggtgtatttatttagactatttacctcaactttctgctctaaaaaatggaaataagaataactgaacgtagaaaggattgggaaaaaataatatgtaatgcttagtgaccagcacaactaaacattcaataactgtaatttgtaatattatgtgttttaaatgatgtatctaactatgtacccatataaatttaaaaaaaaagaaaaaaatagaaaaatggtgctgatagattttctcaatgcagagttgccacaagccttcagtttgtgaaaaactcaatatctgcgaagtgcaataaagcaaagcacaataaaaataatataaaaaacataataaagagagataagaatcaaaggagtattgtccaagatgtattgttaccttaaaaattccgtgaaatataaaatgtgaaaatcacagaaacacagtcagacttaaaaagaagatgattagttacagaaagctactaaaagcagcccatggtgctgaagccataggcctgctgaaatctggatctagaatcacatcgagatacctagaattccagctctttagagtaatgaggtcaaagaggctccatttgaaatggtggacctgaacctggcttactactttatcacgaggctacaaaaatttggccaactactgcctggggaaacagcttatatagggctgcaggacctgagagctggaagaataaagatacagcattatgataaaatattcatataagaatgaagctgaaagctaccattgtaagatctggattgggactgagaagatccagataaaggcaactgtaaaacccctagttagggacatgtgaacaaaacgaaacaaacaaaacaaaacctgtaaaacaaaattctaaagcataaccaagtaatggtaagaaaatcaataattgtaacattcactccagataaatttgattttatgaaattatctgacaatgacctcagcatgaatatgcttgagatgcttagtgataaagtactcatacctaaaaaagaacaagaaatgattaaagatagaaataaaataagaataggtgaataagagtaaaacttaatcagaaatcttaaaaaattaaaaatgttcattaatataaaagtacaataaatgaaataaaggaatttcaaggaaagaattgagtgtattggaaggtaatgttaaggaattcactcagaaaaaaattgtagcaagaagaattaattttttgaaaatgaaatagcaattgagatactaatcagtaagctgattagaaaataccaatgtttatcttataagaattccagaaaaagaaaatggaagtaatgacaaaggaacaataaagaaaaggataatagctgagaattttccaaaactggagtcctgagattaataagtatatcctgagttcatgactaataattcaaaataaatccacgtccagacacatttcagagaaactacaagatatttaggatatagaataacttttaaaagctaccaggagaaaaagcagattatttataaagagataaaaacagattgatagatttctcttaattaagaatagttgacagaacaatagtctaagatataattgagtaatgtctttaaaatactcaacaaaaaatacccagataaattgctatttaagataaaaaacaaaataagtacatttttagttatatgaaatatatgtattacccaaggtcctcattaaataattactaaaaaaaagtaacaagaaaagtgcacccagaaaggaagccacaggatctaagaataatggtaggcatagtaatatctaaaaatattagtaaatataattaagcattgattatagacaacagtgatcaccacttttgaatatggttaaaaacaaataggtaaaactaaaacttcatacacaattatagtaacaagattgatacttaataggtaattaaaagatgctatgttaaccaccttttttatactaagaagaaggtcagaaatactaaaaggtcgattttatattttcttagaaaaatacacagttcagtatacacaaaagaattttagaattagtgctaaagaaacagataaaccacctacagatttcaagccagaagtaaaatccatgtaccagataaaatcacaaaataagctaaaaaaagtttttcaattaaaaccacataaaacacatcattttattttaatgcgtttaaattcagaaataaataataaaaatagagcaaatatgtttacaaagtaaaagcatacccttctaaatacctcaagggctaaaaataaaacagatattatgaaatatttaaaattgaacaaaactacgtatcaaaacatggtatgcacctaatgagaaaccaggagaaaaatttagagtctgaaattcatttttaaagataataaaaattattgaaagtaaaagggtaataattcaattcaagaatctagaaaaagaaaaatggcctaaaaatataaaaaaaaagaaggaatgaaataacgctaatgctgataaaagcagaaagtaatgatttagactacaaataaataataaagtagataagcagaatcaaaagccagtttttgtaaagaagtaaatgaaacagaaaaatgtctagtgtctaataaaaaaaagcagaagggtcaaataaatattaggaataagaggggaacataaggacaaaaaattaaaaatcataagaatatataaataactttgtacaaataaattgaagtataaactgtgaactgtatttaaaaaaaataacttcccaaaattgactagagaagaatcagaaatttcctctgtggttattggtttattctgatattcaagtctgcctacctacaacctactgatgaaaattaccaagttcagatgacaaatactcagaataaaaaatcccaataatgtgaaaactgtttaagatatagaaaaaaatgaaatgttactcagcttattttgtgaggccagtattgtcacagcaaaactctatagtaacagttaagaaaataaaatttaaagattgatctccccatgtaaacatactacatgtcagtaaattaaactcaatagtagattaaaaaatacaccaagagcaagaatattttttccaagaatataagaactgtttaatatcaggaaatgtattaatatcttataaaatattaacatagtagtggaaaattttatcatattattgatgcagaaaatgcattagataaaatttaactagtatttctgattaaaaacacttagtaaactataaatagtttaggaacatattaagaacttccttaatacaataatttcgatttctcaaaatcccaagcaaatgttatgtttctaaaacatttccattaaaataagaaacagaatagatattcttaatgtgactatcctattcacactatactgaggtttagtaatgcaatatgacaggaaaaaattgaacatttaagaattagaatttaagagaatgactgtcattatttactgctgacatacatgttgctgtagaaaacttaagagaatttaccagtttagttattcaaagtagtaagagagctcagcaaagttgctgaatatataacaataataaccaataaacaatgaaatggaaaacagatatgaatataataatgtaagaatctaagttatatgaggaacaattttacaaaataggttcaagaaatttatgatggaaattttaaaacatgattataggatatgaagatgatcacaaatagagggatatagtatgtcactgggcagcaagacacattataaaaatgtcaattctccccagattattttctaatgttaatgtaattacaaataaaattcagcaagacttttgccaaacttgaccaactagccctaaaactcatattgaatagcaaaagaccaagggagctaaaagaatcttaaaaaggaacaaggtagagagacttatcttaccaagtaaaaagaatattataaagctatggtaattaagggttatggtgttagtacaaggatagaaaaacagtccatcggatcaaataaagatcatataaacagatttgatataggcaaaagatggcattataaattagttaataaagaatgactaattttttaaataatgctgggataactgggttatccatatggaaaaagaataaaatagggtgcatgtagggtaccagaaccaaaaataattccagaaggattagagatctaaatgtaaatgggaaatctttaaaactgttagaagaaaatacagaaaggtaaatgaccttggcatgtgaaaggatttcttaaatgacataaaagcacaaattatgaaggaaaatatcaataagcctagttgagttaatattaaaagctttataaaaacaaatactactaaagccacagttaaaagggcacctacaaattgggaaaaaatctttgtaatctctatggcccaaaatatgaaaatccagaatattacaacaacagcaacaactaataccaaaaaccaaatcaagccaaacaaaactcttccaaaataacaacagcacaacaaataacccaacagaaagatggacaaaagatgcaaattaggcaacacagaagagaaaatcccaatggcttacaactaaaaaaaaaaaaaaagttaatgagatattattcaattccgatcagactgacaaaaattttaaaaagtctgaccatcacaaatgttgtgaagcatgtggagaagctctcatagattgttactgagaatataaattggtacaaatacattggagggaggttttacaatacctagtaaagttcaaaatgcatatttcttaaagtttagcatttctacttctatgtatatatgtctataaaaatgttaactgtggtcttgtttgtgattgggaaacaattaaaataatgtccaacaatgagagaattgataaataaattttagtaatacatacagaagaatacatttcatataaaccaaaatatatagcttatgtaaaactaattcatgatgatagaggttacagtggttttgcttgttctttaccttttgttaaaactttggaaaatttcaccttcaaggggcacatacaaaggattcttcttaggtattataaatattctgcaccttgggttgggtgttgtcacatgtatactcatcaaggtatacacttaatttgtctaattcactgtatgtaacctataataaaataataaaaaataggttcagaaacaaatgttccaaattattaaacttcgtttaacctgggttctggattcttgtatttcatattatcctttatacttccatgtgttttaatttttttttttttttaaagacagagtctcactctgtccaccaggctggagtgcaatggtgccatctcagcccactacaacctccgcctcctgggtacaagcaattctcctgcctcagcctcccgagtagcttacaggcacgtgccatcatgcctggctaatttttgtatttttagtagagacagggttctgccatgttggccaggctggtctcgaactcctaacctcaagtgatctgcccactttggcctcctaaagtgccgggattataggcgtgagccaccatgcccagcctgtgttttaaatattttacattagaaaatgtataaggcaaacaccatagattttcctaactagaattaatcgaggtaaaggaaagcactagtgtcatcttctcttcactatctctgataatagagcccaatattagtaagcacttcacagccaaacatgcctacaaagtgattattttgttgaatcaaaagcaaaagttttcattcacttcttgactgactatagaatctcaggcttccttaagtgagtgaccagagggatatattgttgatatagacagatgctgccaatgcacaaagatcatccatttaggtttttcagttgatgaagtgaggcatgcattgccagactttacttacatgaattaacagaatcaacaggtgatttggtatcagtactgctattggctggcgggtttcacctctggtttcagaaaagaaagagatgataccttttcaatgctgcatttcaagtcaaccatatgaaaagcaaagttttattccagtcacttttctttctctcacattgtggaagaaaagtgccagccactgctactctaaccactaaccatggtacagatgtttgaaaaatgtgaaacagagaaatgaaacaaaaaggaaaccctcaaaaattaagtttcgcataagtgaaaaatacagtatttatgtatcataactgcaaaaagatcaatggacttttttctcatgtattaaacaaaaataaacacaaacattgattttttgacttagtgttttgttgaaaccaacaattacaaggaccaactcaaacatggctaaaagtgggaataaaaataagatttcttttatcctgataaaagattttttatcaccaagaacgttacagtatgacctacttaagtgaatacttattaaagaaacagattcatttaaaaaacatgtttttaggtaaataggaacggtgcaagtgtttctttgaaatcttacaaaagataaaaattaattgaactaactaaggttccttaccctatgcaaataagaaacggcttagaaagaaatgtcttcaaactgttgaaatgtatattccttagttggtgtaaccaatgtgaggtctcagttactataatagcaaatgttctattagatttaagcacatcagtgcaaattattaaaatgagactgtctttgtttaaaataaagctttaaaaaatgtaatgtaatctctgagggagtattgcctgaaatgaaagttttaggccgagctctgccacaatcctattgcgcatcttggttcatctgattaaacatctttgggtctcaaaattcacatacattcacatttctaaagtgagtgtgatataaagtcatagcttgatcatcaaactcctttctagccctaaaattctacgtatctaatgagattaatttatcatgaggtgtttttcttctttcctttgttaatttccttacaataaatagacaaataaatgatcaaataagcaaataaataaatattaaaaagacatacacacactgatagctatccatctgaataggaagaaagacttttttttgtttgccattatctatcccctaatgtgtatttaaaaagagagctcccacagaaaagatttttatttttttctaaatcaaaaatagtgtatcatttatttgccatttaagttctactaagaaggaaaacacaaaatcattatggaaatcctattaggaactttagaaagaaaaagctgatgaaattccatttacaattcaaattgttcattcacgtatttccttttgcagaaactttaaatgctgcctcaaactatcttcacctctttttccagggacaatatccctaactctgttaaaaaaaaaaaaaggctctcttctcacacccttcccacctgtcctctgaggtagttgttccacaaagctaaggtatagattacatcaagagatatttgggatgggagtaaaacatttcaccctggagacagtaatgtgtgcaatttgccaagtctaaaagaaagttaagcctcatcaccactttggcaagaaatgtggttctcatggatggacaatgattatcatttttacacagaacttttgaaaatgaaagtacctggggcaccagccagaaaataagtacgagaatgcaagttttttgcgtcaatatttaaatcagacaaaacactatcagtgtacccttaacagacctgaagcgtctagaaagaatacaaggcagctgacaccttggtgaataagagcagctcagttttatgaaaaggccaaagtcttagggcaaactctctgttgttccaagtgctgatatacctatggcatcaacaaaggcaaaacaccatagggggcaataggcaaggcttctcttacaggcaaggctcctgttaaaggctgggaccctctggactacacactcgaggaaccccaagtgtgggtccctgaggggaggaagtttcctcaaacagaacggcgagaggctgaagttacacagtgtaggagtactccctgctggcagctgaggttggaaatgaactggtgatgtcctagagagggctgcttaaattttctatgaggaggctaatggagataacagtgctcttgaggggacaagagcatgggtctgattaggtttagataactccagatattatgctgagtgaggaggaggttaagggaagctactgatgacaggaactccaacaattgacaaaaactatgtgtagagctggtatatacaattttcatttaagtttcccatctcatatcattctataaagcatacacagccgtatgtgcacatgtgtgtggggttcagaggatgcaggaagaaatctatttctgtgcagttcattttacccctgcaagaacaatctttgaaaccgtctaatgtattcacatttatgttttacaaggaatcccttccatacttctaatggacctgcctggtatgccccctgtaccactatacctaatccctaggcaggtggtctttgtatgggcctggggcaaccacactggtttctccccagtgctctgctctgttagggttcttctgcataataaaatgaaggtcaaaatggcagcctgctaaaagcagcagtatttcagttgcaggaataacttgcttgtcatcaacttgttaatgcaatagtcaaacatttctctgacatgtacagtatcagctaacttcagcagataaagggtctagaacaggaagatgctgcagatgctttagctcggaggaaggcttagcagagccaaaacgtcagcagggcctgtttgttccatactttccatcgggctctgtgaaagaaatgttagattactgcaatgacaagtttgtgacaagcaagtcatttgtgcaactggtgcgctcctgtttttatctgtttaccattcagacttgtgaatgccatttcaagcacttagaggatttctggctcccattaaggggaaatggttcctccatgtttagaattttctacctcaaagagaattactaagcaattatttgttcctgtggtcagtgtcacacaaaagcactcttgagttgtttagctggactctgaatcatgaaatgaagtcctgaagactggatagcttggagcatcaaaaatttcccatctagtttattggaatgactacaaagcaagcctgtgagagacaataaaattatggccagcttgaaataccttgcccttttgctctgggatcatatatcaaggccatatgcttcaagccacataaactcacttgtaacaagtagatcctgagaagctaaggcctggcgatgtcacactgacatgtgatttagcatatgactgttttggtgacaaggaccactttagctgttgagaagagaatttccactgacttctctctataccttgtgggtaactatagggtcaatactaatccagagaacattttaactgtggtaaaataaagtaatataatatcaaattaataactagggccatcctcactaggctgactttttaatagtgaatggagaccctggcagatttgagatcaagaattcaagatcctctcattaggtccttcacctgaagttgctgagtttcttcaagtcattttaacctcctgggacgaaggtagaaaataacagcacatgttcctttccatctgacataaatggtctcagggtcaatattacaaaagatgaagagtgccttcagactcaagaacaagaatgatactctctaaacatcatttattctttctacaattttacatttttgcccattgttggtactgaatttatacataactctaggtataactcccttttttttttttttttttttttttgagatgaagtctcactcttgtcacccaggctggagtgcaatggtgtgatcttggctcacggcaacctccatctcccgggttcaagcgattctcctgcctcagcctcctgagcagctgggactacaggcacccaccaccacacccggctaatttttgtatttttagtagagacggggtttcaccatgttggacaggctggtctcgaactcctgactacaggtgatctgcccacctcggcctctcaaagtgctgggattacaggtgtgagccaccgtgcctggcccaattctaggtataactcttaaagaacataacagaatgaggctttgaagcagacacagatgtacactatctggggaagcaagtcaaagccggaacaggtggaatgtcaaggactagacaaaagtaatgatgtaaagtgaagcagagcttagaaagggctactagagaatgttacagaaagcgataatagtactcattgaataaaaattttattgtgaatgatcctgtgccagacactatgtgtattatacaatttacatgtgtaatttaatcattacaataattctatggcatatgcatgctcaatattttttcagatgtgagaactaaaatgtagggagttaagtacttcacaccataaatatgtaagctgcagagatttgaaaccagttttccattgttccaaagcccatgtactcttaaccatagaagaacgaaagtcatttccactgcctccagaagccttttctctcttgcttactggaaaacatttcagtctggaaatacaggaattcactaatttgatacaaaagggccagtgagaagattctagctctatctgtattgccatccttgttaggcctctgagaaagctgagtttcatcaagatgtcattcctttctccaggcctgacctattcctactttaatgcactggggaagaggtaagtgattctaacctaatcacatatctccgtgctatgaatggagggtgtttggcggcatctccttgtgtccatgacaattcctttctctctcttcatgtgtatagcctttagttcatcctactctttgctcccatattacttccagggggccttcttttgtcacttgtctgctattctgttttaggtgggggaaggggcggacagctttcttaccatgacaaggatcactgaaacagtctcaacttcaaactttgcacagaatgtatcctttgttcggtcttctgctttgtttctctttaatgatagctttgccatgagtcccattcgtatgtaactcagagctatgcaaatcaagctggtaagcaagcatttgcagttactcagtcttaaaatgaatatgtgtccaaccagtggaaacctgagtgaggaatgtctcctgaacattatgtgtggaatggctcctttccttgatgggtggcaaataataaactcagtgagatctgcattatattccctggtctcttttagtgtatgctcagagtgggtcacaagagtggttttagcttatgtaaaattttttcttatagtatttccaattttttttaacttcttgatgtctcccaaacacagaattcttaatagctactgaaaaatccccatgcctgaagaatcctaagatcccagggcaaaaatatggtaaagaacattaaacaacccatggtctgggtcttaatctggtgctcacagtgatcattcagtctctgctgcataccaccagggcacggaactctccactgtaggatacttctttctgttctgttcttccttatgctgaatcttaatccatattagtctgttctcatgctgctatgaagaaatacccaagactgggtaatttataaagaaaagaagtttatatgactcagtttcgcatggctggggaagcctcaggaaacttacaatcatagcagaaggcacctcttcaccgggcaacaggagagagaatgagtgctgagcaaagggggaaaagccccttataaaaccatcagatctcatgagaactcactcaccatcacgagaaaatcatgggagtaactgcttccatgattcaattacttctcaccaggtccctcccacgacacatgaagattatgggaactacaattcaagatgagatttgggtgaggacacagccaaaccatatcataatctatctttctaaaatccccccagtgcgtctagttctttctcaccctaaatttcagttcagagcttcagaaaattattagtttaatgactcatttaatgacaacccttgtgtgtattacataccaacaactgggtttagattgtcctgccttgtccctttctcctcacccaacatgatttaaattcccactctatccctctgacaagccggggagaaataaaagccagtcacacccatttctcatttccatttggatgcaggtagtactggtggcaaagcattcttaatctctttgattttctgtcctattctgtggaaaatctttcctgacaacctcaggcatctttgattgatatggctatttatagattgaccatttaatttattgtccaagcagggacacttttgacagtgaaagggccttataaataattataccaagactacagacttaaacaagaactttcccaggcaaacttacataacaccttgcatatacttttacttcaatacccatctttttgcataaaaactttcatgtctatttttcccaccaacctgtgaacactctttagcaacagaaacatatttttacctatgcagcttcagttcctagaaaagtgcttgtaagtataaagacctgggggtaaatatgtactgacgcacatgcatatgcctatatgcatgtgtatgtgtttgaattgatggtatatttttccataattacattctgtggacctctccccttatttcatagcaaataccaccaacacatgttaacttcatatttttggagatgaatcaaaaatatttcacttaatgccataggaaggaaatggtctgagtatattggtaatgggtttgcttttaatattgacagcaacaaacagaaagtgaaatgtgataaattttccactaaaagtctactgcatatttttttaacaaagcactgaacaataagctttaatcgctttcttcacaagtattataaattgtttcaggccgtgtgcgaaggctcacgcttgtaatcccagcattttgggagggcgaggcgggcggatcacctgaggtcaggagtttgagaccaagaacggccaacatggtgaaaccccgtctctactaaaaatacaaaaattagccagtcatgatggtgggcacctgttatcccagcaggaggctgaggcaagtgaatcgcttgaacttgggaggcggaggttgcagtgaagctgagatggtgccactgcactccagcctgcagcctgggcgaaagactgagactccgtctcaaaaaataaaaataaataaataaatttatttattaatttatttaataaaaaataaaaataaataaaaaataaacaaaaataaaaataaataaataaataaaaatttcagcagctgtatccacaatttcaagtttgtagtaaatgagttattataggaaatgatggtaatttaagagtgatcctttaatctccattaaaatgttggtggcatttctattgctttcaccctcgtcaagcacatttggaagtcctggtaacttttggcagtttttttgcttctgagtaactgtggctttaagaaaaagaaaggtaaggagaaagtgcctggaaaatgtgaaccacttagagaagtcatttcttcccttctcgctgacacatgcagaccattccagaaagatatgactctatactggttaaagagcttcatagaggataatctcacaacttccctttcagtgtttagcactcactattaataacctatctcattatcaaaccttaagattttctgttgcagcatattttgtcattatcagacctcagtgaagaaaagagagaaagccttgtttcccacttctcatcacttgcttaacagctactattagcgctctaccttaacattcctttttccaagataaaaaaagtcaatgtttttgactcttccttgagaatttttttccaaaatgttaaatttaaatttgtttggaggggtttgataattctgtctctctaagatgtttgtattcagtattatctgaaatcagaacaagcatgaataagtatgtaatctatgctcataagaaatcagagaaatatctatatttggcatgcttcttatacattccactattatagctattttaaaatttcagtttgacatttcacactcttgataaactttctataatctacttctagatgctatttttcccacagaggaagtcattctttattttcagtccatcaatgacatttaccaaaccatcacggataatgaaaaatataagacttataagattcaaaagaaacaaagttacatgtctattatttcagagtcttaaatatgtggaaaaaagaagacaatcccacacaaaagaagaaacatggataagcatgctcaggtgtttggtgctagctcaccagctattagtataggtgaactaatacagctatatggaattctctatacaagtgatgaagaagtagtggatgaaatgccacttttgaggtctgctttctctcctgaagaaaactaacaataacttttatttaacaacgttttgtttattcccagttttactgagtgttcatttcagtcctccctctgaagtggttagttatacttatctctcaaattgttgttatttggacactgtacgtaaaagcattgcactttgaaagcatgcatttcttgtcctcaacatctaaaataatgatttgcaaccatttagaagttctggtatcctgttgttaatgtgatttttgcatcactcttccttgcctattccttaaaatataattttaaatgaaaattaatttcattttgaggttttgaaatgcctctaacaataatttagaatacactgaatttgccaatattggaaaacatgtatgtagtctagattatcaagccagaatccaggaccgacctcaatagcatgtcacttctatatctctcaatactgagtctcatctcctactaatcatttcctgagaattctgaagtgctggccacaaaataaataggttagaattttttattttttggtcatttgagacagaattaaaggctctgctggttacgtggagttatatcataatactagctttgccttagttcagcaaaacttacattgggctaagaaagaagataatatattatcaaggcgttgtgtcctggtatcatcaaacgatgggcaaatcgatttcattaggtctctcctaggatatttcgtggaataaaagttagagttctatgtctataacttgcaggatagaattattaaaaatggttgtatttaagtgcattttcccaaatagtgagtttccttttggcagaaaagagacaatgaaggtaaatgtgaaagtatcatcaaccacaaactagtaagctgaactcaagtataatggcaatcttcctgggtgatcagccatagagcaccatttgtgcaagagtctgaatttctatactaacttacttttaaatttcgttgaatacaaacataacaatgtttttaataagtggcttatctattaagtttatagagaaccttccactaaagagattacttattctaatctattcttttgtccaatcttttccccatttttgcccagtgttttgtttatataatattttattctataaaaatctatattatacattttctacctgccttgtctattcttatacattcacaatctattctactcttagtatataatttgaacagattcacatacataaatcaacattcattacttctgggcatataaatggttgctgggtccatgacggctgtttaaataggtagcttccaggccactatgacatagggaaaaactgaaaagtgtatgttttataattattgagtaaaagaggattttcattatggagacatgtacagctatctcaaaggcttatttttccaaaaggaacaacgacactgtcccctgggatatgtgaattgaaaattcagtgtcaacctcttctaaaaaagtagatattttgaggtattaaaaagcgttcttttattagtgataacacctcttacttggggtcgttttgagatgaaagttggcaagtagatttttcaataaggcggggtgggaatcactataaattcataaactaaaaagaagaatgacaatttattggcccaaaaataggggagagggagagatttttttgttcttttttcttttctttttttttttttttttgagacggagtgtcgctcttgtggcccaggctggagtgcaatggcgtgatctcggctcaccgcaatctctgcctctggggtttaagcgattctcttgcctcagcctcctgagtagctgggattacaggcatgcgccaccacacatggctaattttgtatttttagtagagacagggtttgtccacgttggtcaggctggtctcgatctctcgacctctggtgatccacccaccttggcctcccaaagtgctgggattacaggtgtgagccactgcgcctggcctaggagattttggaataaaggtgtctctgtgactaaaaacatataactggtcatagatagtctgtttacctctagtgtcttttggagcaagggtgtgggtctctctgttgagtggtgcctatcattaggcatcacagcaacatcaacaaaactcatctccgtaatatagtagattttacattgtgttaaggtagaccttttaaacaactccttcaagttttctgttgatttcctgccagacagtcagacagctacttcttttttagtaggagtagtcaaggctaaagtcaatacatgtgccttccttgctgagttagaatcaggcatattccatcaacacatatgtcccactgttctcatttctctcactttactatgtgattagtagacaaagtatatactaaagaaagctgaggaagttgctaggatttctaaagaagaagaatccaaatcttgcctactttaggcaaaaaacattttagtattaattgaaaagagatggttaaattgcaacccataaattaaaatgtagttccaaagtgtgtctatagtgatctacaagcaaacataatttctcatattctttttttttttttttttttgagatagagtcttgctctgtcaccaggctggagtgcagtggtgcgatctcagctcactgcaacctccgccgcccgggttcaagtgattcccctgcctcagcctcccatgtagctgggattacaggcacatgtcactacaccgggctaattttttgtattttagtagagacggggtttcactatgttggccaagatggtctcgatctcctgaccttgtgatccgcccacctcggcctcccaatatattattaaaatatattctgcaggctaattctatgttcttatctcattcctgtttcttcctctgctccagaaaggattagtgtctagcataaaacaaacagtatataataaagaacagataatgtatagtcataaaattctgaatccacagcaaaaagagggtaaggtcttagtctagcaggtaagtcttattgacaataataaaggcatgtttctaagccacccatggaaaataccaaaaatgttctctattatatcttgaggtgaagttttggccgtgtaaaaaattatggttaatgctgtgtatgttatgttttatttgccttcattctgggaccacaaaaacggatctaactatagataggggcaggagagcatttgtgtttcttcattagaagctgtgcatgttagtctaatgtataagaattaggaaaacaatactaaatctcttgatgcaggccatgtcataaatccatttatacttatataatattttcctttttcttattctttcaaccttcatgcttcttttttcatttaaaaaactttggggtcagcccttatattaccagatgatttctagtagttgaagcccttgggaaattcatttgtccatccatgctgcctagtttagtacaacactccaaagggaacttccttctaccaaaggcaatgactgattggacttaaaaaataacttctataaatatgacataatatctggaggccacatttatagctggtcaaatgcactgttagccctacaaaaggctggctcataattatgaggcaataacatgtaaatttccctttctgatgagaaactaaaggtcacataggtcctgagttgtattaagactgcattaatactgttcgttagacatttcttttctcagtctcaacaagtcaccttaaaatctatggtatatagcagatcctgagcacctacatgaaaagcaagtactcaaatgttagagacctgaattgaaatcaagattgagatccatccaacttaggagttactgctggttcaatgagtccagggaagaggccatttaatgattcctccaaggaccattaagagttccagggtattcccttggatatctggaaacctgggttacttgatctgagcatgactaaaaactgggcaaagtcttgcatgcttatcctaggttggacacagatctctaagataagactggtatttggtaagctctcatctttcccattccttcctttagagttcatattcctgatgtattcttgtcacaagatacggtcaaggttacacatgggttaagagctcacagcagtccaataacaaacatgttgctgtaatactggtctcccttgtagaccttgaaagtccaatatgctatcatctagggcagttcatgggaaagttgacataataatgcttcaattattcaatttataaatgggacatttaactgatagagtagggaggacaactgagaaacgtttgaagatgtaaatagtttttgtttcagagaacaaccttatctctccaacacagtaatattttttctttgtgtagccaaatttctctaacacgaggctcacacagaagctatagagacttcacctagaaggtctcaatggccttagagccatatatatatttctactataaaacagcaacaacaattttggcccaaatatcataacctaagcaaaaatacaaacaaaatcaaacaaacgaaaactacctagaatataatcttaaaaagtactgcctatatgccatcaccatgtatactataaaacccaccaaacttagaatgcacaatgatgtcatttacttcaatttttataatactgctttttgaagattcctatttttatacgtaatgggaaacatgacatcatataaatgaggcaggcaaacagaaaggtgtagaaggcaaatgcaagatgcctatatattgtctaccaagtgttgccagttgtgaaaggatttgacatgctaatatccattcattcactaagagcatgatggctggcaggctctgcatttaagtgcggttatcgaggcccccaaatattgacagagtgccagattctaagaaactattgatgtacacagccggccacagctccagacacctctcagacagagtctttaaatgtcacagataaatgaattttcatgaaactgagagagaggaagagcaagaggagagaaagaacacagaatgagaggcaggaaagaaacaagaaagaagaaaatcacttccataacactgacatgaaagcatgtggcatctcatctctaaagctcaatcataactccttacacaggatgtgagatcaagccttctgaatgcattgcattaccaaagcactcaaacacttttaatcatttcattgcatggtattttaaaagttaagggagatacatgttacagaatagcttcaacaaactatttctgagcaaaatacagttcaaatataaatacttcccgactcaatcctaaagcaaattaaaaaaatatatatatatataaaggcccacaggcacagataagcattggagccttctaagcagttctccatatgcataaaaggtgaaaagtcaaggtgtcatgaaatctattttatgccaagacacaaatgtgtcctctgacattttcttctccacagtcctactgaaagtagtgacccctagtgggtttattgcacgatattaagggatgccttcttccttcacctctcttttcctgcctttccacagaaaacatctgccaggaaaatatacgagtcagttacttgacacatgataacaaaagtgagccatggttataactagaacgaccaagtattccttagaaatcatgtgtaactcaatatattttaaacgtaaaggaagcttttttactttgaaagttttccatctgctgagggcagcttctcttgaccttgatacactgtgccattgaaagcagtcacactttcaaggttagaatatggcttgtttgtgcatttactgttctatactagagttgtacaatctccacgttttacataaagcgatcatgccaaggcacacaaacaaaattcttcttccaattcaaaagcacatgggtaagttttctgttttggtttttaacctgcagcaacatggtttcacaaagccctagctgcctttttactagcatcacaaaaagccttggtgtaagttatttttctacatctggctctctctgttttggatacatgggactttagcaggtatatacttggagaataaagttccatagctcaaatattcaatagaggttttgtttttgcatcaacttttcagtaatttcttagtacttttcttttttatgttaggagataaaatgaaaggatttagatttcctgccatgggaaaaataattattttccctgtctttaaaggcttttattttgaagacaaaatcagttttaactcaaatggaaattgcagtaaaatctcagacactgtaatcagtgactgcattaaaactctcaagaaggaagccaacttccatgtgaggccacaattcagccaggatcacaaagagacattatccactttgcctgtggccattctgtcattttagactgtaaaatttttatactgtaaaattaaggttcaaggaaatcttctctaactttcacatacatacacataaatatactgatttttgcctgtaaccatataataagcagagaggttttggcttactttagacataggtatagaagacacttaataaagattattaaaatttccttcattatataagtaatagtgttcaccaaatattcagtgattggttaacacaaactgtgttatacaccctacagaaaatactgtaaagttgctaaaaaaaaaaatagacttaaatgtgctatatgacaggatatgacattatatatgctcaatccctcttgtataaagaaaattagtatacatatatacacatatttatgatagataggcatatacacaaacattttcttctggaagtatatgtaagatacttttgatgtatttggggaaaataagatggagaattttacttctaattacatatttttctattctgtttgaattcttcaaacatgtttaaaatataatgccaatagggatatccgagtggtaaggttatgaggaatttttttctcttcatttttttatatactggaaaatttaatatatcatatttcaaaacggaagcatcttcaaaataattatgtaatagtaattcatgttagttacaagaaacttgaaaacactaaaaaagcatgaagtatatcaacaaacagccttgtaattctctgacccaacaataaccactgtcgaatttttgctgcgttgtgtccagtttgcaaagtctcttctgctttgtacagtgtaagtaagaaagatcctttacattcccttaacggggggggacccaaaacagctttatgtgtcatttgttctgctatataccttcttagacaccttcaccaccacaccgtttttagttgccaggacattgttgaaatagcatgctatatgtgacacctccctaaattacacaggttctttattcatctgctattgccccctgaaaaacatgatctctgtgctatttcataatagtacatggcatttcatgatggaagccatggagttgaaggcaacagtggcctcatgctccacaattattatagtatacatactgaaatagtttcgtgaggactcagaaatgttcttctcttctgaatgcacagagatgcttccctgtaaggagctctgtcttagaacttcttcaaagcctaataaagttgaaggaaaaacacagaaaggtgatatacttggtgtgatattttaagcaactgacctattaattataataccttttgatattttctttgctgaggatcattttctgaagaagggtatgaaccttctctttcatgcaaaataccttggtataactgttcatcttttaagtatcttatttgccttttggcaaattaaagaattttcctacctttgttgttgctgttattgaaaagaagataataatgacaataataatttttatagctaactcttattggttgctttctataggttgggcagtttacttacattatttgcatttaattccaaaaatacctctattattattgttgctgttattcccattttatagatgagaaaacccaggcatagaaatgttgaaaaacttgcccaatgtcacaaatctactaagaagtagacgaagaaatctacatcagactcattccaaatcttccttaagattattatctagattagggttacatgactgtactaagaggtccaaaccatgtccagagctttcttatttttctaatactatggggggtgaaggggagtgggaagagaaagagagcgagcgagcacataagattccaaataaaatgttataaaatttatctaagacttcattttcctcacctctaaaatggacagcacccatcacagaggtttatcttgaggaccagttgagataatataagtgaaagcatctagtacaactaaaataaaacaccattattgctctacaagtttccttcctttgcataatggatatgttctggataaggtgattatgaaaaggtataggcttaacttctgttgtcaaatcaaagagcaattacactataaaatctcagagaaggattcccaacagattgagatgaagacctgatgtaaggcaggggttcaggtggaggctgggtctacagatttactgggagcactctgtgggttggtaacacattctagatcctcttacctctctctcctcaggctccttggtctgaaaattcctgagtgtactacagcagtttccagagatgattgctttctttttcttttatctggttacaaagtctagtggaatttatttgcaatgatgatacttcacttgaaggccttatcccacacattatgatataaaatagttagaaattcctttaatgtgagattctcaatcagataaattcactgtgctctatttactctggatgtttggttacaggtttccatcatattattaataatacttgcattaacttcctcatattcattacattgaaaggctctgagttagaaaatatgtattctactttcttggaaaccctacactcactagtgaggcctataaataaaatgaaactttaaatagtacgaacttcaccttcaactcataactaaacccaactctgggcttaaagtgctattttctccctccagtctcatcagatataagtatatcatgttactaactgaggccaagctatatatttacacaattcacttcatactaacaacctgctgcattttgttgcttgccttttcttgaggtactgggacttactcttaaattaatgccttagtttttttttttttctctagggacatccttttacttatggaaaatattcagaaagaatggaatttttaaaataagccatctgctgcgcagacctcaagaaaaacagttatgtttgaaaataccagattcaactaatgaggggcacaaaagccttattaactgtgttagctttcttatctttagagctcaggtaggaagtaagagccgacctcagcatgccaacaggtatcaagtgagagaggtcagcacagtctacacccttatgatatagcttgaacacatcagctcagaagtactcttcataaattctaaaaagagaccttcttccagattatctcgcacatggcagcagcctgggagtccttaagacaaaactctctagttctagaacaattcaaacaaggtgcatttacattatatttaatattttgctgtaagcagacgatagaatctactcaaaactatctctatttcactgtttgcccatattcccatatccgtcctttatttctcagcttatatctttcttgaatttctaaagataagaaatctaatttattcatgtattcattatacaataaatattaagtatctcagaaaagggcaaataaatagatgatagatgattaatagatagctaaatatatagacagataatagataaatagctagataaaacagagatgagttatggcctaaagaaatggctaaggaagaagattgcatattgaggatgttttaaactaggtattgaaggatacttgggatttcaaagtatagagagcaaggagaaatcatttcgagcagaataaactgcatgaacaaaaaggtcatcacacgttgggaaaagcagattatttggtttgtgaaagagagtagtaaaaataaaactgagaaggtaaattagggttagatcacatgagagttcgagtgccaaccaaggaatattactctgtcaataatctaggtttgaggaaagcacagtcaacaactctctagctttcataatttaagtaatgagtattataatccaccaaacctctggtctttaggctccacaggggatacgttagatcagtggtagagaaaaggtcctcatatttaatgagtcctcctccagctgagattatcatgctgcatctattgaagttaatcatctcacatgatttgaacaagaatctcactagttcctaatcacactagcattggcccttcattctcaataacaagttctatagagttacctaaaggctgacactgaggctggctgagatgagagcggtgagtatcccaagcacatgtgagatgtctgtagaaagtttgacataagctgtcatttgattttgaataaagccaaattgttcataagtgattggttacttatatatgtctagttcaggttctccctatgatacagaaagtcattatagtatacgtggaactctgagatctccttacacatcttttaaggctcactcctaactgtttaggattctttgatagaaggtgtttcccagcaccttctgttatgctccctctttattgttctctagtggacttactgacttctgatatgctttgtttttatgtatgtatttgtttactttctgcctctcctctccaaatgttaggtctttgaaaacaaggattatttgaatgtgcctgttttgctcactgttgtatctccagcatgtagaagagatacctattgaaagactgcttttgaaactgaagacaaaatatagaggaaggtaagcacatattaactggtatatgggggaaaaaaggcttctgtataaaactccccccaaaaactcatatgctatataatttgaaaatatcatcagctaattatgtcacggacgaattttctataaaactcaaagcacttttaaattaaaagtatgtattttttcttcctgttactgaagtaacaatctcattctctctattttatacaaagggaaatcatggcagagagagagatactctggagtacagcagatgaattcagagcttctgactctaagggccatctatattctatgcactatttaatgttagtttatattttactaccagtgagatttaagtgctgaattgaatagagtcctagaatttgtaccaataaataatgttattaacttatgctctttctgctagcacatggccttctcacagatataagcaaacaaataaataaagagcaacacagaaagaggaaaggtgaataacttaaaggggtgaacatggttgttcttatttttaaaatccagattgttcattttcgttgtaattgtattgtattctactggcagaaagagatgagatttagtgtactatgcaaattatagtaggtccaccacagcttatcaagttctgagaacagtatggtttctttttcctcagatcctcttttacccttaaaatatcttctggattaaaattctcattcaatgaaccacatctttcaatataaaaaatgaaattataaaagtactaaaagaaaacattagtaaatttctttataatcttggcataagaaaggactttttacctataactcattatctagaagctacatagaaaagattagtaaatctgattatatttacaaacaaacttcagtatggccaaaaaatccataagtaatttttaaaagtgggaaaaacttatgcagctcacatagataaaaggattatcatcttaatgtataaatagcaagaaatacataagagaaagactaacaacccaatagaaagaaaaggctaaggagatgaacagacaccttatggaaaaataaacgctaatgacattaaacatattaaaaaagatggttgacatcacttataattttaaaaatgcaaactaaaactataccgagataccgtcttttaccaatacaattggcaaaaatccaaaagcttaaccaagcactattttatagttgaggcttgggtaaaaaggtacttttatatatgccaatggagctgctaattgatccaactcctgtcgagatcaatttggcaaaacttttcaaaattcaagatgcatataaccctttgatcaataattttatttctgagaatttatcctgcagataaacttgcacatctatgaaatgatttatatataaggttgttcactgtaatattgtttgaaatgaaaaaaattgtttatcaatcgggactgaataaaccatgatgcatttatataatggaatactgcaaaactataaaagagattaaggcagttctctatgtatcaatagcaaaagacctctaagagatactggagaatacaagattgagaacagtgtataaagtggtttaacttttgtgtaagaaggtggaaggagggaatatatattcactttttttgcataaaaagaccactggaaagttacacaaaaaaaataatgaataaaagtggttactaatgggaatagaaagagaaaaaggtggatggggagaagtgaagacgtttttacatagttttgatttttgaaccctggaaatatatagcctgcctcttcaaatatatttaaaatatatgtaaaatatatttaaacaaatatatttaaaaactaaatgaaagataatctcatattaaagtaaaaatgagaacagcatagcaatgataaaaatggttcctgagctccataaatttctcccaacttttagctaccggtgcagccaatatctgggtaaacgtggtaaaaaaaacttggcagtttggtccaaatggcgtctttggagcaaaaaatgattcaggttcttccctttgactttgtagcattcttcagatgttattaaacagttattcctttctaagctcaatcgagttaccagtaaaatataaaatgacattagtgttgcagctgtgaactagttgggatgaatccctttaaaagcctaggatgatttccatgtgttgagtggagaagacctggatgtttgcttgttgctacgtaataagaacaaaacacatttcttgaggaattttaatgtgtaaaattgtttttaaaaataagtaaaatctatttattaattatataatatttatcaatcttctataatacttaggcgatgtactcagtatgcataacattcttaacaggaggcagaatacatcattaggcagatgatgtatgttgagtacttagaagttcctaaaggagaagcctataaagacagtgcattataattaataataaatgtaatagtataatttttttgtaaaataagcaacacatttatccactagtcagaaattatagcttcaattcaataagctgctttctcatgtttgtattgagaatgccatctagaacaatctagaagccacagacaagagcaggggtgaaagctcctaaatttcctatttccgttgtcccatgactttttggtaaaaagataatcagtgaattacccattttgtgtaagaatttcttcctctgggttctgttcttattttaggcaatgattttaaaacatggaggtaggtaagtagggagtattcattcaatcattcatttgtattaattaaacaccaagtatgttctgtgtatttcgctaacattagaaatgcagagacaaaagacataatttttgcccccaaatatttcaatctagtggggagaaaggaaagtaaataaccaactaattataacacagggtgaataacctgctgtaattgacttaagcataaatagctgtgagagaacagaggcgtgggactctgacttttaatgaggaggctcaataacaagttttgaggagtgggtgccttagctgaaacttaaaggatggaagaagttaacaaggcaaagatttgagaggatagaaagggattctaggtataggtaacagaaaaaaaaaagtacagagcaagacagaatatgatccattcatgaactgcaggtggttccagacagaggatagagtgatggttgggaatgccaagaaatgagttttcaggcccatccagattgtgatggaagcactactttagataaggtgataagggaaggcggagatctgaatgaacagaaagagacagccatgaagagcttggtgagaacaacgttcccagcagagaactgtacttattgcacatatatgcctattttaaggaatggttaaagagctaggggaactgattcctggttgtcagagatgagcagcactattccaaatactcttcccctgacaattatctaatctcttttgttgtctctggaagcatggttctttcccatcaatgaattcattcagtccctgtaatcaactctgattagtgttgtttaacatcaatcttttctactttttttcaaagaaagataccaatcagttgctgcacacccctgcttgttaaaagcagcacctctcctgctgacttaccgttcttttaatcaaaagggcaggaggaagcagttgggattcacttttctttttttttctttcaaagtacacaaatgtcaacttccttaaggatgtctggcatagctgagttcagtcatgtaacatacaaagtcagcttgatcaaaaggttgcaggctgcccactgctaaaatggaagagaaaaggaaaccatgggcttccctgaagtgtgaatgagtgcataggccactgccacgtgtgtatttatactgaagacatgctgggctgacaagggagattaggaaacataaatccccaccactacactgctctatcttcacctttgaacctctggagcagcactttctctctttcctatttcttctgttgtgcccagtgaaggagttactatatagctttatagcaactgcaagccatggctatttttgaatatttaaaaaaaacatttttgcggccaggcactgtgcctcactcttgtaatcccagcattttaggaggttgaggcgggtggatcacttgaggtcaggagttcgaggccagccttgctaacatggtgaaactccgtctttactaaaaaaatacaaaaattaactgggcgtggtggtgggcacctgtagtcccagctacttgggaggctgaggcaggagaatagcttgaacccaggaggcacaggttgcagtgagccgagatcacgccactgcactccagcctcagtgacacagtgagactcaatctcaaataaataaataaataaataaatgaataaattcttttgccccaacatttagttgaagtttataattctcaatttgcaatatgaggttataattcacaatatgcaatatgaggttataataatctcaatatgcaatatgaggttataatcatttctatggatttaaaagtgttaataactagaaaaagcataaaactgttcattcattttttttttttttttgagacagagttttgctcttgttgcccaggttggagtgcaatggcatgatctcggctcactgcaacctccgcctcctgggttcaagcgattctcctgcctcaggctcccaaatagctgggattacaggcatgcacccccaacgccgggctaattttgtatttttagtagagacagcgtttctccatgtttgtcaggctggtctcgaactcccgacctcaggtgatccacccgcctcggcctcccaaagtgctgggattacaggtgtgagccatcacgcccagcctcattctcttactcttttaataaatcagtatgtatcatgtgacaaacctgtatctgccaatatgacaaacccttgtcaataattctcctggaagatgcttctggcaacccagaaccagaaaataatttttccaaagagttgattatcttagactaaactaatgactcaagttggttttacaaatagggaacactctgtaaatactcatggacatatctaaacctgaacatacattctcatgaagcacaaaaatcatcatatatggttacagtccccaaacaaggctgcagaagaatttaacattcgtaacaatgtacagctagtataattacattttgtgcaacctcgtaattctttaacagtacaactgaagtgatgagaaggtacatactgatataaggtaacatagctctgtgttctagccaaaactagaactcaggatccattatttttaatctaggaacttttatgtgatgaccatttactaggaagggttgggagtaaaaagcataaggcaattgatatagagaaacaaggatgctttaaaaaaacaaaaacaccagtctaaaagaagactattctttactcacttgaaatggctctgaattcctgggaagagcataggaagaaatgtaactataggatcacttttatatgagtaaattaataaatcatttcccctatgttctctaagaaatcttttagaacaatatttcccaaacttccctaatcataccaattgactagtttcttgtttcagatccaaatgccaaggccccttcgtgaaaatttcttattctctaggtttatggtagactcaggaatgtgcatatttcaagggtgaccctgatgattcttagttcagggatgtttgggaaacactgttctggagaaaactttgtacaatagctaaacatttcttcattcctaatgaatcatcccattttaatgtttctgtggtgtgtcttaagcaggtgcagactctcatagcaaaccataaactcctatgttcctttaaaatagcttaagatacatttactcagttttcaggattagcaaaaagtcaaatagggctgttaactagcccattcccacagaagcaccaacctgtaattcccaagtatcaattctaatgtgttcaaaaataaaagcatatgcttagtcatgtaacagagggtttctttttttacttttatttcattgtctgtcaatctggttgatcagattactaatttctactctactggaagtgatctttagaaaaacaggtctgccatgtttgcattacagagatattaacaataataatgatttttaaaaagtaaaccaaacataaataaacaggaaaagaaaccaccatatttgagtccagtctttgtcctgcctagtgaaacatctgtcttatacctttttgacaggcagaaataagacctttcacatcgcctcatctctctgataaatcagtctatttccttacaaatttggtctgagacaaaactcttctgctcttccacttaccatttagaaaggcacagtcagaaacaccatctaagatgagctcacttctgggtgtctttcagttagacttctattaaatggataacaagaaaactaaccaagaaacaaaaatattcctgtcacttcttttgcaacaattccacaatcttgaggaaaattgaattttgaagaaaagaatggtctatgccatcttacaagcatgagatggaggagcaatgactataaagaatattcgttaattttggttgtactgtagttatattacaaattgcacaattaattcccactatcaaattacactggtaaacaggcctagattaaaaacacaagcctgctctgcttgttttgctctgttatacacaaagtaatcttaaattcagtttattatcattagtatggtttcactttgggggaaaaaaactctttttcctcataaggcatattgcatattgagatgatgaagaccaaagtcaatgctgtagagagttgtagggatataactgctgctaaaataagcacttggtttagtagactatttcccttagacgcttggagcacaataattttttcctgctgggagacaatgtatatcctgaatggggtagggcctgaaagacagtgaaatacagccggaaatacacctgatggcagaatccaccaggatcagacagcatcaggacagcattaaacacagtgtttgaagatagcagaggtatgtggactctcaaggaacactgaaagattacagattgtaggtgagcatggttttgagagtctatctctgctagccacaagaaaattagcagtcaacatttgcaaggtctgtttaattatgtcagtgaccagagctagcctcccaggttaagtgagaacgagaactaacaagctgcccctagcctccttcaggacttaaatgataaagccatggcaatcacagcagcagcagcagcagcaaaagcagcaacagcagcagctgaagcagcaacagcagcagcaagaacatggttttgacccgcagttcttgcccatcaaagagctgtgccctgtctgctcccactgacaggcagataaatacagagatctgttggcaagtacatatttatgtgtatctacagttccctcacacagacttacagagaatgcataacagcttctagtggtataacaaatgcacccactaatggggtgagacccattactcacaaatgggtgaaaagaagcatcaatatgcaggtcttaaccccagtttgtgggcagaaacctgtcattccattgcaggccgataggtctcctattcacacagtccttgtttaattttccaaacaccctttctctaaatggtgctactctgagctgtgtagtgcagacagacaggtttgacaagcagagctgtcaatttcacatttttcatcccaactgcagggcaaaattaggccttgtacgtaactggggttgactggttaggaaggcaggagaggttggcatttaagaggtattttccacattagaaactcagaactcaagatagaaaactcaaaaagggttgtccctattcaacatccatgaaatcaggagagtccaaagatgtgtactggtggtctactgtggggcatatacattttgctgaaacgagaagatgaagggaaaagtaaagcttggtcctatctagaaggagctatgggtaagtaagtagtgaaagacactcactcaaataccataatataaaaatggggcacttgccgtaagagaggaacatagcaacgtgtacacacaattcttggttaaccaagaagttgaatatataagtaatatattagtcaaatttttatccttcaaaaaattttggaattgtccaaagaaaggccaacaggatacatgctaggcaatgatgggtggattaggcatacaacgaaagcaagttaaccagcgctgtttctaacaaccaagtcccagaatatccttgggatctctgggactatctcaagcatataacatgagtctgggatggttttgaaatctctgctagcatatgctctgccctgaggtttctttttggtgctgatttggttgaactgaagaaggaagggagaacacatagaagaagagttctctctattttcaggcggcagtcctatctataccggtggtacagttaagaacctagaatgaatgctcctccagaatcccctgtgcagatcgacactctatggtatatgagatctcacagagtcttgcatatcagaaactcacaaacgggaacacagaagagtctgtgtgtccctgagtttatgctcaagctgtcaaacatcaagagtaatttatgttgttcaggaacatactataacaaagctctcacaggttggaggcttcagtgagcctgagggctcacttcccaacctggacttaccccataaggagcaacggactttgctaacatgaaatcaaaaggcaaaggaaatcaggcatttaggaggtattttacagttacaattacccaatcctaggttggactaggattggggttggtggggaaggagacatggaaagtgctgttaaatgttgtttgaaatgtccctttttgatccccacagtcatgagtgtatttgagtcttgattgctctttacttaaattattgtcattgcccctcagttggcatctctgactaatcccaaccctctcaatctactctgcacactatagccaggttaacttctaaaacatgcctttcattatttttgcttgtctctgtaagtgtttcagttattcagcaaatccttattgcattctaactgtctgatagctattgttctcatcacccacaaaaaataaatctggactctgcctgccttttggaattcacatcctagtcttcaataacatggctctcatttctagtttcactacttcctgtatacaccaactttatttccattggttgatatttttcttcatcctccctacttctctgttttcccatattaaaccattggctaccatctttgcttctttccaaaagaccttttattccattatctttcaacgtccagcttttacatctacagctaaagttctccgtctactattaatcaagccttctatactcctttctaggccaccataatgcagattcttgtagtactcactacctttcgttattgctcatgttggtgcataatggcagattggtaatttccagttagttttaggatctaattactagtctctgcaataagagtataaaaaccataagctctctgtgagcaggtattgtgtttctgatagtaacattattaactgttgtgataactgtgaattaagtttagcatcatacttatttctaaatttaaattgtaccacttctaacaaaattttctccatcgttttattaaaaaaaagtccaaaagaggatgacaataacaggaacacaataaatatatatccacatgtaatggtcagtggtcttttccagtgacaataatgctgcattttgctattagctcctttcttttttacgtgatattcactattagacatactactacactaatgccaacattttccagtaaaaattgacattaattaagctttggatgttgtcagcactagcctagggatagggtaggtttagggccactgagaccaagttcagggtataagatctctgatattcatcaagcagctaagataagaagcataatgaaaggcaaaacaaatggtacaccatatagtatgccgaatatttttaatgctgatttttgtagatagaacttgatatcagcttttactcatttgttattgatatatgtgtattttcttaaaatataataaatatagaaaagggtttgtgaataacataatatgaagatcagaatcaagattagagccaagggcatcagattaaaatgcagatgaataatgaatcacctgtaagattaaagctctaattccaaatggaaagaaagcattggcaaaggcatacaaacatggttctagtgtggtgttcacagttccatgaaggaaaagatgaagcagataggagggtgggcctactgtatggactaggtactggtattaagggttttgtattaggcaagaagacaaaaataattaaaagagtttggactggaagactgggaatgataactggggatagtgaataggatggcctaggtgtacaatgaggtcagcatttagcacatcaggtggccaggactaggacctaaccaagaagctggaaatagaaggaaactccttcattcattatttgaccttacatttttttattgaataatagtagtagactgatctatagacctaaaccagtggatcaacagacctagactagaccatgcttaacagaatttacagtttggagggaaaatagacatgaaagacttaagtaataagatgagagcagccagagacaatgagtaggtaataggagtgaggcccaccaaagaagtgatcatatatcagctacttgaaaccagtggtaaaagtaaactcagtaccaagctcacttcatccaaagcatggattccttatatgttctctgcttgggataatattaagatcaatctgtatgtaaagcttacacagctaggacaagcaaggattcctaggtcgggggagtgtgttcacatatgatggtgtctgtgcatgtaggtttttttcctaacaagtattaaccatgatcctatagcataagagtgagtgatgatgaggaggatgataatggtaatgatgataacagcagctgtttattgagtgcttattatatactaggtattggtttaaatattttacatttattagattacttactccccacagtaattttataataaaaacaaatttatggtcccccacctccttctcctcatccttaatttacagataaagaaactgagtcatgagaattagttttcttaaggttacagtgttgtagaatctacgtagtcttcactcttaaccacactgctctactgcctaaattcaggtaaccaacaaaagagttgccctgcctcatcttggagcttatagatgtctacagaatatattgagaaatatatatgagaaatgatttaaggatattcttaccagagcagtagccattctaaaaattatcacaatggtatattatattgtttagacataaaatgagagtattggggtaacatatatcagagatttggctcttacagattttaatttttaattgtactatttaagggaaaaattgagtattgtgaggagcactggaacaatggaaaaggtaatatggaaagtaaaaagtttagtctcagcctggtaagtgtggctgtctatctcttcaagcttcctttcctcaacggggtgacataagggttaataggatgactgtaaaatgcagttaccttatgaagaatgaaaaatcccattattactgagatttttcaaaccctgataattctgctgggattttctgaaccatgataattctgctgggatctggtattaaacagcatgtagacagattaatcccaagcccagaaaagagcaaacaaataaaacataagtagcataatgactgaagaaagttagattgtagtgtccaatctcatagtggccactttttttgtttgtttgtttgtttgtttgtttgttttgagacggagtcttgctcggtcgcccaggctggagtgtgcagtggtgtgatctcagctcactgcaacctccacctccctcccagtttcaagcgattctcctgccttagcctcccgagtagctgggattataggtgtgtgccaccacatccagctaatttttgtatttttagtagagacgaggtttcatcatgttggctaggctggtcttgaactcctgacctcaggtgatctgcctgcctcgcctcccaaagtgcccaaagtgcttgggattacaggcatgagccaccgcgcccagcctgtagtgcccacttttgacaaagttgattgttcatgtgggagcatgaacatgaaaatttaattacaaactaaggagaaacatacttaactttgaatctttcctattggtttcctggagtcaattttaaagtatcacttaataaatactatttgacaatttgcaaatttatataaatgtattttccttagagtataagcattcaactccaatatgatggtttcctattttcagtttgagtaaatatcaaaatagaatgtccctgttagatatctagggaatcacttttaggggacactatataatgccttactaaataccaagactacagtactattattttcacaagtgagcatgggtcaaggcaaagaagggcaagttggggtaaggatgtataggctgttaaccttgctgcacaggtaaatgtaaaagttccttttttctagcctcaacatgctggaagatcctgactttaaactgagtagagaatgtcttaaagcaaagaaacaagaactcctgtactctgaactttgttggggagttctggccccttttatcatttgatcgtcaatgaataatataactgcgtttagcccttaagcctgtatcagctgcaaacgtgacagatacctgtcatattttagaacagcttatcgcctcagcctctggagtgattgagtatttatagacacaaagatagaaacataaagcacatatgtataggcaggagtcccctggaggtggcgattaggactaggcagtaattttagcttgaagttcctatgacttaaatagccacttgagctctgctcttgcagtttacgatgtcaatagaacccctaaatgaaattacagccttctgatacgcagcaggatatcctttctttgccatgcaatgtacacggccaggagaaattgctctgtatatggagtttcactaaagcagaatttatcataaggctgctctgctaaaatatcattatgctgttattcactggataacacatctaatgactcgaggtgcacttgatagccatgtttcagtgaacacagacgcatgccctgatgtgaactgggcactccagtacttcaaagcactatcgatttcaattctaccataatttacacctggcttgttttgccaatagcttgaacccatgctaacactggaacatacacatacaagctttagaaagatcagaaatgaggtgtatagcaaaaatgaatgcagcaaactctccaggattttgcctttataatcatctcccttgatgccgattaaatattttgcacgattttcctagttaagtttgggcattccctctgttagcattatcctttggttggtgatgatggtaataagaacctcttatatttggacaagctatggacacttctgcagcaggatctgggtgccagtcatcttggttctcccactatctagcacaatgactggcacataatagttgctcatgataatctctgcaggctcctcttcctctctccattccagaaatgcactgtatataaaggaccttctcccttttgtcatctttcaatatatttttcctgagaaatgtccactccataattttaactattaccatgatttggatgattcagatgactgccaaagtctgtccctgacatctccagcattcctgactaaatccaactgccagtctggatgctcccctaacacccccaaattaaacaccttcaaaagtaaatttgtaatcttcccccatcctccaaaatctactcttcctcctcatagcttttcttgcttagttgtataaggcagaaacctgggagcaatccaaaattccttctctccatgcccagcccaaaggttattaaattgtgtcaattttgcctatctcttgaacatatctcctcctctctgtctattcccacagttattgtcctagttcagggcttcattgtttcctgtctgaacaatttcagttgcctcctaactcattttcttgcctctattctcccactcctataatctatcctctaccctgctgacagggtgatcttgtatcacacaatttcatcattaaccttctctacttaaaacctttcaatagctccctgaatgccacaagatgaagttaaaacttctttgcatggcaatcagggtccaacatgattgttccctgcctgcatctacagcatcgtttctctgtactcccctactacacataagtgatagtgttccccagctctgccatgctatttctagttaactgcctttgcccctgctggctcccttactgaatgttcttcctccctctgaccatctgggaaaatccttccattcccagcacggatttatcagctcttctgtgaaacttcctctgatcccccactccaagatatgttcagctgaacactcactgtgcctccatggttccttgaacatccttcagttacggcacttagcataatggtattaccccaacttgtttccctatctgcctctcctctagtgagcaacttgagaccatgttgtattcatctttgtattgtaaatgacaaagccaatgccttcacaacagcatattagggcccatgtgatcagacacccttgtctcccttacttcatctcctactagtctcatgcttacccactcagattctgccacacagacttccttgttgtcactcaaactttccagatacattcatgtccaaggcctttgcacttgatggttccactgttgaaaatgcttttgcttagatatccacaaaacttgcttcttcactttcattgaggtcttttctcaaatgctgtcccccaatgaagacttccctctctacctctccaccctatttaaaattgcaaacttatccctgacacaaacacacatgtatacactctttctcctctttaaattttctccatagcacttatcataaaatgccacatattttacatatatatatatattttatcttctgtctctcctatctagaaagtaactacaaggagaacaaagatttctgtttttttttttctaaatctactgcagtatccccaacccctggaatagtgttgggtacataatatgaattcctcaataaatatttattaataaatgaatcaatctttagcttcttgaataataactgacacagagtagggattcaaaaatgtttctttcctttttttttttttttttggtttgttttttgagacacagtcttgctctgttgcccaggttggagtatagtggtgcaatcatagctcaatgcaagctcaaactcctgggctcaagggataagggatcctcccatctcagcctcctcggtagctgggactacaggcatgtgccatcatgcctggctactttttaaaaattttagtagagatgagatcttgctatgttacccagactggtctcaaactcctgggctcaagggatcctcctgccttggcctttcaaactgctgggattataggtgtgagccactgcatctggcccaaaaatatttcttaaactaaaaaatacatgggtgaatgaatgaattaatgttaaatccatctttaatgaatataatgaagaaacagtctgtgtacagtacagtctgtgtacagtaagttgaatgggttactattatcctcattagacaaatgaaatagatgagtcccagaaaggttaggagccaaaattaaagctactatacatagcttaaacaggtttgctactctttttcaattcactattgaaaggaacagacaattctttgcactttgttcatgatgtacctctgacatttgttatacaattttgcttcctcttgactaggaatgcaattagcaggaggtgcaaggtgctaacactttttattacaatttatgtctttccatattaggtgtttttcataaaaaagatcccctttctttaattttcacaagtggattaggcactcatataattttgcccttcggagtggtttgtacatgactacccaggaggacattgtgttacaaatcctgccagaatgaactggaaggtgagtgcagcattcatagcttaaggatgaacaggttgtttggtgccaggtttgtactaatggagatgttctccattagtgttaactcccaaaggagaataaattcaataacaaaacatttcagtttttggcatttctatggagagttaactttccattgttcaagggttaattatccattatgtgaatcacttttctttctgtggctgcttacatctaggaattcagtttactagagagtgagcagggaaaataaagagacgaaaaggaatattctatatatataaactccaggaaaaaaattggtttaggggacagaatgagatatagtttggggattgctaagttgattgacaattgaaaatgggtaagattaaagcatgttttattatacacaatattttgggttttttttttaaattgtttattagggtcagtttgtagtacatgcagttactctctggatgtgattcttgtcagcacaataccatctagggtgctagaatgggcatttagcaaatggtactttagaggctagctcgacttggtgcccctctcctctgaagaaggcttagtgtgctgcagcttaatgaatgaaacagcactaagtgattccacctatttctctactcattgatgagaaacaactgcagtaggctattttcagctattatttacctcaaacagggcatttaattagtgcttgttaagacagtgcaaatgatttggctgccagtcttcttgcccctgctctttattgtgctgtatgtctgccccgcctctctcctgtctagttcacagggcatccatagccagtcttcatgcctttccataactgacatcagcctgacctccacggatgtggaagtttgaggaaaggaagaacaagtattgacaagctggagggactgttggttaatatgatgcattataggtaagtctggtactttctgactacatgagctgaccaagctggatattcggtcaccctcataagtccaggaaaatgaatggaactactgcaaactgaagatcccatgttccatcagaaattacccaagcattgtggggaaccttagcaatcttagtaaatggttggaaatgctgtcagatagttggaagatctaatgtgggagttaaggaggctcagatatagaagactctgccaatttgtgttctagacatggacatgtttttttcttttcttttctttttttttgagatggagttttgctcttgttgcacaggctggagtgcaatggcacgactttggctcactgcaatctccacctcctaggttctagcgattctcctgcctcagcctcccgagcagctaggattacacgcatgcgccaccatgcccggctaatgttgtatttttagtagagagggggtttcttcatgtttatcaggctggtctcgaactcctgacctcaggtgatccgcccgcctcggcctcccaaagtgctgggattacaggcatgagccactgtgtccggctgtttctttcactatgataagcaagatgtattcactgtcaatgcactgacatgtagatatccattcattcatcacctattcattgatcctccactcagactgagccaatctgacactggttgggagagaaattaacaaacctaaaacacaaaacctgccctctaaccacttgcagtttcatatatagaaaaaacttcaacttaaaagcatatataaatgctaaatgaaggtagatttgtaaaatgctaccagtgtcagatcacttttaatttgggttttatggaaaacttcagagaaaaagtgtgacttgtcaaggatatgatttggctgatcttgaaaagttatcagaaaaattatggttgctgatgctaatatgtaaatacagcatcaaaatatttaacatatagtaaaatagctgagaaactaaaatgggatcatctgtatatgtactcagccttataaaataaaatgaattcattaaacatatgctcaattttaagatatcaattaatttctttctacttaattttaaacttttatatatatagcaattaatattttgaagctgtacataatagaatttaggttgataagctaatatgtatatttgctgaaggataattaccaaacttatcagctaactacatctttctttttgcaaatactgttcataaatatttgtgtaaactttcggtgttgtcagtgtgataaaaagtcagctacatttcatttatggtcattatgaccaaaacatttgactgaaatcaaaggcaagtaagcctggctagaatttggtcatatttttaatagctgaatatagatatatggttgtgcgtatatgtaggcatttataagctaacatacatatacaatcatatgatacaagcaatcaactcctttttaagtttttaaaatatatgtctttcttaggggaatcacataaatactaaaaaccacttctatataaataagaaagaacaatttcttattggggtaacaacaattctgttatttagcaatttgatttgtgtatatctgcgactgcctaattaaatgaatatagcatataggaagtacttacagctaaaatatgcacgcaagaaaatacacatttcacaacatgcatcctcattaatttaatgaaattagaatttccaggtgagcactaggaaattgagttattgacagtgcattgtgaaggcttatgatcaaggtattgaaaaaataagtaatattaatatagccattgaagcacaaaaaatacatcgtcttgcctttgtatcagaggtacactaatcaaattctgacttcttatatatttcaatttagtcatgaaattcttccacgaccacttggaactccaagccttagcaactataagaaaaatctctctggcagattatatttttttaaatgtcatgtcttgggaatactcttaaatatttgttttcacctattctcttcttaaagttgcttatataatttcatatgtagtcattaataacatgttttcaaagtgttagagatctagcttgccttcaacgcagttctaatagacatccctaccagaaactatgagacagttttcctgggagtctgggcagtttgaatattaactgaggaatgttaacctcctatgtaggtcttggtggtaatggcctaagagctagttacattttttataacgtattgtaaacaccatttccctttcaactttttttctttagaaaacaagataactaatgaaaattacccaagaaatattatacatataaatagtatagtcctaacacgagctaactacaataggcaaactttactattaatataacattaaacttttaccatactagccctaataaaactctgagactattttctatcacaatgacagctgatgaatttaatgtgcctcacaaactataggaattgtgataggaagctgactctgtcctagaggccactgacaaacctgataaggctgtagcaggggtcagtctctataggaaacttgggctatatgagcatgtatgagttctgtggttaagaatctgaagcactcagtatagcaaacaaaattccaaagctgagtaccaatgtaatacgctggatcgctgtacctacttggacaagagtacatgcaacaggcacatacaatatacatctggttaaatgtaaaatcatccattgctaaagcattttaaacttctaggagaaatctactggcaatgtgttaacagcaaggacaaccaaaacaataaaataacatctctttcctaaaatttaagaacatcaagtaagtgccccttaggctgggttgtgattcctggaagtttcagcctatgagaaccatattggcgacatcaaagactccccctctttccaaaaagcaattcacttcagatgctgccacacaatcgaatgcttttatggccaccatgtttttttggtttttgtttcgtcttttgttttttccatgcttaatgaacatgccagattcttgaaatagaaagaagatgagaaaacccagtaagatggaatacctctagaaaagaaactaggcagggacctgatggtaaaggataaaaacacattccaacaggaattctacttttagggagagtatgagttattaagaaggatgtggaaggcacattttggctatgaaagctggtccgtggactcctctgccagtctcacatcagacaggatgcaaccatccccactccattccttcgacaacttcccagagcacattcaatcagtgtcccttaaattgaggacaatactatatttgggtttaatactgtgaggacagtcatttagttttcctgtggcaggatgataaatttcctgggaaccaaataaggattctcattgcattcttctgcttgatactatgaatgcagaagaataaagaagagggtgtgacaaatcatattttccaaaggtcgggtgtggggaggttccctaacgtttaaaagcaaccagttgttagcaaagtgatctttagaacagtattagcaagaatgtttgctctacatccactatagatattctctcctgcttagctaggcatgtaagtactgtgagcataatgtaaatactcagaacagaaatgcatggaaagctggtggagtgaaactccaaatgaacaattaattccactttcacttcccccatctacctccctgaatactacctccctgcccccactcacctatcttcctccccccaacaagcatgtttgctaggcatgtcaaggctgacatccatcggtggcagtatgaaacctatgcctacaggctgctcctgagcatagcctcaaggctctgccattgtccgtagagtgctctaagttgtgcccgctaaaaatcttcatcattccatttgactgtttggtagtatttctttaattgtattttttgtttgtttgttttaaaaacaccctttatttcctgcttgccttagagacaccaagaataaaatccttgacacatcaaattctggaacctcaccactcaccaggactatggttcctgatccaaggagtgacgactgagaatcagcacacagtctcttgagggtgtccaggcctggctgttaagctccctgctctgattagtttgtcgagttcacagtgttccagagtgctgaagcacagaaattagggaggggaggtggaaggaaaatcactggagcctcttacgatctaacttccactaactgggaggaaatgtcttataaataaacaacagtaagagaaacaaaaaaaaaaaaaacccatcccgtcctgccagaggaatgtacattattgtctcccgacggaaaactttacaccacaccagaatgcagccatgtctcctgaaactacctccctcaaaacagaaagaaaaagagaatcaaaaaggaaaggagaacaaaacagaacaaaaaagatttcatccccttgaattctgttgggaagttcatgtgagttcccagtagacaaactaaactaagcaatttcaacagtgtcactgttccagaattttgtgcagaggctgcttattagccaaatttcatttctgcccagatcactgctgtaccatccagacattttcagaagggaagttcagggaaggggggaagggtacgactgtggagaagaggaagaagagaggacaaaggaaaactcctgatgaaccagaatgccctagccacggccatgatagagcgagcccccacccaccacccgactactgcttgttgaggacttggtgatgcggtgtgttttatctacttactctttctgctcgggaggctgaggttcctacatttccagctcatgctggactgtaccgtaagcaacaagtgaaatgagttcagtgatctcattctagtccttcgactcctgtccacatcactaagcgactgcacagcttggcacaggccaggatgagtcagcagtctctggtcatgagaggccaggcctggaatagcaggggggtttaggtcaggagcaaaatgaagcagaaaggcagtctagatggcagggctctgttctgcaatacacagaaatactgcaggtcaaaatgaaagcgcctcatcagctctggggtgaagattgtaggactgtaaaaaaagaagcatcaagagaaaaaaaaaagctgcctaccaaacatagcaaggacaaaacagagtaccacagtcagaaaaagagggcactggtagagccctggaggataaaagatgctcattaaggtttctgaaatgtcttttcttccacatgctcccaaacttgaattaagaaatggtgacttcctatatactatcctagtattttggtactgttttcccaattcagtaagtagcaaaacaaataaaatgcaaggcactgcagttaaatagcaagaaaagcctcatatttcataaaataatatgagtctgatatctcaaaggtgtacatttgggttaatagtgtctgtatatagcctgtatgaaatggttaaagaggagtactctttaagttgagcttgggtgggggtagagaagagcttagagaaaagagagttaccagttaatgataaaacataggggaactatgacactgtgaccatatttctactcaatggggccaacatagacctccattagacctccatcaagaagtgatgctcccactaacaggacttcaaacacttctccctctgcagtagtactgtaatatagcaaggggagagggaaaataaaatagatagaaaaacaaggttcaacataaaaaaaattagtgatagacattttgtttcagaggaggcaaattgctctataagtcaactgataaaaaaaagtcttggtatctgaacagacttagagaaaccatatctagatgaagatgccaggtggagactgataactatcaggaaatggtagtaatggccataaagaaggaagaaagcaatctcaagtcacatgatgtagaataaaacagcatggaaaacagaaggagagcaacagacttcgggaacacgagtaaaatatttctttaaagtccttttaagaggagtaatgaggacccaccacatattcctaaatgttgtccctcagagatgcacagatgtatatgggtaaggaaatgtaaaataaactttcagctttcatttcagagggtattaagtcatctgaacacatatttactaactgtttaatcttgggcaaatgagctttctagcctcagtttctctctctttgaaatggaaataatattatcatcctcatggaatcattgtaagcactgaatcaatgttcattaacccttatctcagcagtacctgtcacatggtgaacattcagtaaattgcttattattcatattatttgattatcatatcatatcatctttataagtatccagtgaaagaatccccctccagtgttgttccactggattgagaggaatcaatatgaagactctagtaaaatcagttgagtaacactgcttacactgctgctttaaaaagattatttctgtctgggtatgttaaacattatacttgaagacacaggatgttgaaaatctattatgtgaaatccttgaatttgggtatctatgttgtcaaagcaacttggagcctaacagttgtccagtaactagaggcccaaaaaagaaaagaggaatttttagaagcttctccaaaagcaacaggataaaagtgttattggccttaaccgcatgatgagggctttttaccaaaggggaaaacgtagtccagttgatcatcgcagcctaattgattaattgtgggtctgaccatctggctgatgaatgctgacacccagcagtgattactgtgtaacacaattccggatgtgctctccctgatgcctcccacaataatggcaactctgaacttaaggttagtttattcaggcctcttggctcaatctcttcatggaatagtggttgtggcagggaatattttactagacctggtcaagcattatcttctcttatttcagttacccactcttttccaactctactcctacccactcctaagccctctcttgtatataatcacttttcatgcaaagcattccatctgtagttttcatcatattatctgattctctcatttctggttgctctgttctgaaaaatatttgactaaactaggagatctatactgctagaatgccatttcacaggggatcctattgggacatgtttattgtatcttatttgctactggtttacttcaaattactctgcgcttccaaataaagaaaattattttacctaattcattagcctgattaaaagtcccacatatggcccaagttttccatgagattatcagaatacaagggttaatagacgataattcttacatcttaagcctacttctgaccctcagttaggagtatcccatgaagaagattcccctggagcatactttactgttagagaaggaaagtcagacccatgtaaatgacaaggttcaatagcaatgccatccacaaaccaatctacacctggagatgacttgtacatggagaattcaccaagcaaataaaacctgtacatataaatataaaccctggggaattataacaaaataattccattgtattttgtaggaatgcacaggggagtaactgacacaaaatatcttatacaaccttgaccaacaagtcacaatgacaaatcatccgtttcctcttttcttttcccagattgatttccagctctaaattcatcttttctttcactccccacagatgctgaattcttctatgttccaggctgagttagtgttaattttcagtagaggacggcagtagcatgctgaactgtagagttccgggctgggagttgggaaatgtttttggcctgactgtcagtaaacaactatgtgtcttgggcaagtcaagtcccttaactccccatgtctcagtctcttcattgaaaaatgatagggtaggactgcataaactccatagtctctgccaacactaagattctatggttctatagctcatttccttttttttctccctttggcatcaactgctcaacaactccgctcatagtaatctctatgctctcagttactaatggaaaaatatgtccttcatttactagttggtattttgtatttgtaatctctctctttttttatttgatgctagatattttgagtcataaacaccaacatatccaaatagatgctttaaatttgaaggcgtttaaggaaaatagctttcccatgtagaatatttagtgtagcagggcatggaggaagccagccatccaaaagtggagcaaaggggccaattcacaaatgagagaaagcctttcataataagagtctccacactctttaacttagataaagctaaaatgctaccaacttctaactacttttccaatcaatcccagacaccatcacagacacttaggactacaaatctgaggaccagcactggcagcaatgcagttcttatttcacctccaccacccattgccaagcaggatttaggatggcatactaataagagccaagaggacgatctgtcatttattttcctccaaactttttgaaatttcccatttgggctctgtttcccagttttaatttggtaactgccatttttcagcatttcttttaacaggttactaataatttctgatacaggatctcatatttcattttatgctgctagagctgctgttaatatttcatctgccttcaattcagctctgaataaaggctgctaggttttgatagactgttaacactttggttctggggatttgatcactatgttcatccagtttgtccatattttgttaaaaaaaaagtaataggttagctatctcagaaatatctcagggtgtgctatacattctagggatacttcagagtttctttttctggatctttgatgaaaaccaacaaaaacaagtatcctgggtttgttttcacaaatgacttgccatttgcttcagtgtcagtattctggaagcagtgggcagtggttaagattcagggctcataggcagatctagattcaaattttggctctgaaatttattatatatatcacctcaggccagttccttaaccttgccaagtctttcttttcccatttgtaaaatagggatgataataatatccacttctattaattaatatgaggatccaataaattaatataaagtgctgaggattttctcagttctcaataaatgatggctatcattatcctagcattaataatctacaaattcacattatagaattattattttgcaacatcttttcagggtcaacaaattattttttagtacagcctttgttgtttgcttcactatagcttacatttttaaaaagtctcagtaaaatcatgtaaaatatttaaaaatttgatatttaaactgtatgtacagttagactaatatatagcaccatattattattattgtagcacttttcagtgcagcagcaaattctcaaaagtttttgtccatctaatagccagccctagataaggcacattgtaccaatactaatctgttctataaaaagatgacttatcatatttatcttctcctactcccaaagaatatagattattttaatattctttgggtatgtgtcagtcaggccctgtttggatacagagaccatatagcaatttgaatagaaagttagtttaaattattaataataacgggattaaagtaataagagtagctagtaagaagtaaagaatactttaaagaatataagaataacatgggccaggcgcaggggctcatgcctgtaatcccagcacttagggccgaggtgggtcttcagcctaggagctgaagactagtttgggcaaaatggtgaaatgccgtttctacaaaatattagtcgagcatgatggtgtgtgcctgcagtcccagctacttgtggggctgaggtgagaggatcgcttgattccaggaggttgaggctgcagtgagctgtgttcatgccactgcattcaaccctgggtgacaaagcgagaccttgtcttaaaaaataaaaaagaatagaagaataacaaatgtaaggaacagccattatttgcagggctaagatagcatatccaaggaagagtctcctccatccctggactgagatctagacattgtaggactcaagacaaaaatctcctggacccctggaccaggatccagaccttgttggacaacacacagccataactcattggatggcagagaagttgctggggagctgcatcagtagcacctgcactctagggtgctaatgaaagctatttacagggatgtatctcatctgaggcactctgctataaattgcccaatgtgtgtgtacacatgtgtgtgtacgtgtgtgtgtatggtgggtgctaggggtagctgctacctgccacgtactggagaagctacctgtgcttcagctgctgggtaccaggttagctgcatttgctgcaggagctacatgctgtaaaggttgcttatgttgtagaagccaggctctggagaaaccgtgcacattgcaggaggctgccaaagtagtgcatgacaaccaggaaggaaaatttcttctttctgcaacgtctccctaccttctctactgacaaagcaccctcaaaccagctagcaaagaaaaaatatttaaagaatccagatacatttttgcagagcaggcaaggagaactacatttggaaggaggcaatgggaggtaatacattggtaactggcacagatattattatttgctcacacacttcatgaaataactcacattagagattataatccagtattttcaactgattgcactactgttcacatttactaataaaccaactccctttgcatagttaagcaaatactgtcagaattaagaaaaataagaggccagtagataaatacctataatagaatattttaaagtgacagtactagtatatgtacataaccttttcccccaagtgctgcccacatacattttaattacatgtttataatttacttaagaaaaaaatatacagaagtactaagctattgacctaaatgtatgcatcagtgatctcacaccagaatctcaactaagtgggtattcagaagagtcattacaaacaaccaaaagctttgagagaggtaaaaattgcctcgattatcatttttcctttctctttccttttctttttaattaactctagaactcatatttgcttcttctatgacatttttgtggaggggtggggtggctcttaaataggttattcttttttttttttttttttttttttttttgagatggcgtcttgctctgttgcccaggctggagtgcagtggtgcaatcttggctcactgcaacctctgccttccgggttcaagcaattctcctgcctcagcctcttgagtagctgggattacagacatgtgccaccacacccagctaatttttgtatttttagtagagacagggtttcaccatattggtcaggctggtcttgaactcctgacctcgtgatccgcctgcctcggcctcccaaagtgctgggattacaggcatgagccacgtgcccagcaaaatataggttactgtttttcagaaaaatacatatttagaaattttttcttatgattctggtcctatattgttctactcttaatattaaatagagaagcatcaataaatgaccaatttggtaaactatgatactgtgatcattgttagaactagttttacatatggggagagagtatattccaaaatacctcccctacttttgcctaattcccttaagaagggaacaggtgcttttgctgtataattacaggtagagtttaaaaccacaaacacctgacattagcaaggagcgtggttgtgagaggctgagagcagaaaagctaattgggtgaggagagtcctgtagagagtagactatactgaggtcaggaccacagaacatctttctcaccattcatccgtttttacctatgtctggccatcagcactatctgttctcactattatggaaggggtctacttgttacctcacagttgtgttttcttaaagccagtggtatccagcaaagcaagccatgttgggttgtctcacaatcacactgtaggcatctctgccagctgcaggtggttatccttatgatttccttttgtttgtgctatgcgtgagtactgaggataaatttaatgaccctatgtttagttctctcctccaacacacatgcacacccccctctcccctgcaattcctgagttcaaaaagagatgaagacaaaggaatgtcataagtccgtgtgattcaggcaggcaagtccattttattttagtttgcccttctgttctgctggcttttctgctatgacccactatacttaacctgtcggctgttcttagtagcaacatgcctttttaatcagccttcctggggtctgcatttgattacagcatttgtgttctattttgattcttttgtactgtgccctgtggtgttcgcttgaaaggtgttatttataaaatgaaattctattgtattgccacttggattcaaagaggacatataatattaatgcagaatgtatttaataatatcttcaatctattaaatcaatttcttcatgagaatacagaatggaagggaggcacatgggctgataatcaggtaataagacttaagaatcacctgaacttttccttcacaagctttcctgaaagctggcacaagaatcattctcttaatgtcagggtttccaagtggaggagactacctttcttcagccagaccagtgcagtgcgcacctgtttaaacattcaactgtgcaggccaaacattttcctaggcttttagatgcaaattttttgactaaggaaactatgagaccaaacatgaatatgacttttttactacatagaaagaattaggttatgaaggaaatgtaatcacctatttctaaggatctactttcaagatttgtaaaaagaagtatatttgttctcacactgactcttctcaaaagcaggataggaaaattctagtgataccaagaactgatgcaaagtttccaaggtggcatgttcagaatgatgttctcacctagcaaaagggcaggtttcattgtgggctgctgggcctacagtcaaatgtttctagattagattgatggaggagtccccaagttttttcaacttctaattttaattccagctaaagactgaaacattgtacactgtatcacagcttgcacagcacatttcttgctgcatacattctattctttcactacaatttttttttcctgttgatctatctgaaatcatcaatggctatgctgctgtttggatagggaataagaaagaatttggtttgaaagatgatttaggaatcaggctctgcagaacttactaaaagaaactgtaacatacaaaggaacctggctgggcagtcttgaaatgagagttcctggatttttacctgttctcattcagtggcatattatataactccagaaaaatcagggtccagttttctaatcactaaaaggggaataactgtccttttctacttgcactgggctactttagggatggataagaaaatgattccagaatcttgtaaatgctttgcaatgaagaggaaatacaaatgcacaatattattaaaatgatagtttaggccacatttttgtttctccaaatctagagatgaaaaatagtaacaaaggaataaatttcttccacttcaaaaataaataatatacccttatttataaatgacatgtcaaacataaggaactaggatgtgttggggaatacacatctcagttttgaaggcatcaaattataagctatttgcatgaaggaatcacattcatctctgtatccacccaagttctacctcattgatttacattatgtaagtattccattcgttaacatatgttgaattgaaatgacaaatgagatcgcacaattttagagctcgaattaactagagaccatgttaaatcctgttgcctcattttgcagatgatacaactgaggcccagataagtaacttaactaagtccaatactaaaaatattacaagttttagaagagttattttaaagatctgccactgaaaatatatcactgaattaaaacaaaatagacattcttctgtcaaaataagaagcactattcagctcaaataatccgatgtatcctaacctaatcaagaaggctgaagcctaaagtaacaagtaaacataattaaatagctatagacccataggcatgttagaaatgccaagttactgaggggtgcatatcttaatactttgtctatcagccagtccaaatggcatatttttttcaagtaaaattaatgtcttaacaaataataggggtgaagtcagcaagatggcagagtggaaaactctacctctcattcttccacagaaatactgataaaacaatgttggaaccaaaataccttgcaaatatattcagattgtagctaagaaatagaggcaccctagaggatcccaaactaaaagcagttgcatttgcatgggtaaaaagtgcaatttcatgttagaatgtcatatcagtacttcccccagactggcttagctcaacactgagaggactgcttcagctcatgatttctcctgtgccacagaaagtgagattggagtgtgtatctggcttcctggcctctggcctctcagagaaccctctgttgggtcagttcctatattgcctcatactgtgtactgacgcacctgtagaacttcgttcccagggatgcgtaggagcaaagaaatgaggagggcaactccttacagttagagctgccttgcaagattaggaatggggcagaactgaggttattcttagatgagggaggaaagggaatgaagggggccttattctcagcatttcagagttccctctgtgaagccagtttccatttcaccttgtactgagccttgtgcgaccattagaacttggttctgagggatagttagcaaaaactaaaaggagcaggcatccctttgcagctggcactgctctgtataataagaaaaaaacatagaaccgagccttttccttgagaaggcaaggaaagaagtgtaaagggccttgcccccagtcttagattgtgctccccaaggtgtatgtctctatcttgtctcatattaagcaccatgaactggtaaaggtctctactcatcaaaactcatctgtagagactgggaaaggtagctgctacttcaaatatacagatcacaaagaaaatctacaaggaacacaaagagtcatctccaataaccatcctgaaagaaacagagatccctgaattaactgacaaagaatgcaaaataaatgtcttaaagaagcccagtgagttacaagagaacactgagagatagctaaataaaattaggaaaaagatacaagaacaaaatgagaagttaaataaagagatagagactattaaaaagaacccaatagaattactgaagctggagaatacaaaaattgaactgaaagattcactagaggagttcaaaagcagacctaatcaagcagaagaaagaaacagtgaacataaagacagatcatttgaaattatgtagtcaggagcacaaagaaaaaacaaggatgaaaagtgaggaaagcctaagtgacttatgggactcaaacaagtgaatcaataaacacattagggaattctggggagaagagagggaaaggggtagaaagcctatttaaagaaataatggtaaggaacttcccaaatcaggggagagaaatcaacatccagattcatgaagtccaaagagctccaaagatctacaccaagacccattataatccaattgtcaaaagtcaaagacagaattttgagagaaacaagagcgaagcaactcatcacattcaaaggagtccccataagactgtcagcaaatttctcagcagaatcctcacaggcaaagagagagtaagatgacatattcaaagtactgaagatcaaaaaacaacaacaacctgtcaaccaagaacgctatactcagaaaagccatccttcaataataaagaagaggtaaagactttcctagacaaacatgcagaggggtgttcaccatcactgtacctgctttgcatgaaatgctacagaaagttctttaagctgaaatgaaaggatgttgattagcagcatgaaaagatgaaagtataaaacttgccaataaagtcaagtatatagtcaaatactagagacctctagtactctaatgatagtgtgtaaatcactttcaactctggtataaacattaaaagacaaaactataaaagtaatgacatgatttgttaatggatacacagtataaaaagacgtaaattgtgacaccaataacatgaagtgtgtatataggagaagtaaaagagtagagattttgtatgtgatcaaatttaagttgctatcagcttaaaatagatgattataagttgttttatggaagcctcatggtaaatacaagaaaaacacctgtagtagatatataaaacataaagagaaaggaatcaaagcatattgctacaaaagataatcaaatcacaaaaaaagacagcaacagagggacaaaggaactacaaaacaaccagacaataatttaaaaatggcagtaataagttctcacctattaataattaagtgtaaatggattagcttccccaatcaaaagatacaaactggctgaagagattaagaggaagactatccatatgctgttaaaacagcaacaacaacaacaacaaaaaacaacaacaacacactttagctttagggacaaacatagactcaaagtaaaaggtgggaaaaatatattccaagcaaacgataaccaaaagctagtaagagtggctattcttatatcatacaaaatagactttcagccaaaaattgtcacaagagacagagagaaggtcattatataacaagaaagtgattaattcattaaaatgatataataatccccttgattaggatccttttgattggaatcctcttgactggagtagaacaaaaactgaataattgtaaactattattatgaagtagagatctccaatacactactttttatttttccaaagctttcctggagatcacagagaactgaacatggagaaaaagtgagcaagagacagcagtaggctttatgccttaaatggctgtatagcttgttaaagattattgtttgtgtattaaaaaaacatgattctagaaacataattggggtttcacagatcaaattcaaattattaacttagtatttcagcctccattacttgctctatcttgcttaggcatcctaggttccagtacttcccaacaagtgttctgtggtgtatgcagactatgttagtgtttccctttattttggtatttccacaggagacctaattttaaattttctgttctatcatctccatgatttcttaaattatgtctagacttctggattagaatattattcatgtacttactatgattcaataaacatcttctatgtgtgagacagtaggaataagatacaaataagacttatttcctatcttcaaagaataaaggaattcacaatacagtggccacttaaatatataacatgtgttcctgcttttaagcttttattctttctataattagagtatcctatcattattttattgattgaattcctttaattatcttatagtccagcttatgttctgcttcttccataaattaatttttactttttatagcccacactgtttccttttccccccactattacagtggaagtggacactattccctaaccaaacttcattccctcattcttcctagccgcagacctctattttgtgcagagtgtcaatgtgctcagtgctggatgatgagttttgaaatttataagccaattatgacaagtgtattctctaatttgcttgcttctctagcaaagaagggtggcctagggattcagttatagccaataagatctatgtggcaatccacttgagaggcaagtttctgagaaagctttttttttccgttacaaagaggaaggtaaaaggcaatccttctgtttcctcctccttccctctttgaacatagacatgatgcttggagttgtggcagctattttgtgatcataaagtgacaagcatgaaagaaagacaaaaagaatcccagagatatcagcacagactttatcatataccaggaatttcctacctctcaacttctggacttcctgttaggtgagaaaactgaatctctatttgtttaagccacttaagtcaggatttgctacctgctgctgaacacatttctaaccaaagtaataatagtaacattcataatttgaattcaccaaactgttcttcctaactagataacagacattggtcacattcttggcacttcataaacattcatttgcttcacatcttgattaaatatgctagacttttatatgtaatgaaattctcacacagaaaggaaggggggaatttggattagtatcagaaaagaggatgaaaccaggtcaaaaaaggaaaatttgattctataataaaaaattatatgacaaaaatttgttacaatgtagctcaattattatatacaataaaagcaaatttttaaatattttccaaaattaatagcaacatattttaagaaataagacagtagaataagcccccaaatgataaatgttttaaaggagagatgatataaacaagtcttctattaaatgtgaagacaataccatgcagttctactgaaacctaagtgaggaaccagcgtttgtcaaataccaccagcaataagactttttctctgtcctttaggttgtatgactgtgattcaccccaatgctacaggctccttagcatgctcattatttctaaaatctttcacctgaggtttgaacccatgacttaggaaactattatcgcatttgcttttggagaaaagactacataagttgggacagaagctattttcaaggcttccaaatattacaagtaagtagtggggaactgttgagaagagaaatgagtagctttgggtcattttaggttagtgaccttaaacataaggtgtgatttaatcagaagccagagtaattatggcaggaggtggggaaaaagactcagagctgtctggagttagggaggactttggtggcagctttcagcttgagctaaaactgcaggattctgtcagaggctccacaaacaaagggctgcattatgtaaggaatcttgtatttctttgtgaactagtccacaacaaaatttcattagtttttttttttttctctcctagagatttttttttaccacttccagcccgtaacttgttgctcagaagggaaactttctaccttaaataaaagtttaaattgtaagcaaactgacatttttttaggaacaaatcaaattaatttgaactttataataactgggaaaatgctttttaagttaggtggatgataagtaatcttatatgaagaatttccaaataatttagcaatagttggcaataatttagcaatagttagcaatacgagttcatatctctctccctctctgtctctatcattttctgatagtctgtttacacatgtaacacttttgggtcacctttcaatggagcatttcataggcagaattggaagatagcaagacacatggatggcacatagcaataggttctcataaatattatctgttttcaaaagaatatttatttttttgcccattataaagatattctaagattaattacagtcctaatactgtcaaatttagctttgatatacaaaaatctattttttagtagtttaatttttttttatcaattactaacttgaggctttcattttacaacattattttggtcagttataaaaataatttaactgccaaatgggttttcccatttgacatttcaaatgttggtttaatacttatcacttagacctctatgaaggttgactcaggtttactgggggatattgcatagatcatgtcttttggtccaacagtttgggctgtgaatagtctaaatttgcatggaagctcccaactaccaagctatccaaaaactacagggacagggcggggtgaatgattctcagcaggtggcactcttccttctaattaggtcttgaatgaatgcaccagcattctgctatctcttgggtggagtgtgagactgaatcattcaataatgcttatagcgcttaagaaccaaattcaagggaactgtggaatgaaggcaagttataggtaacatacaaggattttcattctgctggactttttcattcaaaacagcatcattctcagactcagaattatggataaccatgcctctcagtctactcaggagagtttccagtttcagttccaatggcccagtcacaattattagtagtgttcattttcactttcaaaagtgtcctagtttggatgataaaatatggggttaccctgtatataagctttaaaaaagttagtcataacaccatttacagtgataatcattctatttaggacaaattaaagtagactctattggccaacttctataaagagaaagagataaactaaaacattattaatttaatctcagagctttaatcagaaaaagtttattttaagatgacaacaaaatttctatgaattatttaggatttctaattttaggtcatttttttttagccttattttatacaagcaagcacgtatgcccttaagatttgtggtggagaaagaagtacaatatctgaaataaagttctttgaagcttaggtttgaattctaattctactatttactcggtgtgcaaatttaaataatttctgtgaacattattattaaccctttctaaaatatgtttaaaaacattttaaaaaccagaagggaaagaactacatatgctgtgaaaagctgtaagttattaacagttactattatttctctttataaataatgatagtttttccctttcaacttctatgacacttttacagactgtagaaaaatttggccaagcatgttgtagcaagggtccttaactgtaatcacctttgacacagatccatgatatttctgggtgacatctctacatggacattgatggcctgcaaagatctagaaaagaaagactatagatcttgtacaccaaggccaaagactaaaaggctgaaatttaaagtacaaaagtattgtgaacagttttgttagtagtataatatataccacttatatagataatttttcttatatagatataagaataatttttcttatatagatataaaatagggtttcttatatagataatttttccatggaaggaaggggaaacgaggcgaaaagtggctggagtagaaagactagtttgtaaggcagaaagattttctaattactaggtagattttattttattttacttgtttttactagctaaattttaaaaaagagattcctagatctctatagacatgttcctctttctttttgctgatattttcctatttcttttctgaaatcttaatttgactagaaaaaaaatgatgttctgatttaattctcttagtctacctgacatcaaaaagtatatggagggtgtctttagttttttatttatatgaatgtaatcaaataattttattttttaaaaaaagactctcactgtttttcattgtttaacagacatttctttaaaactttgaagtaattatagaaaatgttctcataaattttccctccaaattaaccaggtagaaagggctaatcctgttatgcatgccatttttgtttgtttaaattgactattctgagaattaagtctgtagtacctagtttgaggcctcaagattttcaggtatgcacaaggttctatcaactaattctttgtctcactgatgatcctttattttaaatatactctacttgcaaaggtggtagggtaaaaagaggagtggctgacaagagactaaagaggggaaaggattcccaacatccttaatatctcagggctgaaaaagagcattagaaatcttctccaatctcttggagaaaaaatatctttcacacactctgtctattagaacttcatttgtgtttaacaagcccctcttttaaaatgcaaatttgccttgtgaacctgtaaacctcattcacaccttattgttaattactttgatgttctagaatatgatcaacacttaactgatattggcaatctaggaatgaacaaattgctcagggtgaaaaaaggaaaattttgttggagtggggctgtaggtggtagtgtgagaatttcatttgtgagaaatagagcatactgatattctgaagttttgtctaggagaatggcagtagttacggtaccacaaaacgagcacttttcccgactgccgatgtctagttgagatcagaaaaagcctggaagcctgcaaacctaagttttaaatatttagccatagcaagctaatcaagcttgcaattttctgaaaacgttttaagttaattcataatagctctacaactcggtgaccttgggttctaagactcatttggttcaaccttccaggtttaaaattcaaccaataaatgaattccaaggaaaaaaagtgaatatggcccagtccttttttactgtctccctagtcattcacttcagagattttggaatgcaatcctagaacatactgtaagcaatttcagaagaatacacaggatgcagtatttctctatgtgtcttagtaaatgtcacttgacccgatatatcaaaaaggttgcaaaatttgaattagactttagttgacttaagctacacatcttagcttggcagaaattcaaggaaaaaaatattttatggcctcttgtaacattattaatcacccctccttttatataaaaaataaatatgctaaactcttcactgttcagaaaaggggtcatttttcctgccaaaatggctaattttagtttttatgtagttggatacatttgtaaactattacatgaaaacatatggttggaacatgcttactccttcatgagtgttccccttttgaggctgcaaaattttccttagttgctccatgtgctactttgttgtgctgatgacttcttgttctaaataattttcttcattttccattgttaatgaaatgagttctaataaggaacaaagaaaccctctgatgaaaatccctttcttgtagaatggactgggaactgatataggacacaggggaacagcaaatgctgtgttgcacattcttcaattaaatgatccctttgtagtttattcacctgaatgcattttggcaaagagtgaagcaatagtgggaaaaggattgtttgtgtggctaatctttggttactcagaaagtactagacatgttttcctgcatgtttgattgatttcctgcacagtttgattggtgaatcaacactttaaggtatctaacccataaggaagagtgaaaaacttccccagaggtattgaaatttcactaaacctcttcttggagttttggtgtatgattctcagttgatctttgagtgtaacagtcaactattaaattggcatgactgaagtacagttttttcaaatagaagagtattttagaacaaatgagaattctaactctttaactgaatttctaactttacattttgcccgtacctctccttgtaacattcttccctttttccctatatatttttaccagtaatcctttcaactgctccttaacagtgagattctactgttctggcacattataggttctctttaactattttttgagtgcacaaatgaccatttggacaaatattataaaatgaacaataaaaaaccttaattatgcaaattaataagtctatacctttgggaaaaaagccatgatagtaacaaaatgaataacaattccaaggatatttaggaaggataaagcctagaagattaaaaatgagaaattttagaatcataaaaaacaaaacgaaataaaatagctcaataccattgaaagcacatgtatgcagaaagaagctaatatattattgtaaaaaattaaatggaaagaaattagaaatctattggtattattacatcaaaagcaggaagttctttctttctggtccaactttagagagaagaacaaatttgccagtgccaccaagggcagaatagagagagatgtttggaatttaagagttacaggttatgttatggttcatttatatcattgccatcactgcagttcattcattttgtgtctaattattgatgttgccacggttgtcaataaacgctcagcattactaatcatcagagaaacgcaagtcaaaaccacaatgaaataccatcttataccagtcagaatggctgttgttaaaaaatcaaagaacaacaggtgctgcatgattgtggaggagagggaatgcttacacattgttggtgggaatgtaaactagtcctacctattaggtactgtgctcattaccataggaattagggtgggattcctattccaaacctcagcatcacacaatattcctatggactaaatctgcatatgcaccctctgtatctaaaataaaagttgaaattttaataaagatggaactaatccctcatatcacagaattatgtagttgtgggtagtcaggataaagaatatttaggatataatttaaatgaattcactagctctgaaaatgaaagaataaacagaaaactaatctagacattaaatttttttctttccctaaggataatgtatagtccctaaggataatgaatattcaaggacatactgtaataaatcatatacatttattattaatataatatagtttattgcacacacacactatgagctccacgatgttcgttgaactattacaaagtttaaagacatacgaaattacagtaagagccatccatataaaaataaaatgttagtgtttggaaggaccaattgtaggagactatattggcgagttaatacaaaagatcatcttttgtttaagagttcatatatttttgtgtaaattatatctatttacagaaattttctttactaccaactgttctcaaacccattcactaataaataattactatatgtgattacttaatatttacctcaaacctttatgaatatcactgaaagcattactggcaaattaattatataggcaaatggtgaggatctctcaacctcacctctcaccttcttcccaatcactcgaagactgactatatcaatttgtcttgttatccagaaattggctttatttgttaattccagagatgcttcaactgtagtttcagccagctgtttccttacatctttctgggtggcatcagtttacaatgcatagcattgttgagggtcaaagttattttattttggtattactattggatttttcccccagtgcctcaaaggggaatgttgagtcatggagatgtaatgtgactccttaaactaagtagacttctaatacaagtatacttttattatggagaaaccaaattaattttatcaattaaatgagaatttatttaccatttgcctttaccagatatttcattagacacaattctcagactttacacaattacaaagaatgttgtataaaaactatctataaagcaggagatatttcattcttagttttttgccaaacaaattatgttgcttcgaggaacagagggaaaagaaacattgatgaaacacagccctcaactatggcataaagtccaaagcacagagaaggtcagaaaagaataaagcagttttgcagaattattatgatagggagtactgataaagaagagtcaactttttggccttagtcatttactgagttcctttattaaaaatagagcataaacattttagaaataattttttctcaatctttttttataaaacctctacagaaaaaagaagcgttatgtgaaaagcagctaaatgggaggaaagtaggggtctgtgggtgaaacaggaggttaccattgcaaaccctgtccttgatgccctcactcagtaggactggtggatggaagaagtttgaaaaacttttatgtagagatgaagaaaagtagaagccctagtttacagagaacgaaagatacatttttcttctgtgtaggtagagtttgtatttggagaaggaggagactcctttcttctgatgaaaactccttcttccaagagaaaactccattaggaaaaatggagcagcagtgagtgagagagaccaggtttaagatttgttttggaggttaaatttgttgtggaagttgacagaatgtggtgaaagcaagacacatcataaaataagccaaaaaaaatctctctcttccagctcattgtatattggagagttagttgacttttctactgtaaatgtaaagaaaacaaaagtttcattcatcctcctgtaatgatgccaatctaatttgctattaaatttctattcaaaagccctattttgtttagttacaagggatttgatccccttaaactttcccaggcaatttgtatggaaaggcggttgctaagggtattcctaagggaactggcaaacgttggaagataaataacctcagtacaatatgcagattaagtagaagggatggtttaagagttaccttttgaaggaaaaataaaagattcagaattcagggctagagttgctagttaatcactgatttgaaggtacttaatcaaggcagttttattttattttattttatttatttatttttttttagacagagtcttgctctgttgcccaggctggagtgcagtggcgcgatcttggctaactgcaagctctgcctcccgggttcatgccattctcctgcctcagcctcccgagtagctgggaccacaggcacctgccaccacgcccagctaattttttgtatttttagtagagactggctttcatcgtgttaaccaggatggtctcgatctcctgaccttgtaatccacccgccttggcctcccaaaatgctgggattacaggcgtgagccaccaagcccggccaaggcagttttatacttctcaagaaagtagaactttcacattgttcctcttgggaataaaggtaaaattatcatagagaggaaattagagagaaatgttcaccatttccttccttatattcttcctttctttcctctctctatctctagagctcttcctcaaagattcaaataaccaaaaatatgaagccatgggtggcagcttggagttctcaaaagtccaaagtgaggttagcttctgaccaaaacttttggcaatttccttaggttgagtgaaagaagcaatgtgaaaaagcatgagtttagagtcagtcagccatcaatttaaaatcaaactccactatttattattggtgtgatcttgaatacattagccaacctctttatagtccagtcatttctaaagaggtgattatctatgaaacctgtattacatatacaatgtgtaagtactcagtaaatactcagtacttctctagtatctctctaattggatttggctagtaatcatgacaattgtgggagagaaaaaaaaagatatgtaatcctgagggcactcagtctctgtaacaatcacttgataaataatcaggtgatacttcgttgacatctctttaatcttccaattgagaaaacattaggagtagaagaaaaatgattaatctccaacttctgtcattggaaaataactaaagatcagaactataagaaacataaaacttttctagattattaaagttaaccttttagacattttccacaatcacatggtatgcaaattttaactaaattattttacattaaatgtattttgtgctatgttttgactagttgattttactgtagtatagaatgtattatgacattccattatcctcttattactcatcaataaaaaatttattgagaaaacaattaattataattaatatttattattcattactagtaggcattgtagtaattacactattattggtattttaaatatcattaatagctataaacatgttatacataataataatagaaaccatttgtggagtgcttactgtgtaatacattttgctaagcattttatatacattcttaaaattaataatttcaaagatttaatgagctaagtgtcaccagataaacgagaagacataataatctttatttattaaaggaaaacttgccatatccacacaatcttccaaagcactgatagaacagaatgatggcatgatggcatcttaaatttagaaagtgtcattcataaaagtgtactgttaactactaatttgtgctatctgcaataataatattatattacacaagatggaaaggctaccccctaaaagatagcatttgataaattgtacataaaaatctagaagaataagagtataacagaggagtgaaatttgatctgaaatacagagaaaattaagaaaaacaaaacatgttagccctactggaatttgtctcaatgtatttcaaggttcaaagtatagcagaggaagatcattgacactgtcagaggattatcattaaatttcaacccaaaggcaactaactcaaactatgcagatatggaaagtagtgtttcctaaaatgaaactaaggcaaatattatttattctagcttctactcttttgactaatcagctgacccagaaattaaatatttaaaggcttaaaaataatatagttttaagaagttgacctatacgttactaaataaaatgatcctcgttgtatttgaagtagctcaccatttaaaaatttaatctatgtccacccattttctttcttcccaaataatacaatgatttaattaccccacagtttaatttgacagaggagccaaaaagatacactattccttcattgttaactttaaggagaaaaatacactataaactatattagaaatcttattttttgggtgtccaccacaatgttttcactacaaaatcccttgctgcctgaatacaaaatgttaccattcaatcagatgagtctccatgaagttagaaacattcaagtgaaactcataaaataaagaagatatactctaaaaattccagttcttgagaagctgtttacacacaaaagggctattaaaagtgaaagggtaagtagaaaatcttctgggctcatttaataaaagaatgtagagttccatgggattcttttctaaagaaaccactaacaatgttgcagatctacaaatcctaaaagagtgcataatggactcaagtctctgctttgtgactcatgggtgtacttcatcaggatgtacttcctcttttagggggtcatataggtgaataagctgacaacaccttcagagagagaaattccacatgtgtcataggaatagaatttatttgatctcaagctttctatatatagaaaaaaaacaaattctaatccaaactttaatgaattcagtattgttgttgttggtttgcctctagaatgtctcttttgaccaagtcacattcctttaaatttacactaggtaaattatatattttccaaatcttttataaaagcataagctaaatgagataacattaaaaggctgattggagatttccctttaaaagcagtcataagaacaacagcaataataatataacaacaatatacactacattttgggcaccatgctttgaatttatatacactaatattattaaggcaatctgtgcttttgagaagctactccagactaggcactacacaaactctgccacacacaagagagaaacaatttcaattacaaagagagctagaaaataaaatggataagagtatcatgaaagattttttgtaaaactgaatagatcctttcatgtttctcagttttaatctctccaaatatccctattgtctgctttttaaaagaaaaaacactgtaaaaattctgaaaaaattattcacaaagaaaacttccactcgtttatataaagcattattattaacttcataacatgcataatatcatctatttctgaaagaccattgaaaagtagccataaaaacttaaaaaattgaaaataatctttagagatcaacaggccaggaagagttctaagaatatgcattggcctttactaaccattttcaatgccatgcacttttgtctgtcaatactttctcctgttatttttaatatccctagattaagaaatattaacatctatttacaaaaaaatattctaacagtttcccccacaaaagcatattcccatgaagatcaagaaaacaaaaaacatagcagggagtcagtattctgacagccttttagtcttcttcatcttcttcctactattattattagacctactgcctattaccagtaggctttttaaaggtcttggacataaatatcagttgttaagttgctattttcatggtcatttaaaattatttcaaccataaatgcttttaatttcctgaatatcttaaagctgtctaagtataaatattctcccattatattcctctgtgctaacacaataatctagttggagtcaagtttcatgaaaataagaaaattggtacattataacattttaaacactgaaaaataaacgtgatagctgtaggatgtaaagtgtagtcaggcctgtagaacttcggatgcatcattttacaatatcatttatcattttgataaaactgaggtcaagtttctaaaaatacaacttgttaaaagcaggaataaatgaatgagagatgagtcagctcgtttgatggaaagggtttaaaaaatacttcaaaagcataccacatgacttggtaaatattcagtgtatcaaaatgtagttgccatctggcattgatagactgggctagaatatgtgtttaaaaagaacaagaaaggaaataactcagccaggttaatgtgcacttgtctacatttcataattcaggtattaagtgctttaataaatattcactatgaaagaaaggctgcattacaatcagacttgggcagtatttgttggggacagctagaaagaaatgaaagaagacaagacctgatggcacttaagaaagctaaaaacaacaataaaaaagtggtttaggtaaacagaattctcaatcatatgtaatattgccagaacactagtatcacagttaaatgcagggaagtggtaagcttatatttgaaaataaactgaaatcttgcttattttcagctttgaatattttaattattcttttctttggctttgacaatttaaaagtatagagaaatccagggaataagtaaaacccttggttggatagtaaaaaaaaaaaaaaaaaaaaaaggaaaaacgaaaaagtcctgacattctttgaagttttaaacctagagtttgatattaactttgcaatatgcaacaaaacaaaaagtaaatttgaaggactcctcttttctccctcttgctcaagaaataaaatatatttagaaagcagtatcattcacaaaagagaaaagtgaacacgagcagtgaacacttgcccaagcgttcgactgtccaaggctgtatctgggcttgttaattagatatttctgtctttaaccttgaacattctccagatttccaaatcttgacaatttacattctaccacatctcttggaatcagagcaataggcagaagagaaaagttttaaaacagctttgaaggttaattaggacagggaccagggtagccattaggaaaatagatgaagcacttcaggtgagagttgattagggtcaacatgaaatttttcagagttgaggtataatttatattcagcaaaattcatggacttcaaaatgtacacagaatgagttttgattttgataaatttatacacctatgtataaatatgtatatataaaaatgtatatatttaccaccataacagagacatagaaagttcctttgtgcccccttccagttaatttctatctcccataaacaaccagcattctgatttttatcacgatagaatagtttcgccttcacataacttatgtatactcttgtgtcctggctcttctgcataccatgtttctggaattcatctacattgttgtatcatactctgttttgttttatttgcttgttagtatttcattatatgaatataccacaatttgtatatccactttccacatttgggtgcttccagttttaggcaattacaaataaagtcagtataaacttgcctgtacaaatctttttgagggcattattttcattattttttggtaaataactaggaatgtaattaccaaacaatatggtaggcatatgcttaaccttagaagatactgatccaatgttccaaagtagaactatatatttacagaaagtcttgaaattaggtaatgtgagtctttcaactttattctttttctaagttttctgcaatctcatatacattttaaaataaatttgacaatttatcttaatgttagaaaaacaagatgttgatattttgatggtgattgcattgaatctacagataatttggggaaaaatgacactttagaaatactgagtattcatctataaataacggatttttctctaaggccttttaaaattttgagtggggaatcttacattcttttgttaaacttttatttaaatgtcttatatttataggctactgtaaattgattttaaaacttcattttcaaattatttgccggtactacataaatgcaatcaatttttgtatattgatcttgtgaccttcctaaatgcactgttagctctattagttgttttgtatatcccctaagagtttctaatgtaaacaatcatggtatttgtgaataaacacaatgttacttcttcctttcctatgcttatacctttaatttattttactcgtcttattgctctggctaggatctttagaacaacgctgaacagaagtagtaagaatatatatctttgccttctactatatcccaggaggaaagcattcagattttatcattaaggacggtattaattatatgttttcatagaggcccttcatcagattgaggaagtttcaatctgttctaattttctgagagttttcactgtgaatgactgtcaaattttttcaattgctttttctgcatctattgagatcatatttttcttctttattaggatgcatttacagtgatttattttcaaacgttaaactaaagttgcttttctgagataaatcctacttgatcatgaggtattatactttttactttttattgttgaagtttgtttgctaatattttgttaaagattattgtgcctagaaccatgaggaatattggcctatacttttattttcctgtaatatctgtcaggttttgctgttgggattatgcctgtctcataaatcaggaagtgttttgtttttacctcctatgttttctgaaagagtccgtgtaggattaatattatttcctccttaaatgttatatagaattctccagggaaactatctaaacctgaagttctttttttaggaatgcttttgacgacaaattcaatttctttaatcaataaaggaatattttgatttctttggtttactatgccagttttgttaatatgtttttaaataaatttacctattttatcaaagttgttgaaattattgacatgaagttttcataatattcccttgttatcctttaatattgttatgatatgtaatgataatctctcattactgatattcataatttgtatcatctcttttttcttgaacttttctgttatagcttataaattctgttaatcttttcaaatattcatgttttgctttcattaatcttctttgtagtttgtttttatttcacagttttctgcctttgttatttgttttctttttttactgcttttgggtttaaaatgattatactttcccactttcttaaagtggaaacctacgctattgatcttaaacctttcttcttccttctaatttaggattaaaagctcaaaatttctgctaagcttctctctggctcatattataaatgtcaatatattgtattttcatttaatcagtttcataaatttcaatatactgcataacttaatttaattattttaaaatttcatgactttcaaccatgaggtattaagtttgttgtgtagtttccaactggtcttttctagatattttattgttttctttttttatttctaatttaattaattataaacaagaagcatattttgtagtatctcaatcttttgaaaatgtttgaaactcatttgatgaaccagattagggtctactttaataaataaagtagaacatacatacaggactctattcctgtatgttttaaatatgttttaaagaacacatattctccaggtgggaatagaacacattctccaagtgggaatagtgttctgtaaacatcaaacaggtcaaggcagttgatggtgtttttaatttcttgtgtattcttactgattttctgcctatttgttctatcaagttctagaacaagaatgttaaaatctccaattgttattgtagattttactatttctctctagttttctgtcagtttgtgtctacatgtttatgacttatgcattcatgataatttcacacatatgattaggaaatatccctccttatctctaatagtactccttggcataaagtctattctttgtaatattaatattccaacctagctttctcatgcttattgtttgcattgtatatatctttctatcttttcactctcaagatatccatgttattacatttaaagtgtattcctgtagacagcatatgttgactcttgcctttttattcagcctaatactctctcttttaattgtagtatttataccatttacagtgaatggaattattgctacaattaagtttaggtctaccatttatttcattatatgcttttgatttttttcttttgggtttttgtcattgttattcttctgttttcctttcctttttttttttttttttttttgagacggagtctcgctttgtcgcccaggccagactgcggactgcagtggcgcaatctcggctcactgcaagctccgcttcccgggttcacgccattctcctgcctcagcctccccagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggccttcctttccttttttaatgagttaaactgatcaattatttttccattcaattgcacaactggctttttagctgtaccttttttgttattttttagcagttgttctaaggattacaatatgcctctttaattatcactgtttacacagagttaatattttaccactttatgcaaatgtgagtatcttataagtataatttcatttactgccacccagtactttgtagtatttttacatacttcatatctgcaagtactatagactcatgagaaaatactataatttatgcattagtcagtttttcttttaaagaaattaaaagaataaaaggatattcttttacatgtaaatagatactttaaaatttttagtgaaaattttctgtaaaaacaagtttctatcttggttcatagtgtcatttcccttcaccctgaagcactcactgcctttcacactacttataggaattccactgacaacagaaaattcatttcttcattattgcaagatcacattgctctacataaaattctggttttgcagttgtttttcttttcaatcattaagaaatggcattacatttagtatgaggaatgagtcgatgtttgattattcccctgtaggtgatctattgtttccacccttagggctgcctttgagatttttctttgtatctttggtgtacagaagtttgaatacagtgcctacatgtgattttctttgcatatttttgtgttttttctcagcaaattttggacattttcagctatgatttcctcaaatatcatttctgtcccattttctcatctgccacccacaatctgctgttaagattctccaacaaatcattttttatttcagattctgtactttaacctttggttctttttagtaatttcatttcttttttcttcttctgagacatgcaaagtatagtggactggttgatattgttgtacagatcactctgcacatttttgaatcctttttctctctgttctttacattaataatttctattgacctgtattcaagtttactgacactttcttctgccatctacaatctattgttaagccacttcaatgactcttcaaaaaaatttcaggtattataccttaactttttacttatttttgaaaattttcatttctctgcttattttctcatctgttccctcattatgactatatatatacatatatttttagagacagggtctcactctgttgcccaggctagagtgcagtggagcaatctcggctcactgcaacctccacctcctgggttcaagctatctattctcatgcctcagccttctgagtagctgggattataagcatacgccaccacatctggtggattataggcgtgagctaccgcaccgggcctgaaaacatatttttttaaaatcctgaatatatttataatttctgctttaaagtccttgtctacaacttctgaatcatcgaggaatctatttccatggactttaaaaaaaaattacatgtcacatttttctgtatccatcactggtaatttttgaattacagttgaacattgtgcatgatatttatacaaactctgggtttggttatctttctctaatgcaatgcatttttcttctagcaggttattaaattactagtcgaccactttgatttgaagaggactggttttattatttgacagaaactttcaatgcttcaggtttgtctctctttctataattaatttcttagttcttagctatcatctatatttctaaggtttgatccttctgggattcataaagcctgagacatttaccaaacccttctaactttgtaaactcaaactcctaactttgtctcctcttcatctaatgtatctgttcagctcttttagctttctagttgttgcttttctccaggcacttataggctcccacatacatgcacagtttatatcagccagaatgttagggtaacttatatgtagattcatgggagccttccctcgatggctccatcctttctaatacttccttcctcaatttcagctactttgccaatgccagctccattcgctaacatcacaaaccaataagattgtggttttctgcctgaattctaacttctctataccatacagactgggaagttccttgagggaagaagctgtaacaaacgtgaattttacccgggacagttcactccagattccaactgcttttggtcactctccggtgccttcaaataattgtggtgttttttttttaagtttttaattggagtttagttttatttttaacccataccatggtttggaactgttatctgtggaaatatttgtcctgaaacagtacaagttactcctttattaccaaaatcacaactaccaaaattgtggttttatgttagatagcacttgaactgatatggaaaactgcattagaatcaaagtgtctatagggcttcctctctcaatattcagtattttaaaattgagacaagactattttttaaccttaaaaaaatcactcatagtgccctaggaaagtgctatatattccactcagtcgctaaatatggccaatgaatatttctataattaaatttagcagaataatctgtgaataaaatgaaacagacctgtatgtaaagaaaactaccttaatgaacttgcttgggagatcagtggtatgtgatatttctaatcatgacagagaagttgaacatgtggtacagttgtgtagggaaaatggataactcttatcttcattattttttaagtcattctaagagaagcatttgctaagtagtttatatatatgaacttatataattttcataacaatttttaaaaatagtattgtaacattattttgtagatcacaaaactacaaagtatcccaggccatcagactccagagttaaattccaaccattccctctaactacctgctcagaattgagataaaactcatccacagcagtcatcattttttctaagaatatacatcacctattaatgttctttcccatctcccatgttaacaactttcttcctctatcatgtaaacttgctctctatcatctccgtgcctttcttgttcattttcatggagcagccataaaatggagaataacaattgaagcagtgaatagccaagaagcatctctcaatcaatgaacctgagacagcctgttcacttctgtccatcattcttgtcctttagatctcagtttcaaattcatttcttctagacattcatctcttcccatgtttaatctggaaccatctacccttccaccagaccaattatcctggcaaattaatgtaatagaccagtattaattatttgcttgtatgtcttaacaacattctaggtgctgtgccaaaaacaaatgaatagcaacacaaggtcttctggttacaagcacattacattttggttggggagattttgacccatctcacagtcataatcttcatccaggttatctcgtcaacctctatgtatgcatatattccaatattttgttttgcttttctttcttccttgtagtaatttcacacagactattcgcttcaagaacctaactaacttcctgttggtacccaatcctttaactctagagggtcaaatggagccctgtggctcctggcagtgttcctgaagatcaggtccctctggtggaactcagttctcactgccttatctaaccttcctcactcagcttgtaatcaacttaacttttaaagtctttgtacacattaggtaatatttgttctctgaactcccagaggggctgtggtaactgcccaactaggaagccctacccttcattattcagcaacagcttgaagaatattctaattctaactttccgccctctgacagaccagctgcatcaaaggctgtgttcccctgtttgtttttttcctgaagcagagtcaccatttcaaactaagtaatctatgagaaaagtaagagctctgggtccaaatgtttaaaacatggctcttctgtgaaccacggcaaatctaaactggattatgccttatgctggagtcagaacttacttggtcccttgttctttgccctctggctccctgcatgctgttcaggggaagttactggcttttgaactggcggtttgaaaacgaaggcatttttcttttagggagaacagtctttcagtgatttaaacaacaagccttgtgatcaaaataattcataaaggaaaagatttatgaagtgacttcactagcacacaatgcattttaaaaactttgttttttaaataaatctgtcagtacagaagccaagacaacacatctgaatgcaatatcagtggacacaccctgaatctcttcttctttgcttgtccaagactgtggtagaaaagggaaatgattctctttgtcttttcttatttaatattattattaaaaattttttaaaaattctagttccatgaaaagactttgaaaaattgtgcctacttttgtttcctgcaggaaaacctgccttgtaaaaatgtattttccattgaccacttgtgcttgtttaagaaaataaaaaataaataaagaactccaacttataatgaatacctctggcattagggagcctgttctaatctccctttatcaagtttgagtgatagttctgctcaacgagtattgacagggccgtcctgtttctcaggctttcgtttccctcggttggagaaggatacagtgcattttcacattctcaaagtctgcagttgtttttatataagaagcaatttgcttgggtcacgtcaggtcgaatgggatgcctgcccagctcttggttttaaaggaaaaacatacagaaagacacaaaaacacagcagtttccttcattaaattccactctacctgccatgggcttctagccacaatggaatttcccaccctggcctagcctagcctaacttttatttttagggattttttttcccctttaaatcttatgagctttctttcaagtgaactttgaggtaaggattattaaatgatagagtaattgcctggttaaaaaagaatcagacataaaaaacaaatgcctagtgaccttccataatatcgctggataaccaccccctggataacagcctttcaaaaactgttcataatcagcacaacaagacaggtcatgtaatttaaaattaaaacctgaatcatttaatgaatagggatcagcatttttttcaatagtaccctcttcttacctaattgcattggatgaagataattttggagaagaaaatgaataaatgaaaacacaaggaactagataaatagatggggcgggtggatggggggtggagagagagacagcaagtgagagagagaagcttttggacctctctctccaaaaagccatttatgcttttccccattgcctaggggcaactgatttaatcaggattgttcatgtggattatctaaactatgaaaagcaacagggagcacttcccaagaaatccagactgggtgtgctgcagaatacttggtttggggcctggagctaagtagactgttcacattgtactcagggtcctaagaaaagtggctcagtgtctctgtaattctttgtccctttgatctacctcaacatttggtgtctcttggcattaggaaagctcacgaaaatgaccctgcctagttaacagattcatagtctgggcacacaaaaaaagggtaagaaagaaaaaaagctttggtaatgagggagagaaacgtaccttcttgctatctttgctgggcataaataaaaatcgaaagatgtgatttttggagatgtgaatcccgttcttcccatatttagtaatagccttttcagagccaattcaagaccttctatcaaccacctctgttaaacatatcaagttagatttctcattcattattttcaagctggattttgcataatcttccttcaaatgaagaagtttacttttcgaacatgtcatttgctcttagcactgttgttctccttcacccattttggcttcttatcctcaaatccctgattccttattaaagtggattgttaatgcagccattctttagcaccacagcacatttataaatcaaaaattagtttactctgcctggcttccaaaaccatttgctgcttgaaaccatttcatgagtttgtctactcatgtgaataaataaaaacttgcctataatgtgactttgggaaaggaaagagcaactatatgaaacgaattctacagaggccaaaattattttcacgagtttcatggattcagcccttgcatgtgccattctacattaactttatctctgagattaggattttgcttctctttttttttttaattatactttaagttttaggctacatgtgcacattgtgcaggttagttacatatgtatacatgtgccatgctggtgcactgcacccactaactcgtcatctagccttaggtatatctcccaatgctatccctcccccctccccccaccccaccacagtccccagagtgtggtattccccttcatgtgtccatgtgatctcattgttcaattcccacctatgagtgagaatatacggtgtttggttttttgttcttgcgatagtttactgagaatgatgatttccaatttcatccatgtccctacaaaggatacgaactcatcattttttatggctgcatagtattccatggtgtatatatgccacattttcttaatccagtctatcattgttggacatttgggttggttccaagtctttgctattgtgaataatgccgcaataaacatacatgtgcatgtgtctttatagcagcatgatttatagtcctttgggtatatacccagtaatgggatggctgggtcaaatggtatttctagttctagatccctgaggaatcgccacactcacttccacaatggttgaactagtttacagtcccaccaacagtgtaaaagtgttcctatttctccacatcctctccagcacctgttgtttcctgactttttaatgattgccattctaactggtgtgagatgatatctcatagtggttttgatttgcatttctctgatggccagtgatgatgagcattttttcatgtgttttttggctgcataaatgtcttcttttgagaagtgtctgttcatgtccttcgcccactttttgatggggttgtttgtttttttcttgtaaatttgtttgagttcattgtagattctggatattagccatgagtaggttgtgaaaattttctcccatgttgtaggttgcctgttcactctgatggtagtttcttttgctgtgcagaagctctttagtttaatctacgtctgattggtgtacctgaaagtgatgtggagaatggaaccaagttggaaaacactctgcaggatattatccaggagaacttccccaatctagcaaggcaggccaacgttcagattcaggaaatacagagaacgccacaaagatactcctcgagaagagcaactccaagacacacaattgtcagattcaccaaagttgaaatgaaggaaaaaatgttaagggcagccagagagaaaggtcgggttaccctcaaagggaagcccatcagactaacagcggatctctcggcagaaaccctacaagccagaagagagtgggggccaatattcaacattcttaaagaaaagaattttcaacccagaatttcatatccagccaaactatgcttcataagtgaaggagaaataaaatactttacagacaagcaaatgctgagagattttgtcaccaccaagcctgccctaaaagagctcctgaaggaagcgctaaacatggaaaggaacaaccggtaccagccgctgcaaaatcatgccaaaatgtaaagaccatcgagactaggaagaaactgcatcaactaacgagcaaaatcaccagctaacatcataatgacaggatcaaatccacacataacaatattaactttaaatgtaaatggactaaattctccaattaaaagacacagactggcaagttggataaagagtcaagacccatcagtgtgctatattcaggaaacccatctcacgtgcagagacacacataggctcaaaataaaaggatggaggaagatctaccaagcaaatggaaaactaaaaaaggcaggggttgcaatcctagtctctgataaaacagactttaaaccaacaaagatcaaaagagataaagaaggccattacataatggtaaagggatcaattcaacaagaggagctaactatcctaaatatatatgcacccaatacaggagcacccagattcataaagcaagtcctgagtgacctacaaagagacttagactcccacacattaataatgggagactttaacaccccactgtcaacattagacagatcaacgagacaggattttgcttcttaagtagatgtcatttttctccagtaaaaccaagtggtttaccctgacatttagtagtaatttagtgatttcagagttccttctaaatctaaagtaaatgttcatgagactcatgaacttgtatctagacaattaatctgagcattttaagacttccctgaggctacatataatctctcacaaccccttgcaaaacctgagattttgaaccactgtcaagtttgtggttgccctggtaaggagtaaagcaaaatcattacttatggcaactaccacacaaacattgtagtgaactgaagtataagaaaatcactactatactttagacagaacattaggattaatgctggtaaccaaggaactaagagcctgtaaatataactggcttaagaaggagaacaggattaaacaatattggagtttagaaacaaaagtagtactgtatcaacctgtcactatgcagccagtcattacaataaaactaaccaaaggatggcggcagaaagaaataaaagtatttttgtgtacaattcttcttgaagcactacttgaattgcatctgtagggaacaggtctcataggtctattatttgcccacctccccaacacacacacacacacacacacacgtactagcctaggccgatatctactgtggtaagtttgcatctgtgagccactgagcagctgctttatatatgcagcataggatgaaagagagaaaactggggtactcatggtttttgtgtaatatcacaaagaaaagaaaacaaaaaaaggcttagagaaagttaaaggaaaatgggcagtggtacatatacagaacaagttaggattccctaggaactggtaataggactaaacttgcttaacatctatcaaaatgacttacttattccagggtcttgcatatacatagcagaagcacaattaatttttgctgaatgaataatctggaacaaggaatgtaaaataaattatccaaaaatgttgatggaatgaaacttttctgagcaaggaaaagctaaactgatggaacacaatatttatccaggtgtgcagaaaggtgccagtgcaaatagagaaaaacaaaatattcaaatacagtcgtttgccgtgtaatgacattttggtcaacaatgaaccacatatatctataccatggtggtcccatagattataatactgtatttttgctgtaccttttctatgtttagatatgtttacatatgtaaatacttaccatctactctgttacaattgcctacagtattcagttcagtaacatactgtacaggtttataaggtttatggcctaggagcaataagttatactatatagcctatatgttagtagtatataccatctaggtttgtttaagtacactctatgatgtttccacaatgatgaaattgcctaaggatgcatttctcagattgtatccccatcatcaagtgatgcatgtctagtttaattataagtcttacctaggaaagggacttaaaggctatgagctctttcaggcaaaaaggccttcaaaattttggcactcattaagtaaagtaatgaaaataaggtttataattcccttatattaaaccctctgcaattatgtgaaactatctgtacttcaaatgccatgttcctataacataacaactcagggtgtcttacacaggacagtcattaaagagtttaaggtagattaaaataatctgcattagtagagaacaaattattttgcggtattataacaattcattgaacatgagaaaaagcaaacaaacacgcttgttaataaatgttacttaacagacatcacactgacatttcttagtgactgactgccatggaagctttctaataagtctaatttttcccacgctctgagtttataagatagcaatattgtagctttgggtgtttacctttgtttatttattgggcggagttttattgcgtgcctcctccagctgtgccaatctggtaagatcaaatggaatcctttagctattgtcactatcctaaatggaccgcatgcttcctttgtcccttgcattctctgattttcgctgggggttatctatcatggctgtacatccaagtctctaatctatctcctttctcatccgtttttcctgacttatttcccttttccctttgtctatttccctgtgagaagccaaaagactgtatagttcttagtagcggtagtagtgctatctagagttggcatccaacagcaccagtgttataatacactttctacaatcaagaaatgatttgatttccttgcctcagtagaaattttacaagttaacagtggttcacctgatataaaccataatatttctatcatatcatgaaagaattctaaaaaatctgttagactttcttctacaagtttgcctatttcctctgaatacagttaattcacctggcaacaaaggagattagctatttctttttgtatgcagacagaaagaagtgtgatctttctttgccaataaaaacttctagtaagtggtgatagacttcaaaacccttctttttatttgaaaatcatggttcagttatcaggaattccaaattcagaatctaagaacagtgatcctatatagtcttgtgattttgcacatgctagggattggtaagttgctgaagacttcttaaataagagaggaagcatttttcttttcacttgcaaagaaccaggaggtacattaaaagaggttttagagtaactagaatgtgtgataaactgttcactttctgttttaaaactgtccatgaggttccctttagagataggacagactacagagaacgtggtgtctcgtttctatgggttgaaattccacagaacaatgctttgcaaagagtcataccaccagttccttttcctgtgagatgcaaatactaaaaacagatatgggctggacaagattattttaaaaatagatagaaggcaataaaagctttggtgatattctagattacatatgaaatgtgtaaaagcgtaaaatgaaaagttctctactttttaaaagctgcatcaaaatttccttcctacactgtaatcgtgccccttaacccatctatgcctgaggttgcaatttctttgaatttctgcaatcagaccatggcgatgaccttgagcagtaggatataaataactcctccatgcttagcgttccaataatggaacactaggcataaatgggataaaacacaaattgctaggttcatgataaacagagcacatctgtaaacaaaataacttttaaaaaatatgcctacatatataattttattacttctagaaacacaagtgttattagacttaaagagagccagtgaattgaatcaacttattctgatatgaacctcaatgtgatctgattgcaggctgcaatgattaacacgttttaaaagaaatgggtccatactatactttccaactgcccacccttctgttcttcttatgctacagatttatggcagcctaacctccagccaacaagttagagaattgggtaagacatcattttggctttttaagaaaattatggataatcaaaaaacatgacacaaaagatttagtggctattatcagggtataaactaataactaaaggcatttatgtgttaggtaataatgatgcttagaaaattataaatatcaagatgctctttcaacaactatattccagatttaggaattttgtagaggatatggcataagagtgttaagaaatgtatacttttttgaaaataaaataaagtctgatttatttattatccaagttcctgtgttttctgggaaaaatgtattaatgagaggtagcattatttgatagttaatggagagtggaaatcatctgttacaggcccacatgctcacaagcaaaataatattctctcaatcctcaaatggaaatggggattataaaatgctataagactctgtcaacatttctgataaattccatgaaaattttgtgttacatattttaaaaattgtgtactatgattataacatagttgattattaaatatgtaatcctttctttcagattattcttcttccttaaatgtaaagggtatattattttcttgatttattcttttggataaatatcctgtacatagatgtctgaaatccagcccgtcagtttccctttaaattctagcatattttaaaggaccttaaaagatgactgtggagtactgcctgatttggaacttgcctctgtctcttacacactgtatgacgttgggcaagccacttaacttctcagtacttcagtttcatcatcagtcagaacagcacaataatagtaccctgctcctatggttactatgaggattagtgggtttcatactgtcaataataagttgcctttctgggtctttgaagtacttgaaatcaggttaattaaattaagcagagctttggtccctttgtttgacaagtaatctccaattttcatttccaggttctgatcccctaaaatcagtggaataaaaccttgtttgtgtaactgccatcttcctgccccaaagccaagattaatttacctgttggttttagttttcactaggtctctctttagctaggtgcttctaagggtaaaatatcaactattaaactatttgaggcaggagatgttgaaaggggaatttaattgttaagtcaatagcagtgtgccagcttagtctgcctttcagaaagatcaccatagtaataacgagaccaataaataaataaaaagtataaaatatacatctatgcagaatcttagaaccctttctctaacacataagtcattaaaggaagctctgaggtctgcctatgtgattcaacatttacacacatcatagttctatggaagaaattctcagttgagagctaccagctttcttcagatcggatcagatttttctatactccattataaacaacaaaaacaaaagcaaacaagtgaacaacaacaacaaaactgtagttgtggttcactccagtaatatatactaccaattcagtggttcttaactgggggacaattttgccacccccttccccaccaggggagaactggcaacatctggagacaattttgataatccaaactgaggggtgctccaatggggagaggtcagaaataccactaaacatcctacagtgcacagaacagacatctaccctgcatcccggcaaagaattatctactccaaagtatcatagtgccactgttgaaaaaccctgtgctaaactaacatctgagagccactggccttaaaccatcagccacatcaacacgtaagacactcagcctatgggatagtctaacagttaaagaagacaccttagagggaactacttcaaaaatatataaactgacaaatctggataccatactaaggaaaaaactggtaaaacaggtagttgtttgaaagcttcttatgcccattattataaaccaataattttagattactgaaccaaccagactaatattccctttgaattccaggaggtataaaaatatgaagtcatcgactatgcaacattatcctgctatggagacattctgaaatggtttataaaagcagtgaacacattaaaaaaaaaaaaactagcccaaatgagttatgcaaagttaaagtcattttttctaggaccagttttttttcctgtgcatagtattttccatatgtaccgcaaacattcatttgtgcagaacatagcaccacatttctaatacaactcctctctgaagacaaatcaggctaaagctaagagttgcagaaccatttctgtatgagtcatttttagcacaacataagccctagagtaaaatttattttctaaataagccacaattattctgcaaacatttaacctagcacctctcaactgttaaagaatgtcaattatatatgaaaggaagaacaaatataaaggaaatttgaaaatcaagaaaattttttctgagaaaagtttgtgagaattattatgaatacagctaaaattcaaatatgtgacattttatttttttaagggtttccctgtcaaagacaacacatatttttctaatgaaagaggatgcctgaagttgacattcataagagcatttggatactaccaatgtgaagttgtacagatttactcatttctgcaattaccctcttgtgtttgaattctactttggttagtggtagcaagcactaaactgtactgagggcttcgcaaaagttgactttatttctttacacttagaaccccaaaaatttacttcctaggaagatactagggaatcatatcttactgaggaggaaataagaggtggaataactggattagcctcacaaagaatgaaagctcagtaatttctgagttggcaatatttttcaccctccttttctccatttaaatttctagatttaccttcaaaacacttgcctttttctaccttaagggaagttctaggatcagggagatggagatagagaaggtagagatagttttaggttttcacagaagttcaattaaaaactgccaagtacctcctaccaagagaccaccactaaaatttatttctagaacaaggtgcagaaaaataaaaggtagaaagcaggaatgttctggtactgtaaaatatttggggaaaaagtctaatttctgttctcaaaatggttactatcttgctctagagaaaaacataaaccctcttaaaataactgaagaacaataagaaacagtataattaagtgtaaaaatgggtggtagaagcaaaatgctgtggggcacccatgtgtcttacatctttccaacacagagaaaagagacaatgggtcaaatgcagcctactctagtctctgatattagtttcattacacagctataatcccattacaaagaacttgaaggaactgttgacattttttgctgccctggagtttattgtctcaagtattgcttgaaataccagggtacatgcagagatgtctgctctaatggtatttgttgacctacattatgttagggttagcctgaataaatggagaggaacgctacatggaatcagttagttagattgtttgtaagtaggcgtgcattatttttaccatgttttattatttttaacctaaagactacgcatttaaagtagggtattatctgtaagtaatcttgttgttatatgaaacagtaatatttattaaaagtgcttttgtaaagcccaaaaaggggatctgcagaggcagatttactgcatatttaatggagcttaaacctcagggaccttcacttgcgcagccccccttccaaggtcctgtacttaactctgtaatcataattttgtattctttttcttcaagaggaccccccaaatagtttaagcttctggtaaaatcttgatctagcctaggtataaaataatcttgaagggatccaaactgatagttctaaaaggctgatgctgagaaagatacaaaatgtgcttttacaaggatatcatatcaattatattttccaaatgtatctctcttattgttgtcgctcccccttccctgccaataaataaatgccattttttttttttacctcactgttaaaaggttattagacccttttaaataagatcggtctgttcagtgactgggaataaccagagtgttaaaaaaaagatgaaaaattcagaggcagaagataatttccaagaatgaaaagatatcttagagagactcacaaaatgtttcactaaaacagcaataattattatccatacctaaggagtacatgcatttgagaaaaggaagggcatggaaagtctctcaatacaatttacagtagtacctactgaaaactgtgctgagtttacacagagtgtgggaatttttaccaccagtaacaccacgtgtctgtttttctggtttctgaaaaccccaaataaatcccacaagcgcctctaaactccaccatggaattctcacacttctgagtaagaagttcagaacagaataaaaactttggatgcagtatgtctgtctatagtttttcctataatgccttgtcccagtttttgaagaaaactgaataaaaattaattcaagaaaaaaaatgaatgaaattacctcaaatggaatattaaattgaaaaataatagtcaaattgctcataaccacttcctgttaattttttttctcttttagaaatggagtaagaatgcttcaaataaaaaacgtaaaacccatcccatcccataaagggcccactcacgtaaacaggaagcttattaaaagaacttttcttggtttcctggcaaaatccagcttttattttggtggcagcatctattaaggaggagactcattttgtgggcaggatgaaaaattaaacattgcaaatccatcaggtacttgctggattagagttagttgactgacttgttggctacagggaacaaggtagttctgaaaccaaggaacaagctgccaaggaacagtccagccctgcccaaaagatgatggtcttctccatccaggcagcacaaatcaactcgaggttccaagagggccagtagacgccagcctaccttactgtaaagtgtctcacatgcatatctaactgttctctcctttcctttacatttaaatcctgttgtattggcttctctgttttccctttcctggaagcgctgtagcgtaattaaaagagtatgagttttggaatttcaaaacttggtttatagtccagcctctgccaaatactgtgacatgttacctgcttgagccatcattttctgatatgtagattgggactaacaattcttccttaatcagctcaagtttcacaaaatatgggtaaacatcacgtgactcaaaatcaactgaggcaaaaattcagatgtcaatggccctttcttgacttattagaacctccatgagctagaaattcttggaatctgaattttaaactcactcccaagtgatttccatacacacagaagtttgagaaccacatcccaccttgtcttgtgtcaggattaaataaaaccatataggtgaaacttatctgtaaattgcatatcaagacatgcttagctgctctcaatagtatcattttccagatagcccaaagcaccaaagtaaggacagcgggccattttcccaagatctttcttccagcttttccctgccatgccaacagcattcttcatcttcaggtaggcagggcaggttcactgggggttggggtagagctcagcactgtgacacaggcagtacttccgtagaatttcatttatgtgactgtacctaccccacagggtgatataaggattaattcctatttggtaatttactgtgtgtaaaatgccttgagccccttggaggaaagtgctatataaatgtaaaataattattataataataataacctcgactatttaactgatcagtgaattagccagaagatttaggctgccaagggacaaggctgaaaccattataagtagaaacactttacatcatcatatctcaaactgttatcacgaaaaagggaaacaaagggtgaaaattaagataaatccatgttctcaactgatttaaatgacagaggatcactagtaatgattcatgaaagccaggaaatgcaaaaatgacagctgcattgtaattctaactcagccacatgtcctgaggttttgtacactttggtcttttatttgtagggaaaatatctcatcagtgcaacatctaaaatttagcattatgaaggcacttgactatgcttttgcttagttgaaatacgttcataatgtatcccctatttgtaggtaatgatttttctacctaaaaagcattgacattattctatgaagttccaggtaaattttgaatcggttgcttacaatctgcctccccacatacacaccctaagaatacactctaacaaaacaatggtgtatttctagatctaaatttaggaaaccaaaatatatagaagataccttttcttcccaggaagaaaatgctttggtatataaactcacatgagctcaaccgtcttcagctcttacattatttgttttatttatttattagattcatgaagattcttctaccaaaagctcaaggggctgaacccagaactttcatatattgaatgtgaatcacttcttaaaccacagaaaggaaaataaagggctatagaaatcttaatgggcaagctccagatgctcaaaagcaattgtttagttactctacttagttatgcatcattcaaaacactttctaacaatcgggcaagaaaggttcctttgtgaagaacaggctttggggtcttggacaagttttaattctagttgttttatagctcatacaaaatagttgtggtgcatatgtaaagaggtactgtacttacatgcaataaagtttgcagatgaatattttgaaaatcaaagaaaagaaaacaaggggaggaatgagcatgtggtaccttgctctatttttaattattaacttgtagcctcaaagatttccatttagtagaaacacatgtaaactacaatgaaggagtactagaaaataaagtcaattggtataactcaaattattttgtaaaatgtgaaattaagctttaacctgtctatgtggaagggtgatgaataaatgaatgaatgaagtaaaaaatcaaagatacagagttgtaactgattttctttgcatgaagtagtaaatattaatattagaaatatcttttgatttagataaaactggccttgggtatataatacacaacactgaaaaacatttcaaatgtggtatttgtttaaatatatacatacataaacacacacatacacacacaagtcaaaaatatgggtgttctggtatagttttctgccttcaaagggtctctggaaaaaacagaagaaaaggtatcctataaactgcttttgctgaggtctctagtagagagcaaatcgaggcaagtgctgcccaaaataatctctattacaaacatttaaaaaatctatctttcatatatatatatgaatatatattatatatattatatatatacacaatatttttaatttttaattttattttatttgctgtatagctaacagcatagccaatgccctgatcttctagccacactgtaatttcttgtccttgcatcacaaccccagctgtagtcatcaaagtggaaaaactgacagcattgtctgaaagacacagcttgggaaaattgctccttgtagctcccctgtcaatgaatattatcatatttttctcatggataaggttactgtgttttttttgctgggccgggggtggggaggcttctacatacttagctactaagcacattaccattccgtttgtggaatggactaaacgtgacaatgcgagctgtagggttagcattcccaacattctgttttaaagtttttgtgtgtatatcttcaaaaataatattcctttatgtattcagaagaagtaaaatcacaattatattttacttgacattactattttcttaaggaggctaacagaaaaatcaatgggtgggcataaagagaaagaaatcatatgaggctaccacacatattctgttactgaatttctttcacctaaatatacaatggaatgctctgaattgtatgttttcttttcccatcatattaaactaaagcaaagttcttgggctgaaagtagaaaaactgcactttagtgttctaatgatccacacctttcacatattcacttcgcttacaattctagatgctaactcaataagaaagaaagaaacaaattcagagtatttcagtcaccaacaacaacagcagtaacaataacaataatattaatatcagttaatatttatttaactcttagatatactagatgccattgtaatcacatgtattaactcgctaaatcttcacaactctaccagagagtactgttattactccgattttattggtgaggaaatagaggcacagagagatcagaaacttgcccaagatcacacagtcagtaagtagaggagtcaggattcaaacctaggaagccagactctgttacaggatgaatattttggttgctaaaggccccatcttccttacttctcctgatcctcttccccaactgatcagcttgcagcattcatttgatcttctcaacaaattacgtattcatttgcacaccgtccatttagaataacacagtagttaaaaacttaggctctggagtctaatatgagggtttactgccacatattggtagtgcttaacttttctgtgcctcagtttccttctgtataaagtagtaataataaaagcaatttcatgtatttgttgtgagggttaaatgagataatgtatgttggagctcaatggaaggtcaatgttctataaacattaagttcattattattgatttttatctcttaataaatagaatccctttttccaattagattgtttttcagaaaaattgtgaatatgaatcttttttgtctcgtgtaggggttcccaaatgttcagtatgttgaactcttagatgtcctaggtactactgaaatcacgtgtattaacattcataacaactctgtcaggtaatacttacatttacccataatattataaatgatataatataccaatgtctaaaatttagtgagaacttactcactggacaagtgcattatggcattatctcattctccctctaagcctctgaactaggggatttttttttttttttttttttggagatggagtgtcactctgtcgccaggctggagtgcagtggcacgatctgggctcactgcaatgtccgactccctggttcaagcgattctcctgcctcagcctcctgagtagctgggattacaggtgtgcaacaccacgcccagctaatttttgtatctttagtagagacggggtttcaccctgttggccaggatggtcttgatctcctgacctcgtgatgcctgcctcggcctcccaaagtgctgggattacaggtgtgagccactgtgcccagccaactaggggatttttataatctcaagtttatgcaggaggaaacagaagctcacctcggtcatcagctggtaaatgttcacaaatgtaaattcttaaccacaatgccatactacctgctaaaaaatgaatttaaggtagatctttagtaaatatatttggtcttgatgatgaatcaattgaattctttatttctgttaccagaaaccttgcacttaacaataaactaatgtggccttgaccagcagccgccagtccccaggcttcagacactggtacctgttaggaacttagctgtacgggaggagatgaacagtggacaagcaagcattactgcctgagctctgcctactgtcagatcagcagcagcattagattctcattggagcacaaaccctactgtgaactgtgtatgcgagggattgagtctgcacactccttatgagaatctaatgcctgatgatctgaggtggaacagtttcatcctgaaaccatccccacacctccagtccatggaaacattgtcttccatgaaactggtccctggtggcaaaaacgttggtggctgctggcccagacaatatcactcattctgttaactattgaaaagagatgactgtatgtcaggtacatgccaaatactggaaatttgaaaaatatatatatatacattgtgggtctaaaactgtatcattaaaagcagctaatgatttaatatcatttcatttactatcattttctgtttactcttacaaaaatcaaacttcttcctctccccttcctctctctgcctactctttcttattccttcttttaaatcaaagttttacagtattaaccttacaaagatttttgcccataagaaggttatatgttaaggcaaggaactgttttaattatatttactcttcattttgagtatatttctttttcatacctgacaaagacttttgaaatgactaaagaaaggcaaagcaatctgattctttataaaaaaatctttcatatgcaatcttttgtctgtagtattctcataatagcttagaaattttaaaagaaggttttagctggttttgttcttttcaaattggcagaatttgatttttttcctcttcacatttggattcactttaaaaatcaacaaacaagaaaataaaaacatattcaatttaaaaaatatgctctccattggtgccttggcatcatcaaccaatatcagcatcactctgaaaaccatttctattctgtttttaaaaaaaagagttttaaaatgcacacataaaatgcacttaaaattgatcctactgtattaaggagagagaaaatttaagggcaatggagagctttgctgtaaccaactcttcagtcaactataggatattgttaatactgccttcacctccacactgaagatataggtaccattttgactgtgcttttgaacaatatatagctaaagatttgaagtgagtaacttcaaagtcagtagttttcatgtatacgtcgcagaatcactgcatcttatgtatgactttaagttgtattaagctgataatttcaaaaagagagactttcaatgaaagaaaattcctgaaatttggtcattaaatggttcgagtacgtagaattacttacaatgtaatgccaaagaaaggtatattgtatttatccagaaagcacgagcataagaatgacctcagaaagttattataatttattacttcattaaagatacatttctagtccatctattatgtgctaggccttataatagacaacaaaaatgcaaagaacaacaaatgtgatctgaaaagtagtaaaggttagggaagatgggactagtaagagagaacagaagtaagaaaataaagtgattataattgtaactgccatgagctgagggcatatcatgcattgaggtaaggtcctaggtgcttaatatgaacaagccctgcaagacaggtatcataatctttgtctcacaggtggtgttgggaaaactggctagtcatatgcagaaaaatgaaactggaccccttccttacaccttatacaaaaattaattcaagatggattaaagacttaaatgtaagacctaaaaccataaaaaccctagaagaaaacctaggcaataccattcaggacacaggcatgggcaaagacttcatgactaaaacaccaaaggcaatggcaacaaaaacccaaaattgacaaatgggatctaattaaactaaagagctcctgcacagcaaaagaaactatcatcagagtaaacaggcaacctacaaaatgggagaaaatgtttgccatctatccatgtgacaaagggctaatatctagaatctacaaggaacttaaacaaatttacaagaataaaacaaataaccccatcaaaaagtgggcaaagatatgaacagacacgtctcaaaagaagataattatgcggccaaaaaacatatgaaaaaaacctcatcatcactggtcaatagagaaatgcaaatcaaaatcacaataagatactatctcacgccagttagaatggcaatcattaaaaagtcaggaaacaacagatgctggaaaggatggggagaaataggaatgcttttacactgtttgtgggaatgtaaatatagttcaatgattgtggaagatagtgtggtgattcctcaaggatctagaatcagaaataccatttgacccagcaatcccattactgggtatatacccaaaaaaattataaatcattctactataaagactcatgcacacatatgtttattgcagcactattcacaatgtcaaaaacttggaaccgacccaaatgcccatcaatgattgactggataaagaaaatgtagcacatatacacatggaatactatgcagccataaaaaaggatgacatcatgtcccttgcagggacatggatgaagctggaaaccatcattctcagcaaactaacacaggaacagaaaaccaaacaccacatgttctcactcatacatgggagctgaacaatgagaatacatgaacacagcgaggggaacattacacaccagggcctatctgggggtctacggctaggggagggatagcattaggacaaatacctaatgtagatgttgggttgatgggtgcagcaaaccaccatggcatgtgtatacctatgtaataaacctgtatattctgcacatgtaccccagaacttaaagtataacttaaaagtttttttaaaaaatatgtgataaaataaaaaaaagaattaaccacagtgccttgcctattcttctataacagtatctatttcactctattttattttgaagctatttatctccaagtttctttctagaatctaaacagttaacagcctgagggcattgaccttgactcttgtctaagttttacaaacaaacaaaccaaaaagcacactgcattgatatacttggccaagtaatgatgtccaaatgctacaatgtcacaaccagtgctcagtaactattagataaataagatagagtcattcactcaatcattcactcctgcatgtttcacttagtaatcttgtacgctcattgaataaattaaaagctgctttatgaaaatgttttctgttaatttgaataaaaacctttacacatcaactagatacaaaagagaaatctattgtttgacaatgatcgttactgaatcaaaaaacagtggggccatctgcagggtacagatcatgctagagtcagggaaaactggtgataaacttcagaaagccaagaaatataccagcttacaacttagcagcactgcctccacacagtcttcaggtatttattgactgtctcacactaatgcatgagtgcctgtggtaatggtaaaagtatataaatttacttgcccagagatactaattgttaaaacaaatacaacaatttaatggcaatgcaagagaagacagactaacatttacaaagctatttcttgtttaggcaagatagtagactctaaacatatattatctcatttaaattatcatttaaaaacccttagattgttagtatttacccattttaattaaaaacataactgagcgtataatttttttttttttttttttgagacggagtctcactccgtaacccagattgcagtgcagtggtgcgatcttggctcactgcaacctccgtctcccgggtttaagcgatccttctgccttagcctccaaagtagctgggactattaggcgtgtgccaccacgcccggttaatttttgtattgttagtagagttggggttttgccatgttggctaggctggtctcaaactcctgacttcaggtgatccacctcccttggcctcccaaagtgctgggattacaggcgtgagccaccacgcccagcctgtaaatcttgacaaaattcccagaggcaaaattattagaaggctgggagccaggattaaaaaacataaaatccttggcttttccatttatttcacattgcctcttcttagaatccacttctacaccaaagcagttaaaatcaatgtggatttgtattttaatagagggtttatggagtagtgggaaagatagcaaataataactatgtttattgaatactactgttcctaacattttgaacctatccaatcatttaatcctacaacaatcttttggaagtgagtgctattattattattgccactttgtaacagagaaactaagccaaaaagaagataaacatttgaaaagtcataaagctagttagccgctgtgcagctgaacttgacagcctatagcccacagagtttaaccatcatgctatattgcttcattaggttgaaaggttattaaatgaaatggcttaaacaaagttctaagcacatggcatggcacagagtaggtcttcattaaatgttagtttctgttttttctttaatctctaaaattctataataataatacctttattttcaaagtaattctgctttttaaagactttatgacatctgatttaaatttcacaaaaaaaggatggtgaatgtggaataaatcttcacaaaaatgacactgaagattatttaaaggcatagaatgttactcacaacacagatttaagagacaaaagtagaaacagtgttcacagtgttttaccaaaaacaaaaagggtatatatgcacaggaaaaaaaatgattagaaaggtatatccccaaagtttgaaaacaaattacttctagacgattgtggggattttaatcgtcctcttgtaatttatgctacgcacagaattctacaatgccttttgtatgctttctatactaagaaaaaataaaaaagaagagtagtactccttttttgagatcataatactgaggggggagaaaatcagtagaaatgtgtgagatttcaccctcagtgatagagctggaatagaattcgcactcttcatctctaacctactgtgttttatctgacccttattttctattcagtgcttaccataattgatgaattcaaaactaatctatgatgaaaacccctgaaagtgattagagagactgtgattgtaaatgtggtatcaatcactaacacaaaagtcccttataactcatcaggcttcttaagttgtttattcaaaccatttgtttctgagtccaaaccaataatatatgtgatagaccggattactttctctaattcttcactccctctctataatagaactttacatccataaactttaccatatgacttgaatgtaactctcagtagagtatgtgttaatgtgggagatgggatatatatctctgtctcttggctttgagcttggttaagtgacttgctttgactaatgaaatattagtaaacatgaaatgagcagagactttaggtattttctgcgggaacaaattctgtagttgtcaatagtttattctcctagattaaatgtttgataaacttttctaaaagaaggaatttttttttcagagagaaatatagctaacatggaatatcatgtccttttgtacttacctggagccaaagtaaactacttggaaaattaaggtaccttttgctggactattcctcatcctttagtttcttcagtccagactgggacattttggttaaaaaggagtaggcttgtgatgttaaggtgatcatcttggtcaccataccccagaaaaaatctttacatatccatgtcttagacactgaggtacagaaagagagttctgaactttccattccattgtcatttgtgttgtggagtcttattaatctgtctcatggaaggtgggaatcaggctatgaatggacaataattcatggggggcagtcaacagtagagaagaagttgctgcaaattgattaatacaaacaaaccaacctgagtacctggctcattttaggttccctccaaaggcttcagtacaggcagtaacttagaaggtaatctcagagggtaagataataataaggattgacaataataaggattggccaggatctctgagatttacacaaaatggctccagaggtagacattataaagaaatagaggctagaacatctctttttccagctctattcctcctttagttgagagtttccccagggcattaagccctgggggcttaatgtaagccccactctccccatcctagattttttgagatctcccagcattggaaaaggtcctggggcagaaggaaaagcatacttgaggtgggagtctgggttagcagagaacggcttcaggtgcagctgaagggaccatgacagcactgcctgacatctctgagggactatgacaggattctgacagccatatctgctacagaagcctgtaaagacttggggtggggggcagtggtgtataatatactgtgtagtctgatattgcatcctttaaagtatgatctggggaaggttaggctgcatcttctttattaaattatattccaaacaagttgtctcctctgactcctgcatgaagtcagactttgggacagtaaatcctacactgtccagctaagaaaaatgacatgttgttaataggcttaactgattctcttgctatgatggcaagatcagatttttagcagtgcttctgaaaatcctgacactcattcaccaattattttcttctaggagtctaatatgtattcatcttcccatatttcagggaagaaatagttgaacgactttagggagcttttcccaaaatgctgacgcatttttgcagcattttgccataatggggcctattgaaaatttttctgacattctgaattcatagcattaagatttgtggtgttgtttttgtatctggtttgtatttatttttgtttttattaaaatacaggagaaattgggacaggttaagagttgcacctaaatgtatgaagcttgaggtctttgaacataaatgagttagatatacagaaagttattaagacctttaagcattcgtaaacatttcatcattgctgacaatatctatttactttaggtaaccctgcctgagcagctcctgcattgctacaaggatgaaggtggggttatttaaaaatttaccaagctgtgaaagagttttctggagaaaactggtttggggactcagagcataaggataaacaatggatacttttatggttacaggagaggagttgataaacccctcattcctctaatgtaatgtataaaagaaaatattgtattcctggtcctcacaaatggggaggtggtagggtaggtaggttatatgaacacacatgtcttccctttgacaatgagtgggcaggcctttaaaaaaaagtctgaaaaaataaagagccctggggaccatttaggctctatcagtgagttctatcctgagatatcaaatccagttgcacagaatctaaatgtcaatatttacaaagctctttccatcttatatcccgcttcctttttcttttatgctctttctaccccttttccttcctccctattcccttgatcccctacatcattctgttttcccatttgctctcatttcctaacaacccccatccccattagtcagtccaaaatctgttcatcccgctataggcttcagtgatggaaaagaaagggccccaaacaaagccaccatccaagacaaggagctccagagggtggtgaattggtgattgaggtaaagcctggggactgagaatgttcaccgctctggaggttcttagcccgaaaagtgattaggcatcagcaggcttgatagctgtatcaagcctcatgatttcaaagctttcatgagctgacaaggacttgctaatttcaaactttctaaccaattacaatcacaaagaactcaggacaacaatcagtgagcaaaatgaaactgctggagtgaagcagccctcggcaggtttcactcttgtagctctgctacgcaatgtgcagctgggactctgcttcaataagtaaataaaaatacattataaaatacaaacatacacaatggatcccacttgctgtcttgttcccagtaaaggggtatgtaggaacgctgtcttgcattcattcagtccattaatttctgatggtgttaattaaaaacttttgatgctggtttgaatggaaaatacctcaaacagtgtttcctttattgaaacaccaagttccaagtcttggattattaggttaagctctgtcagtagtgagaccaacataaatgcttttcataccgtatgctttgacaaaagagaatagtaataataataaataaataaatgaaaaggaagaagaaataaagtgtttagactgaaaactcctttacttcaccaacctgtttttttaaggactaaactaaaaatccaggtccctgaatgtagaacatataattttaaaaaaatcttttttcaaatctttatagaacattcaaatcacccaatgttccaggacctgaattttttatattttaaaatgaagaaagctgcttaaaataagtgaatcagctgctaagtgatttctctctgtcttttcctctactctctctttaaaaagactggaaaatgcttaaaatggtatatgcaattgatatgtgcagcttaaggagcttaatataattactgaggactcagactttctatttaaaaataagatagggtagggtaacagaaactctgagtggtgagtattcatcccttgtgatggtgaggtgtgggaaatgtttccaaatgtttaatccactgagcaaggtaaagagtgcgaagcagttattcacagaatttggtgtccttctgaaaacctagggaagcctaggaaatccagagaacaactgaggaggatagtatgagagatgctgtgcaggaaacaagcaaataaaatatccatttcttcaatccaatgcttttgtgaagtattaagccaaccaccaaaacattctgattgatttttaagactcttctctaattttattttttaattactcttccctttgtgtattggggtctgaagccttgggcacccattctgagaggtcttgtaaatgtgtctcacatatgcccgtttctcttttgttttctaatatacctttctctatcatttttcatttcccaacctgtttattcacactgtctgcaatgtcatctgaatcctcgaaaaaccacaagactttctctttattccccctgaaggccttcatcactcttgttcttgttttgatctacatatctctaacgagaatgaagttctccataaaggctaagcagtttggcagaacttccttccttccctccctaaccgcaggctgtattgacctcaccctcttggatcagtttgctaaaatggcctccaaactttatgtgatatgatagtgaaccttcaacaacaacaacagcaataacaacaacaacaacaagagcaacaggataacttcagtgtaaggcatgtgagaaaaatacgcagagtaatagaactaaaactccatgagggaaatgggcctgagcaaaccacagcatgggtctttttgttaacaaaatgtatgatttttccccagagtacattgatagaggacatagcctacaaaggaccagtaaatgtaaattaactaacagatatgtagcaaatgaatgcatttaaagatgatttccagctgaaatgtttttttttttttttttctggagaccaagtttttgttaaacttaatccttactctctttcctttccagcagcagaaacatctggtcggttttagattccccttggatttccaacttcaaagggaattataaagaataacaaattcatgtaccggcactaaaaaaaaattagagcagcaggagagaatggtaaaattgtccttatttgactgctagtgacaggcgccacaggcagaactatgagaaaagacaaaggcaagatcaccagttgacaaccagagttcctgcaagagactgaatctttggctacatgcaaatatgcacagggcccttaacaatccatagggagatttacttgcttaaggaaaataaataggtaaataaataaaaggagttgaaaggtaaaaaaaaaaaaaaaaagaaagaaagaaatgagttcatgtttgcctgtcacatagtttgttgaaataataacaaataaaccaataaatgtttattgaaagaatgacctggaaataattttaaagatccacttaaccccttgggttttatttgatttaaagaaaattgtgagagttctgattctacaaagggctggataagtcatccaagaaataatacaggctcttaagagtccactaaacttggatctccaaagttcttaaaagtagtttctgtttctcctttggctccagatccttattatcaaaagatgtgacgagaaatcaaagtcttcttagtggccgggcgcggtgtctcacatctgtaatcccagtactttgggaggccaaggcaggtggatcacttgaggccaggagtttgagacaagcctggacaacatggtgaaaccctgtctctactaaaaatacaaaaattagctgggtatgatggcgcgcatctgtaatcccagctacttgggaggctaaggcacaagaatcacttgaaccggggggacggaggttgcagtgagccaagattgcaccactgcaatccagcctgggtgacaaaatgagactccatctcaaaacaacaacaaaacaacaacaacaaaaaaccaaactaactgttcagtacatgctcagtacttgggtgatgggatcatacataccccaaacctcagcatcacacaatatacccaggtaacaagcctgcacatgtatcctctgaatctaaaataaaagttgaaaaaaaaaaaaaagaaatttgtaactgtgtcaagttgtgtttgacaccactttatagaaatggatttattcttctcctctatcattttcttagcaaaactgaaacacacttctagagtgcaggtcttgatataatcagacatgagaaaatgagaacagttagagaaaatacaattttgccattgtaattacctcttacaaacagcctttcctctttcctgttttatgtgcaatgtgtacagcaacaacaataaaaataaacaaagacatgattaaccgatcaatttgtttctccaaagagagaaatagttaagggctaaagtgcctttcaataattaattataagagtctttaaacttagtattgagaggttacagatttccataccacaaatacattaggttgattcacagagtggccatcaaatacccagaaagcaaattacttttgaccgaaatgtatacatcaacagtacggttaggaatgttttcatagaggaggacagaacatacataaccagttctctatggagcctagcatagtgtcccatggaccaatccacataagataagaccatctacagagcatattcttcatatcacagactctaggtaagaagaaagtattctctaggtaagaggagaaaaataagtgaagatttctttcgttaacacttccaccatgaaaggaatgagctgactacagaaccattttcttgaatatttttgtcttgagtggggtttttatccttccttcaccactctaggtagagcagaatcaccaaagttctctcattacggtaatgtcataaatcccatcctatagcagttgtgcatgatcctgtgttatgcatccaataaagtttattcagaaaatatgtcagcttcattaaacagggatctgatgatctgaacaaaccacttatcttgcttttgtgacatgtattggtatccttaggtctaaaatgaaaatcttggttggtgggggtatctgccaaggattccctgcctcatgtaagcagaatcatctaaccacaattctgagcttaactgggggaaaggaggtggaaggtgtatcgtactagttcgttctaagaaatgtcttatagcttgaggatacgtgaggtcacaaatgtaacaacaactgaactagcaccaagagccaaagaggccaagcataaggaaacctgaagcaagagaaaaaggtgtacgcgtacatacaccaagaagcaaatgctatcattaataataattattgttattacagctattagaatgatgaggcattgatggttcacttgggtgaaatatataatacataagctagaaagaactgtgggtaaacttatggatctttttaaaaggcagtttatattctaggtttatgtgatatgagacacataatttaacaccacatataagaacaggatgctgaaaaaagtgaagaagacttgcagctttaaaatagtataatggctagttcctactggtcttttcttgtgacacctgccttagtcaagccatccgatatagttctaaccttttctgatattttaatgatgatgacaggcccagagtaaaggagacaaaataatcagaagattcagaggggaaaaagaaatggaaagaaaaaaaaagagtttgtattgtttataccatctaatctgacaaattttatatatgctctctgtttgctcaggatagtttattgctaatgttatgactttctcttttttttccatgtgctttgctctaccagttttggctgaaaatattttgtatatgtccatactgtaaaccctcatatttttctagagatttagtgtggtggggaaacttttttttcttccccaagggttaggcacatcaatattctagctactcacttttgaggccaatggaaaatgtgctcctaagattaaatagacctgagtaacacataaattcagtttatactgatgcagtatgttgcatagttacatcctgaatttctgatgcgtgtaatacacctgttggacaacacatcactactgaatagtcactgacctacaattcaaagacagtgagacagcacaagactacagatacaggttctctacagacagcctgatttgtacagagcattcctcatctgtggaactctgtgtgtaaaggatctaggctagccatgggaagctggctcatagagggttctaaatatttttagaataaactagagcaataatacaagcacagagagcaccctttgttatacaatgcataatttctttccccccaaacatgttgtttaaaaatgattcagatttttattatataattcccccttttacatatttctaaatgcctcacatacccatcacatgttttccatgtctgccaataatcttaattaaaaattataaacttttaaagccagtgttacatttgatttaagtagatttgccatatttatctggtattggttggctgtagccagactggagttctaagtaataaggggactatgctttcctttcacctcaggtaagaaattgtattcaacacatgcttaaacccaataataagtataattaatgctgtatagatctggcaggcaaattagcatcctaaatttgagtcaagtaaaaaaagtaccaaaagaaaatagttcccccaagaaacctagccaaatctgtgaaatatttctctaggcaaccaaattgccctgtggcttacagatgtgtctaagaatattaggcaactcactgatgagattttacaatcaactgttacatgttagaaaatatgatgtcaggatactatgaagaaaaatactactatatacaataataagaactatttatctgaatagtttttaacattaacgtgtaaaaaatatcctgatggatctgaaataatgatgtactaaatactacaatgtctggggtttgcttcaacataacatggtgatatagtgagaaaataacaggccatcagttagtcattgtgcaagctggtgatgagtacatgggagttcattatagtaatttgtttatattcatgaatttaagattttttatcataaaaaatttaaaaacatatactgatttgaacttttattcatttattatttgttgactgattcatttactgtttatgcaaggtattattgagatataaataataataataatgctcttattgggcatttaggttaaatgagctattcctcttcaggaatattatatatttattttaaatgtttataaggtctatgtaattacatatttcttaggttaaattttgaaagcaggacacaaaattatatagaaagtatgataacatcatgttttaaaaatatatcctcggggaaaatgagagtaaggaaatatatcaaatggttattaatgattggatttaaattatagaaataattactttaatttttcttcattttactcctatgtgtttttctaaattatttttaatgagcatgtatcattttaaaatgaaaataaatatttcttcattactggaaaagatatgttctccttccccaaggagcttttcatttactgaaacagagaaactgcaaacacacagcattgcccagatagtttaaatctccatacctagaagggaaatacacccacaggaaaagaaacgtcaatacagattttatctgatcatagaaacataaagagctttctctgtgttggacagcaatagggaagaaactggcttgtttgcaagccagcaaaagcgtgaaattcagtcctttttgtgatgagatcattttgtgataaatgcaaaaggagtgacaaattaaagtcaccaaataagcctttcccttgagctcctgaggcttactaatacgagtttcttttggggtagcatagcaagtaaagcgtgggagtggggagggaggcggagctacaatcccgaaggctcctggccttcactggtgagatggatatgctcagagagacagagatagatgtgcaacagaatcagaaacaacaacacagtgacaactatggattatgcacaatggatatggaaagtctctgttagaaaactatctttattaccccaagagattatttccctcagtttatgcacgttcatataaagcgaagtcaagagtgtaacttttaaaggtttggatgaatatgatgttcatgactaaacaggcctagatggagccaggcagaacacagttagatgccagggaagtcacccttttcctcctcctccctctccagtacagttgccagtgcatttcaatgcaggtcagcctctagcaaagtcagctgtttcaagctctgattggataatactttatctatacacccccagtcttgacctgcactcttctcccagtcatggaaatatcaagaattctagaaggccacaataccaatctttttgaaactttacaaactttacaaattttcactacaagacacctagaaaaatcttcaagcctatgcttacctgtagccctggtcttggtcctcttacttaactggtaaaagaggatagccttatttatgtctttgaagggtattttccttttttgcttgttggtaagtacaagagcaaccatgtctaattttaagattgatccaaatgaagcaaatgcatttcaaatttacagaataccatagaatactaatgggtagttcaaagtatcactaaatgtgtttggagggttttgagttttttcaaaacatacaatgttccacacaggaaacatcagtgccaacttcaccctatcactctttctgtccactcaggagtctcctttggaaatatatctctctggagggtcttccaaacaaatcctttgaatacttccatcttgtttagcagagtattctaaaatatttgtcaaaatctgtgataataggttctggagatcatgtttcttattcttctaaatgctggtatttcaaatgaacaaataggatattaaagatctgtcctttaccaatgtcaaaatatgttctgtcaaaatttagtattgctaaagtttagacccaaagactcaccacagcctttggatctcatattttctgaggttcatggaaagatatttgacttctttgcacctcaatattttggactgccatttagagataatgagagttacttaccagacagcaatgtcatgaggaatatcctgttagtaatgatgaaacattctgaaataaaaagagtacaggtaagtgctaggtatttattttaataaatgtatgataacatggtaatcatagaaaataacccatttattcctcactttgggatactgactaagtggtagtatataaaaagtaaaggatgtttccctttgggaatggaaatagaattgtgcactaagaaagtatcttttgtaactgcctgcatgtttaactttaaggtctctaaccagttgcaaccagttatgaatgacttgctgcccatttctgcaattcactgtaacttgtgttgagaaggttatgttttatggttaattatccatggtctgtttaaaaaaataaatcaaaccactgtaaaccactaggatttgcagctccatttgagctttactgtagttttgatcaaacattttgtacataaaaacaagctggtttctctttgtttttagttgtttgttatttgtgttataaatattgtggcaatggtgggagaataagctatggattatttaccctcggtttcatgagttgtgagttattggccttatcctcctttataagtataaataaatgtataatattatattccaagtcttgtaagacaaatggaacgagtgaactgaaaccttttagacccaaaatcttttatgcgaagtcatagaacaacaaaacaaaacccaaattaacatttaaaaagcttctactgtggagcaacaaagtctttaaatattatataatctgcatttaaaaaactgctcatctaacaggcagcagtctatcattctacaagcttttcaatgcctttaacattcagaagctacaggtggttttcccaaagatcactcagcacccccaatatcactaccacaatgaaagccttgaaaatggccagcatgattactttaagccaaaatggatttagaaaaatcaggaattcgtgtagctaaaagtaatgaaacactgtataaaagaagaaccctatagaattttttttatagttaccatcctaggacttatataaacaaaagaagtccaaaaacaattgtccagagaaaatgagaaaagccaagattcaaaggaccctgtggcagagtgcatgaggagcatactcgatagctagaatcataagtatctaacacatttgcatatgaaacttaatgaggatcaccaaagtagcttgccaaaaattatgtttgttaaatcagccaacagtctatgtagcacagacccctaaaaagaacctctaggaaagatgtaaaattgtcttctgaaatttgcttcttttataaaggcagaaaggataaaaaggcctttctcataaaatgaagtgattggtccactactacagtctgaagagttctgtatcagatttcttcttaccctttattacttgtatggcttactgcttacctgcatcagcagtctgcagggttggccatagcaggtcccttacgagttcactgaaacacggaaaatatttatgatggtactattatgtgccagacacaactggatggattctgcttgaaaaggtaagtcagtaactgaggttcttgttgccacattaaaagaaaaaatctatccctactgccaacagcaataagaagagaagctagggtgaaagagttgtcaaagacttatgaaaaattcgaaactgtttaaaattctccctagcttcttttcttgcatgtccaagtaacagaaagcttaggcctgccacctgtcttaagcctggatcccatattaaaaaaataaaaaaaaacagaaaaatgagaaacagctaatgtgttcccaaggccttggttacaacagaaaatgagagccgagaagtctacattggcacacatcgagatttgaaaggtcagtcctgccctagtatggttcagagaccgtgaaaacccaccaagatgaaaatggaagctattctgacaacaagaggcagggaaaaagttcaaagacttttcctctgcttcttttataacgagatactttcaactatttttgacaatcaataaaatgcaaatctccctcacttttgtgttctaagttttttttttttaaatttaaacaacccatttgaaaattagggtactcagaataacttcttgtatacagaactacacatttaaaaagctttgtgcagattgttaatcatattaaaattacatcataaacaatgcactttacatggtgcaaatgttttatgtttttttcttttgacaatcaggcacctacatgcaaaactgcatattggaatccaaactcaactataatacatgtagaggaacccttagaaaaatgcatgtgggaatatgatatcccagttagagactagaatattctgaccaattttcattatttctctgtaataaatttatctgagctatagatcctgttaagaaaataaagctaaatggaaaagtattgataaaatacattaaatatatatatactagcttagtcattattcatattaagatcagaaaagatttccgcaagtcatcacaaatacagagatgggataataccaataatctcgatcacccagttgttaaaacagagaacctcacatttgggcaataatagttttgatttttatcttgtgcaccagatttttccatacaaaggaattctaaattgcaatagttaacacataagacagtgttaaacaaattcataactttagtaaaattaaatgaaccaatttcttatggctttaatatccagaagtaaagtatgatcttaaagaatgatgctgatctgagatacaaggagatcaagcgcttcaatagttcctcctcacacactaatgatcgcatccatcctctcttccacccacctcccaccttttctggttgtattaaaaacaatcaaaactaccaccactgctgctacccttcacacacctgaacttaatttcttctaagagatgcctaacagtgcctagggctgtgctatcactttatatccattttatgaccgcttgagaggcagaaactaaaaaggaagaccaaaacaaaacaaaaaatccctccaacctcccttatcagacaaatgcctggttcccagaggacaccagtcagttaagcaaaaccaaatattacaacagggatgaaggacttataaattgcatacaaatctcactgtgctcccacttaaggtggaaagggagttactccaatgaaagaaaagggggagggggttgtgggaaggagcgaagggctacagaaagagcgagagaaaaagagagagagaaagagagagatttattgtacatttgagacattaagaaggcagtacagtgaaaccaaaggtgttccagggagaaatgtgacagaaagctctaaatgagaattacagaaactattccttcttaaataaaactgttgtttagatgatgaattctataggaagtctgaattaactgtctctgttgtagcatctagatgttttctctttcattaagactttggagtttgaatgtactttgttaaaaaaaaaaaaaaagaagaagaaagagaaaaaaagaaaaaaaaaaaagcattagagctttatatagctcccaaagtaaaaagcaagagaaagatgggtttatataactggcttttttacataaatattacatcaggatacatttcaagtgaaaacacacaaacacacacacacccgtcttccttatactctttctattttaaaattcatttcatactttaaatgttgttggtttttcacaaaataagtaaaaacgaagtcaaaacatctcaaaataagttgccttatattacctggaaaattaacccatcatacaggtcacgatgtctcatttaaagccagttaaggtgctgacaattatgggacattttgctgcagcctagggcaactagaaagggccatggatgttaactaactcccttttaaacagtctgagaaaagggaaaaaaaactgtaagtttccccatctgttatttccttttttttttctttttggctgtggaaaagtaaaattatgcaagagcttttgaatgtaaaggctgtgtgtgctttttccctttttgtctctgtgtaccggttaagtgatgttgcgtaactgagtacagagtaggcggttagcgtttactattgatttacactatgccatctaatgaattcagaacactaaaaagaaaggagcaggagagggagggaggaaaaagagaaagggagaaatagggagaggaaaaaataggaatgaaggagaggaagaaagagcttattcagagaaacagttctaatgactggaataggttcatttttattcctatagctctgacttttggttattgttcagctctcacaaaaaaatggtcttgagctggtgaccccaatattccaatcctatttctaataaggattactggcaggtgaatgcctgaaagttctaatgtgtcaaattacttgaaaccaatttcactatactgtcagactcctccatatgcatctatttatgattctctctatgcatttgtgaatctgtatctgtgatcaccatggatttggtcctactggcttacccaatcaaaaatattatttgaaatatatcacgggaatgtcatcagggtaaagagaaatacattctattttacccatctcctttaaaaatacataaagaacacatttagaactttaaatatatcactattttactttgaaaacagacatgctacaaattgtttggctgaacaaaacagcccaatataggataataaaagagaaataggcaaaatgaggaagaacgctaaattgaggaacaatattcataaagaaatttaaataatttcttatgtctatggagagccttttacttttgtttgggtggaatgcctgtagcattctcagtctttgaatgctgctcagtgcttcccatgccatataatgaattcccaaagcgtggaccagaaagaaagggtgaagttgtttctgctgctaggtacaggtccttcctgtacctgagtgccctcctatggctgagaacaaccactaaggtgagaaagagaaagagaagttctctttagtaatcagctgaaaagctgggcagggaacttgatttctccctcaatgtgtgtttgcaaatgatgactgggaaaaatcacaggaggttatccaaaggaaagaacaagagttggggtttctagtcatccagttgtcttctcttttcagccatctgagcttagaaaatattaaacagatgcgtactctgtccacttgtcaaagatgctttaatgacccatggtggtatgcacacagttgtatacctagcacttgccatggtgcttggcacattttctatactcagcaaatatttattgaaactgaaaaatgatgatgggagaaatatctctgtagaaagaatgcactagaaaggcctgaaaaaatatattccgatgttttacaagaaatcttaggctatattgctctatcattaatctgcacacaaaataatactgtaagagaaatatcaggcagttatttaggggtcagttgacttcagttccattttattaggaaaaagcttaacaaaaattataatactgataacatcagcaaagttttgtgttcatttccaccagcccttttgggctgtctttcatttcagtcttgggcacagaaaagtctattttaatttccatggacacattctaaagaaaaagtcatgggatatcaacgtaattcatcttttaaaaaatactgagacaaatgtagccatttagtaatggaagagaatatggctttttgttgaagggcaaggcaggtggagttttgattaggttacacaaatttaaattactagaaggacaccaagaatgtactgatttccattttcttggttaaacagtttttttttggaaaaaaaaaattctggtttagaaagtcagaaatgccatctttcagttaattggagaataagacctttagaaaaagaattgcaactacaatttctcaaaaattccagcgaagattcaacttaaagcatgtttagcaatagtagccatattcttttaaaaaatggggctaccatcttgttaattctgtaggactgagcatgtagatattagtcaaaaccttcaaaaagttttttatttctctctcttggtcatctatttaatgtaatcggattcagcaacttccttcaataagcattctggcaatatgtcaacaagatcattcatttcatgattcttaaaagtggatgagaacttacctgttcttcttcattttatatatgaagattctgagactcagaattaattttctcaaaagcatatattttgaggcagagctgggactagtatctaaagctcacagttcatttttttcacagcacagactaaatcaaagttgtataaattcaatcttattttaaatgccataggggaagatttcaaaggattcttttataagacaaggaattcttacattatgtaaaatgttcacctcaaagctatcttatacttttttttatcttaaatgtgagcctactgttcaaattgttgcttctccttttccttgtcttaatttttgactctttagagtctttgcctcctgtcctctcacttgtactctgtgtctagttcatatatggcccttcctgacttcatattcttccttctctctctcttttcatctttttatcaaacttttatttattcttgttcctcacagaaataatttccttgttaatgtgatatcctcagaaactacaaaggaagaaaaagtgtaaatttagtattattataataaataggcctttggtttatatttaaaacaaaactgcaataagatattgacaaacagagtaaactacagctataggcttccctatagaaagttacagctgtctagacctccatattatcaatatgaaaacttgggggctagcatttcaaagtatctcatcaaagacagagagcaaaggctcatgatctccagaccactcattttccactacatcaggacacctttcgtttcccttttctttctttccattctacattattgatatttgagactgattacggcacagcaggaggagattcagagaaatctccttggcttaatgtggtcaaactctctcaattccaaaaaaagtcagaaagacctgcacactaaaattgtagttacacagaaaaagaactctgaggaggttaaaagagtcctctgacatgagaaagtagtctctggatagcagggacattgctgccaaaatcattgtaattaagattgggtcattgtttccattataaaccttatgcttatggggtttgtaattcagttaaaatgatcagctgtaggctgaaatgcagccccaagtatcttagagtgggaggtgtttctcccctcctatttcttaaaaaagaaaacacatagcaactatttaataatttcaatgagagttgtattctgacccttcccctacaaagggtagttaatcaatgagcttaatctagagtgagccaaggtgagcaacatccactgtggaatgaagcacattaacctggcatatgaatgggcaataaaaggatttcctattatttcataaggtttaatgtacatcactccattccactgtattgatgtgaataggctttcagcaacaccgtgttgaaaaatctcccacttctgtttgttaactcattattgtaggaaacattacaattataggagacaggaatttctgatggtttccttagatttctttcctcataagctcattcccagggtcagtattagataatcaataatttctaaaatttcttgctcctatttctttagcattgtctacaatatctgatacctatagtgtaatgctatgtgccaccatgatgtagagggattggggaggaaatcatagctatatattaaaattaacaggccagaggaaactggtatttactgagtacatactacatgacatatattccattaatattatttcatttaatacaaacctgcagtgaagtagctgtggcccatgttttatagattagcaacatagttaaagagctgttagctaacctgcgtaaggaaacagagctaatttaaaaagttgcgaagtgaggtttgaatcaagatctgtttgactcccaggcccatatgtactgcaatgcaatgcaacaccaggaacagaatatgaaaccatctaactgaaaaaaaaaagtctccatgccaatgatgagagctacctcatgctccaagtaggaggtagaaagggtaaatgactcctaaaaagagattcttgctttgctcttggctctgataaatccctgtttattcatatgcaaatatccaaatgcatatttggaaaatgttttgtcttagataagaaaatgcacaatctcctagaaacctttaaatgagaccagacatttgaatgtttacaaaaattcctttgaagatttatattaggagaaagttttaaaacataatgcataaaaaaaaatcagatgattggctaggcatggtgactatcgtcaccatgggagtcgctttgggaggctgaggtgggtgcatggcttgagcccaggagtttgagaccagcctagacaacatggtggaaccccatctctacaaaacacagtgaaaaaaaaattagcaggcatggtggcacgtgcctatagtcccagctactctggaggctgaggctgaggctgaggattgattgagcccaggagaccgaggctgcagtgagccatgatcgtgctactgcactccagtctgagcgagagaacgagaccctgtctcaaaccctccacccccaaaaatcagatgattaatacaacattaacatttcaatctggatgtgtgtgtttgtgtgtgtgtgtctatgtgcatataaacctataaatatacacatacacagatgaatttttttgtctttgtcaaaatttctggtaattattataaagtatttgacaaaagctaaacagtaaatatgttacaccaggagaaaaggaaacaaagaacaagaaaagaggagtatgtgtatgtacatacttccctcagaaatctaatcctaaaacattttttaagctaaatgggacatagtgctttagtctaaattgtgtgtgtgtgtgtgtgtgtgtgtatgtaaagataaaggacttttactatgttattttggcaagtgattatttttctaaaatctttgctgaatcgttttatgtagatatactataatactcttgaataaataaatacttgttcaagttaaccttagagctcatcaggtaaataacagaatttaaaaaagaatctgtagtctgaaacactgtagagtatgccaactttacacattacattaagtattcgttcaaaataatttataaattgaaaagtatactccattttattcaaacaatgcaattttttaaatgaatcttacacaaatttgtgtgtgtgtgtgtgtgttagagagagtgtgtgtgtgatcctcaagaccactgagtcattctttaaaaatattttaaaatcataatttggtgaagaacttaacaacaaagtaactgaagccagatttgagagaagaagaatgaacagttcttcaggaagcaccaattcattccttaacattcaataagtctttattgcttcgcccttccctcctttttttcctctagtctaaactctgatttggagcagaagttaggaggaacacgtattctggtccctcttctctcatccctgtaaggaaaagcaatggtagactaatgacagaaaaagcaattgcaacaactttggcagttttgtggtactgggaaaaagcaggctttgtatttgtacatttcaaggaatttcttcaaattttagcttctttgaatgttcctacaacaagctgaaggggagataagatctgctagggaaatagatgaggtttagagagggaaaatggagggactactttttttttattcaaatagcattcaaacacatgagcaagatataacttgcaacattaaaaagtaaattagctagctaaaaataactcacaatacccttctcactaaaacaaaataaaataaagcaaaaactcacaaccaattattttgactggtaaaaacagacagtgatatgaaagtaacagatggaagcccagttttactcacacaacacactcactaaagacaattgcaagtgtccccatgacaataacttaacaatggtcactttagcctgagatatctcctttaggtgagtttccttaaagacttcagaggggcttgtagaaaatactgtagaacgaaaccaactcatttgtctatatgtagaaataggcaagagttgcaaatcacagcctgtggacgaaagggatccaggtgtcacatttgccaaatctttttgcaagactggaatagatattcttttcttatttattttttgttgtatggcagtatttttaggagtggtgacatttctgtacttttaaaaacacaacactacacagcacctaaaaactttcctaaatcaaataattaacagtaataaatcttcctgctaatttctcctcaaagttgaaagaaaggttattttcttacctcacactgagccttctgatatgacagtgtcattcagtcaataatttcaatgtcagttactgatttctaactcttttattacaaagacttcaagcaataatgaaatggtgctgatctgcttgctttcactctatataacgtctatatttatatgcttatgcttctatttggatctatatttatctgctttatctgcctacagtgcatctgtttctcatacacacagacatatatttatatatatacacacatactgtatatatatatataggttatatataaacacacatacccacaaaaatgtatgaatgtatgctagtgagcttacttcaacaaccatgcaggtgcataaatattcaggcacatgacaaatatacaaagaacataaatgaacatgtaaacatagttacacaggaaaaagaatatcttaacaacagccctgtctgccatacttggctgttggcctttgagacttatacactgttgaatgatatgtcatagactactctgagaagcagaaaaatcttctgaaggcaaaagtatatgactaaatcaagataatgaattctaactctctcattttcgcaatgaggagtctgagatactaaggtgaacagcaaagattttacagctttctggaggcagagctggaagttttacccaagtctctgcctgctagacaaatgctctttctactactatgctgaattgaaaggatgaaaacaattttttcaaacccaatatcattattttctaattgccactctttcccatttttcccttttcttgctgtgtgaaatgtaaacaaacaacattcactcagggtcaggcactgttctaaatattctatatgtactataccatttaatctgtaaaatatctctatatagtaggtattattattcaaaatcttagtttagtgaattaaataactcactcaaagctacacagctagtaaggaaaagggctgagctcccataatactcaagacccatgtttttctcacttaactatgatgccttccctaatacatatttgtatataatactaacccttccctcaccaccacagcctgatagtcttagaaatctaatatttgatctgtttcagaacacataacaagtttaaaggttctctcagcctgaggaaaaaaaataaagggaagtagagcaggtataagttacatccctagtatgcagcacatgccctatactagagaactgaaatatgcaaaattcccccccaaaattactccaatgatagtgtgatgtgatttaaagccttaataacttccagtctatgaacattttatgtcttttgcaaaggattatggcaaactgataatatagaatcagattggaaataagaccacaagaaggcaaagggaaaatagcaaaaggaagaaagacccacacccacttcttcttcctctcttggcacaacacttccaaaaacaaacacccattaaaaacaacaaacccagtatcaaaatttggtatttttttccccactcaagtgttagagacaaattcagaaaagaaactaagtctacgtatggtaggtagttttatacaaatctcttcagatagtaaccagttgtgagccatccgaacacggaggaattttacactttggccagctaacccagaacccagcactgggagatgtcatgtggatttgtgaaactccctggggcatactgcatccataagccaaagaacagaaattatactgatccatacatgcagctcttcatctgtgccatattgataattactcttcatttgtgaattaaatcctagttataaaaacaactttcagacatttgtcacaaatggcacattttacttaactctttcataacaccatctagccacggtctataggaaatgggagctaccatactcccatataggtcatgatattataggaagaatatgatgtagagaaagagagagagagagagagacagacttgagtttgaatcccaggttttccatttattaacaataaagctgtaggcacatcacttaaatgattctgaaacctcattttcatcacctgtggaataaagaataaaaccacctattttgcaggaacgttgtgaagattagagacatcccagcacaaagaccccctcataaaagggggcattaaatattaattattgtatatttaagaagtctatttgtgtgtgactttctcttgtattaatgatacataaatctgctgggagtaacagaagatgtgaggtactttttatgcttttttaatcaaagacaaactttttggtgatcacatgtgttccatgtaaaagtggaaataaaagcatatcacagtgtaacattttcagtggacgattttaaagcacttaataacccttgactttttgtgattgctggcactctcatttaacagttgggcaaaatggggttcagagatacatcctccaaatcagtaataataataaagaaatcaccagcaggggttagtagaaagtctgtttttaacatctaaatcccacagtgtccagctaaggaataactgctgcaaggtcacagatacaaaaggccacactttccccaaagctctttgagattattcactgaggccaaaacattaggtaatgctgtgtacatctgctgagataacaagggtgagtcagggttaggtcacggtttcaggttagaggggtggggtgaagagtggctttcagatcaaatgacgagagtagtttaatttaagcaaagaacaaaccatacagtattttaagtaagaggggaaaaaaagggggtgcaactacagccaagagaaggtgggtgggaatatagaccctgtgggggtcaaatgggtaactgtggctcaaagaggaaacccacccacattcacacacactgaaaagcgaacaaaaagcccagggtgcagcataaatcctgctatcccaataacacacacagatgttccaccattgttttcttttatgcacattttaattaagagatcagaatcaagcattaaaatgttattaaatggcttgtttacatttttgctatatgtcatttataatgcattttctaaatgtgtgtatatctattcggaaggactatttggaatttttacatcagtgctacaattgtcccactaactcacagtcatttttgctaaccaaatatgtgtcagaaatccttttcagtttaagcaactggacaggagctctcactctttaattctcagtcaagcaattccctacccccaatcacacctcctttaagcatgacaaagtccaccacagtacttcaagacaataggaaggcccaggtacactggcaacctttctgatttttcacaagagtcccagtttcaaatattctcccattgtgctcacaagaaaatagtcttcatatacatgcccgaccctttccctagaacagttttgaaaatgtcgggaactcaaagctaccacatgaaggaccctgacctatgagtgtcccctggaggggacacagtggaagaagcgggaactagtagatttttttttcctccccacaatccatcttctatttgcagtctacaacttatccctatttgcctgggcaggaatttgagttctctatattattctggagttaaaacaggtatgcctttcccgtctctcagattccacagatatcatgactgatgcacacaatccacctgcatatgtggatcacaagtatcctgtagtctgctggcaccatataacttaattacttttaaccacagggcattgtcctagaagcccactatttatattgtaccttatcaatcatggtacttggaattgcaaagtctcagaaagcaggaatcatatctcctccacgttcagttcaatgcctaatgcattgtgagtgttcagttaggacaagcaagagaggtaaggttttttctttctttttgttatttgtttgttatccaggataagcagaatgcttgtacagaacatgcataagaaagaaacgcaatctaatctcactgtcaatttatattctgtaaactgtctcatttgcagcataaatgactacaaaaatgttttggttactctaagtgttaaccttaaggtaagagttaaattaagtctgctataactggtggaccagaaaggactcagagaaaagcaacagcatggctttgaatcaaatcacttttggaagaaaactttaagatgttaccaccgaaaaaataaaactggcaaaatgctctggagggcatcttagcaatatgcatcaaaaatttaaaaaatatatgaagactgttgacccagaaatctcacctctaggaatgtatctaaaggaattactcaaagatctacacaaagatttagaagcaagaatgtttaccatggcattatttataattgtgaaagactggtaaccttgtctgacaatagagagttgattaaataaatgacagtacattcctagacttaaatactatgcagtttaagaaatcatattttagataccacttaattacatgaagaaatgtttttggaatactgttaagtgaaaaggcatataaccaacaatatatgtacaggaaaatatattgtttaagtaaatattgctaagttaaatattgttaacttaaatattgtttaagaagtgatagttgtgtacacacaaagtgcaaaaagaccagaaaacactagaagtgcttgtttctgggtagagaaattataaataatttttgtttatttgaacttttccataataaaagcacatttatttcatagtaaaatattacttaaaatattcatctataccaaccttccttctctaaaggcctaaaagtgaccctctgtaggcactcttttgtctctagaagtcttccttctcctgtttttatagatgtatgtgttgcattctaaaatcttaagtatttgggactatgtagttataaaagataccctaccaattaaacaaataaaaaatcttattaaatctgtggttttaatcttaggttcctgcttagaaaaaataccaatttctctttaagtcctatattttgctttcaattcagcctccatagtattaattagttatattatttaggcctgcagcagaacagtttcatagttcttctcattctcacagttctttgtaagagacaccacccctctcatggttcttactcacccctacacccacaattgaccataggtaattgtgcaagagaccacaaatagaaagaaaatgaaggaagccttaaaaggccaaggtagttccaagttataaaacagagaaaggctgaaaatttaggcagagatgtggagaaaatccgagccatgacacttaagaatgaactggagtaaagatccatgagcacctggtgcagggagagacaactctacctatcaatccagtacatgctactcacacaggactattaattctagtaaataaccacagctttaggaggggcaaatgttctggaataggctgcctgttgaaaatacaagtgctagggcctttccataacctataatcaggacttccagaagtaatatccaggcatcttcattgaaagctccaaatgtgattctgaattatactagaggtgagaaccaatgggctactggggaagttcaaatcccttagctctagccaacttttataaattcatctcccttaacttcacaaacatatacactctgctgatgctagaccggtgtccttgttctccatccttgctccgtcataaagagaaagctagtttatgtctttgtacaatctacttatgactttatatcttgaatgccctgactgctccttactacctgtttaaatcttcactaattccaacaatgggttagagtttcaccttcctatgaattcacattgatttttcctacacattaaactacagaatctgtgtcttcccctatttctactcttacatcaatatgaaacaataatttgtttgtcttacaactcaatatgatcataaaccatatgtgcccttagaaagtgttcacatggttttgttggtacctctttgcaatgtatatcagggaattttaaaaaatagcagactgaattgagaccagtacttgcatgttcatcatcatataatatgggacatgtatatttacctccaaacattctcagagttcattcttcgtaccctgtaggcttatgctgtaaagaaaatacatatgcagaaataaaaacagagtttgaatctccagtcctaatccttcctctgaactcctgtctcatgtatccaactgcctactacatctctttatttggaaaagaatttcaaattcaacattctccaatactaactcataatcatctctttcccaaatctgctcatttctccatatcccctatagctcccaactccatgggatattgccatttatccagtggctggggtgaaatgcctgaaattcatcacacctgatgtctctctcatgtaaaaccacattgagaccctcagcaacttttgtcagccctaccttcaagttatgcagagttgaaccacttttcatcccctccccactgccattgccctttgcataactgggctactatgataactactacatgctcttcctgtatcaccctgaccctgtagactgttctccacagtgtagccctggaactcttttaatatgtaaatgagatcatacatgcttaaaaaaatcctctatagctttctgtcagtctttatcatggcctgtgtgagctggtccctacttatctacatgatcattcttactttggtccacttgagccacacatttcttcttgctcttcctggaaaatttcaagttgttcctactccaaagtctttacaatatccatcccctttccctaaaatgttcttcctgctggtcaccacatgcttaggttcttctaataatttaaatatttgctcaaatatcttccactcggtgagacctttcctacttaccctatttcaaatagcactttctaaattatatatccctattttctacctccttattatgcattattttcttcctagatctgatcattatttaaaatgatttttttttgtttacataattattggctgtctctccttccactataaaataagtttcataggaaactttgtttaatttctcactatattcccagtaattagaacaatgtctgaaacattataggtacttgatagctattaaatgactgaatgaataagtagatgaataaagtgttccagtacttataaatctcatcccagtcacataaactttaaataggaaatctttattctgcatggtgcagcggcttctctggattgtcccagaggcctctattctttccatctgactgcacaggccagtctgggaaaccacctacatgcaatagctcacatgtcttataataaacttcttgggaggagtaagtcaaattagatagttaactaaaaatagtatctctgagtttataaaggagacgttttcccagcccaactggtcctggtaagttagactggcatcaaatgctgacatggcaatcttatgcttgatgaaccctcaatctggagaggagtgagctatacttttatactatttattttgtgaaagttccaagtatagttcatctttgtatccacaatgtcaagaacattgctgagcagagagtagagcttcaataaatgtttattaaacagatgaacaaactaatccatgaagcaaacaacattctaagtgctattcttctatgtctaagctttgacgatgcgctatataaaattcattcttgcaattttccttcatagattagactgaaaaactcatcgtgaaggaccatgtcttatccatcttgtatcccaagttcttagtacagtgctggatgtaaaaggaagaaaaactccaaagcaaaggatagagaagttagaagtcctggcagcgatcagtgagtattaaagaatgccagtatgacgtgattatcagatgttaggtgatgaaaatcatgccagctaacatatggatttctaccctgtttctgtataagacttgagctctaaatttagttcctgaacacaggggatcagagttgaaggtgattatttactatgaaactgctattttccacagtatacatgatcaaagtgctagaaacttaatgcatgaaaatctacacttctttactcaacctctcttacagttatataaaattctttagaaaattaatgttataaaaaagagttcaggccgggcgcggtggctcacacctgtaatcccagcactttgggaggctgaggcgggctgatcacctgaggtcgggagtttgagaccagtctgaccaacacagagaaacctcatctctactaaaaattaaaaaaaattagccgggtgtggtggcgcatgcctgtaatcccagctactcgggaagctgaggcaggagaatcccttgaacccgggaggcggaggttgtggtgagccgagatcgtgccattgcactccagcctgagcaacaagagtgaaactccatctcgaaaaaaaaaaaaaaaaagagttcagtttgttcactaaagggctcaatttgttcactacataaaaggatatagcagtttgttcacgaaatcaaagccttttcaaatataataagcaatagaagaggtgacaaaatatataatgtaactattaaatcagtatgccttacaagtatccatcatggttatagtactaattgccttggtttgtccaagactgaggagggatgtgagcttttccgtgttcaaacagagaaagctccaggctagtcaggacaagttggtcaccctaataatggtataacctgctaagctggttatcagctattccgatgtatctatatgtaggatctataggtacatgtagaatatatgatagataactaggcattactaggttataagatgattaagaattaatcagtctgtactagtataccatatgaagtgcaaatcccttgtttcattttctcttcatttcccctcgatgttggacttcttatgtttttatatcgtatgcttatattgattttattatagtcaaatacattaatttggggtgttaggacaatttcattttcttcagaagaaaaggaaaagtgagtagcagcaatgcagatgggtctcaattgacgcatgagctcatctgttttttacaactccaagtgtggtaattccccgtagaattaaaatttcctaacacagaaattaaaattttcctagctgaaaatgccggctttttacatatcccaaaactgaacacataaagattaaactccaaaagtaaggcaagatctacagaactatcccagccctaattctgccgagatatttattataagacaaactgagacagtcccctgtggtctccttaaggtcctgatggccccctcaaagcatcatctggctttaagagaactccaaaatagtaattggtctttgggcacagaatagccattggaatctggattagagtctgaaaaacactgcattttccaaagagattacaatgccaggctttgaacattgaagggtaatatcttctttctaagtatctctggtcagtctcagtaactagacctacttttgaggctccatttcttttatgtcttttaaatttaatgataaaaaagaaatatctaaatttataatatacacgaaacagtgaaattaggagaaaaaattctatttgatgtgtccatttttttaagctcccatgactaaaaagatcaacagttacctacatttgtaatatttatgcctcccaggctcagtgtaatgagtttcatctctgatcgaatttttataactgactttcacttacctgtgaaataggtaataggaagccttggtaggtgctttccctaaagaatcagatgcaaaagttagacctactgcaaacaatacagaggaaaaaaatgtcactctaatatactactactatatccgtctgctttttgcaggaaaggaaagctatcatcctagacagaaatactgaaataagtgaagtacagacaagtgattaatcaaaatctgaaaatcatagtcttcagctttttcttccatgaaaccatggtgtgtcctcttaactttggccaagtgcccagctaagagaattcttccatgagatgaacatgcttcagggcaaaaccttattctaactgatggttttaaaagcccaactctacattctgctcaaggctttggttacgtaggtaagccaaaacacaggagacatgacttcctccattaaactggctgaagcccaggttacactaattgagcctaaatagaaaacctctgcttttcaatccctttgttctcttggatgtcacagcttcctgctctattcgcttccttttatagtcttctctcaccaagcatttcaggaaaaaaaaaaaaaagctaaataaagatcacagcctgttccattgtgtccccttcttcttcatcatcttcttttccatgtgtgcaatgttgtggcacctattaactaccaatgttttcagaatgacattatacaaggtgcaggctgtaccactgtgccctaaaaatatcaacaactgcattagtctcacaataattaatggcaggcattatgcaaatgacaactttttcgctgcaaaataatgacatttcttcattttgagcagagttatgcaaaacaatgaatttaggatgataaatcacacaggagaattaagaaagccataacgttcctgcccaggcaggcagaaagatagacagaccaacaatttagaagacattgttttgttctcacaccactataaaaaatcatagccagtcggccattaatgtgtgtaggtttttttccttctcccctttaggcaacaatgcataaggggatgctaaattctagcaattggatcattacaagtcacaagcaaatttttctttattaaccttaataagtcattcactcagagactatagtcatcaagcaaataaaaagtatcacatgccattctgctacacattaactaattccttatgcaaacatcacaacatatagcaattactgccgctcaaaaaaacaaagtcattttcaatttattttattgcttttatacttggccatttcctgtagcacattatcgtttctttccctaacaacccgaggtggaatgaagaagaatttcggtagcaatgagccccttcctctagccacctttgtcatacctttttcccctccgggaggcttttaaggaaggttagggataaggtatgtgcacgctccttcacaggaaatgtgcatcaagctcagagaaatggtacattcagctcctattcttgcagcaaagagagtgtggggtaggcagtaagacccaagtctgtctcccacatttgctacaataacactgacagctttcctttattcagtaaaacaaggtaaaagtgtaggcttagacctgtccccaacaggtgaacgttaaagtcaatatatgcaacgttgacctgagagatatagtaatggttaatgagaattatgaggttacttcgtcttgcttcactcagcacataacttgtcccttccagaatgctgaatgaagagcaataataaatactggacactaccccacaacatgcacagtattaaataagatctttgtgtgtgtgtgtttttaattctataacatcctttatccaagactcccaggatgtgaaacaaatgctaaacaaagcttacacattgctaacagattcttttagcccattttacagactgacaaatggattctgagcaactagaggctttacacaaagttggactggaacaggtcagactatctttccaatgttctaacctctgaggcccgtggcctcttataatcatgagcattctttcctgctgataaacaattatgctgtaaacagcctgtacatgtcccttttcacacaacaggatgataatctctctccgttctcctaaatccacaatccattcccccctttttaaggtagaacatttccgaaatacacacgggaaaagctctgttttcagtttctcctcctgaaggtaataacattttgcagttctccttaaataaaatccagcccatgctggatcaataagaatgatgcccatttccctaatggcagccgattgccatttgctattcaaatcagactagataaattacagtacatgccagggaacaggccagtgaattaagacaggcctccagaggaccagcgatattattaatcttttaagacactatcatatttcttcttgacagtgtgcgtagactcacagacacactgcacccagattgaaatatcagctgctgaaaaaaatcaatagtgttagaaacacaataatttttggtctgcagggtctacactaagcaacacttgtacccctcctgtgccatctcttctcccacttcccctttgccatatttgcctcctacctttttgctcttcccttttcattctctggttttaaaagcttgtaagtccaaatgacaagatattatgagaaggtttccactgctaacactggccattgtggttacagcgttgatttttcatgggttgtttgaaatgcaattttactagtctggcaaaatgttttggcgtgggattgtttttcctatgaacttaatatagattttcaacccttatgcacttggttctgtattatgaagaaatgaaaatatttataggggtggccatacctgaaagttctgaggaaagtggaatgcacagaagggaaaataatggaaacctggcccagaaatgaaaaaaagtggggggtattcattgaagatccaggagaataaacaaaacaaaacaaaacaaaacaaaaggctacaggggaggtgtatgtagagcagaacatggtaggaagaatattctacttagattctgaaaacttgaagttgacctctgcctctgctgcctgcacactgtgtggttttgccagttacttacccttgcagagccttggtttccttttccattaaaacaaaacaatctaaccacctacctcatagcattcttgtgagggctaactaacaagatgtgtgtgttttctaaataataaaattgtgaatgatataaactaatttctactagagagaggtttatgaaatgtgtctgcttttttcctttttcatagatacagaataccataaaggaactttagacgttatcaataaataagcaaactgatagccacagaaaggttattgaggttcacattaccagtagctagtagaactttaagtagaccaagatctgttgaatctgagccagtcccttttacattttaccagatggattttaccttttccatgtctctttctactagagatttgaggctttgattcttgtccatgttgcttttccactggggaggcagataaacaaaatgccacataagaaaacaaaaacagaaacaaaacctaccatgtttgtgtatatttatatgctattcttttgatcccaagactccctccagttcaccccccattttgattcttcctttcataacaaaatgtattagaaaaattgtccgtattagttattaccgtatcttcactttctattcttttcttaatctattccaatcaggcttttatccgttccactctaccatatctactgttgccaaatgcaatggtcacattttaattttcatctgactcaacttcttgcaacaatttaacacggataaccgcttcttttcctcctcgaaactgtaatatcttttgggatacccctcttttcaactttctctactatcttacagggcacttaagcctatttaagcctcatcaaatttgaaatctgttactagcaattcattcttatttctgaattgggataaacacagtatatttggaaaaacagtggactgtcagatgttttgatggtctgattttatgactttgatatacaaaaaagagtagaaaatcttattcttggtttggcttgaagcttttttattccacatacctcatggcaaaatttatgaactacttttgaaaattcataagtgatcatttacctagatccacttaattgctccacccagtttcttcaaacacttgttctttgaggtctacatggcaagaagtaaatacgaaaaccatttccaagtgaactaaagtaacctgaatatgttttctgtgttaggttgttccccctacccacagcaaaagcatgaagacttcctttaagaatacaagatatattctaagtctaccagtactccatcttctgatgtcagatggagttaaagttcactttcatctcaagagaaaaaacagtcattcctgacttacaaacatgagtggagggaagtacctgaacacagggattgctttcctcacatctggctctaagatacaaccacgcgctgtgacatataaaaaggtcactgacacgagaaaatatcgcaagatattacaaggataatcaaagccaaaatatatccaaacccacttttggagagaatcccaataacttcttttgaatgtgataataaaaataacatgaataaagatcattttcttaagaaaaaaaaggaacgtttctatcacttgcctgccacttgccacttaggagtagactctggctcccttttccgcttaaattcttccacagagtcagcttgccagactcttaaccaaggtttttcttttatctagactataacaaatactccattttgggtcatgagaacatagtagcaaaattcccagagttaatactttaattatacacatatgtatttattattttgtatgtgtgtgagctgttccactaagttaaactttaaccatattaatccaggaaaaaaatccctgattatcaactaacaattttgtaaacagttatctcacaggttaaatattaactcgaaaaatttaactcaaaactccacacaagcagaaggagccaaaaggccaggaagaagaagtaaagattagctgctttaggaggaacacagccaggaaagtgagcattttggtagctggataatgtgtaggaagtccagggggttgtgcaggggggggaaatagaagcaagaagggagcctggaggacacctgctgcttatcataatatcaaaacataaaacaatgaggtgagaccttaaggaaaagaaaattcatggagatatgaatccattgataatggccacaggaattcaggtgcaataaaggtttgaacctcaatgatatggacatagctaaaagatccaacacaaagctagctggagcggactgcctgcctgccactgaatatcatgaggaacattctggggtccctcttccactagaaataatgggatgaaggctgctctgcctgtcctgtttctgtttcctaacaataaaacaaaactgaagtgtctccctccagtattgggttattaggggcaccgattgcaagttctaagcctttatctaactgtccatcaattctctccctgattaacagaaccatatcacgtaagaaaaagttggaaccagcagtagactaagtcagaaggcttttctgtaccggaattgctgaactacaaatattgttctctggttaggattttgactaaaaaatgtcaagaaaatccacatggccagagaattcgcacaatcttgatatctgaggtacagggtaaagctgatgtattttaatgctgttttaggaaggttagaaactgttaagattcttcctgtcagtatgtcaaatatcagatcagtcctgcttgctgatttttaaggaagtcattaaaaaaatcctcccagtgagtagctttcaaggaagactcccatttgcccggcagatctaaagaaataatgaggccaaataatgcaagtttctcaagagaggtgtaggattgaatgaaaaaagggaagatatagaaatgtaggagaaataattcttacatatataatatatataatgtatatatgtatatattgtgtataatatgtatatattgtttatattcaagaaatatgatatagcttatcatatattacttttgatatttttcttatacatctagtacatgaatacatgcttattggaaaagtacaagtacaaggtgtagtctctattatctaaatatattatttaaatatatatctaaatatattatctaaatatagatgacacctcgtacttgtaaagctttttgcagtttataaaatatttttgcataaaatatcttttgctttcctgacaaccacaaaaagtaaaaagggtgggttctataatttctgttctatagacatgcaagtattactctaccattgacgtaactggtgcagaataaacctgaacagaggaaatagaatccattagtagcctggttatccatatccacatgccaagtaagaaagcagcatgatgactgtggaaatgtaaaggcattataagagtgatttttggagaggattaaggagggagacatcaaaataattcaaaaggaagtttagaaaatcagtagaaataaagggctaaatttggagtaacttttttggaaaaaaagtgtttagaacaaggaaagaaacttccaattcagaccatgtattcatttggcatatactaattgtatatctatgtttgattttctttgatagatgctattgggtaaataatgatgtgtatggagacactgacctgtgcctgacatatttaatatctatttgttgggataatgcccagaaggaattattatgcaataaaattcagatattcagaataggggtttagagagaaaatcatcactgatatgtaggctgacaaaggaaagcttcagtatgatgaacaaatctagttatactttgaaaaacatgtaagatttgggaggtgataagacatttcaagttgtgtgaagggcatgagagaaagcatggaagcagaaaattgagatatgtatttgggagcagcaaataaacaagttagttggaattgtaataggaaacaatgctggaaagatgggttgagtgtggaatgcgaaacggggtccttgaataatgggctgagtagtccactttattctgtgaacacaagaggtctattaaaggcttgtaaagtaggacactggcatggtcacagtgatattctagtataaataattgggaatggtggacagaaaaaactgaaacagggagagcataaaggtaatgagagagaaagagagagagtgcgagcttgtgagagcaagagaatgagaagtgatccactgcaacaacccaggtactatgtgataaatatctgacttcggtagtgtcagcagaaatgtacaggaaataacatgttctagagacattgtggaggaaaaaataacaatatttactaaagttctactctgtgccaggcaccgaactatgtgctttatgtagattaacccattaatctccatgctaaccctaagaggtaagtaactttattgtttccattttacagataaggattaagcaactttttcaaggttatgcagttagtaagtggtgaagcctggattcaaacccaggcaatctgactccagagcctgttctcctaacccccacacttactgtttttcctaggtacaagggatcttttggtggattatatatgacaagatttgatataatttgatgactgactacatatgagcaataaattcgtgggattcttgggattctcaattctgagatttttgggttatattatgaataaaaagaaggaaataaagaagatcttcttgacttcacattgtacatttgttcctaatggtccaattgctttttggacttaaagtatcaatttacaataaaagccacagaagcaactgaaccaccaaaccggaaagctctttgaaaatgattcttctttctagtttcactaatgtatatctggagtatagcacagttcttcgcatataggggatgcccaacaataacatgatgaatgagtcaactggagaagtattaattgtaataagtgagaataagggagtggagggtgtaaaagtcaaaagagtatgacccagagtcagacaaatattggttcatatcctggctcagggccctttctaactacatgacatacagaaagttactttaaacattttgtgtaatatggggtaataattcataggaaagctagctaccttactggattcagtggttttatataaaggcaatgggtgtatgcaaacctagtaaggaatgctcccaaaggctgttacctctgacagaagaaaatctgcaacccctttctctttgtttaacttacaaaaccacatgaagacctaagaaaaaaaatctgccaaataaattccagttacaaaaggaaaataaattattttgaaagtaaaaactataatttcaactgaagaagagattttaattgcagggagatagatcagttgaatggtttaacttggacttgagaaatcagtagcagccagtgggatacatattaaagaaaaaaacaagtttaattacccttaagattttatacagcttggctcttccctcccacacctagtctgcttccatcaggtcagactccttttcaatcacactctcttccatccttttctcagttgctgtcatgacaagccaatgagagaatgacataccgatgaaaacaaggtttgagtaattactgcactgtggctggttgttgtctgggcatcattttatttcttccaatcaaacaggtccttggacttcacagctctgtttcaggtgggggtgatgctgattatattatgacattatagcaaagacaggcagatcagatgaagtgaatttcactcagtaattaaactgcagtttctttcgtctaaagtccagggcaggattaatcgaaacgtagctctttatcattcctattaatgctgggatttgaagagtgagctctgatttgatagctagccctgaatctggctgactggtgtccccaaatctgtctaacttgcaaaaataatatcagatcaagatacatttgcaaggttatacccttcccttttattttacttttttttttgataaggaaatgcaaatagattcaaatatgctgccatttccactaccttgttttctattacaaaaatgtctgtgaaaaaaatcaggtccttccaaaccccacagcattttacaaatggttttccataattccacttaacaccatgctctaatggcttctaattttgtgacttttcattatctgagactcaatatgaatatttggatggcccaagcgacagcttttcagaggctcaaaggttctacttttattttaaaggactcattctgggacttatatagagattttgtttcattcaatcactcttgtaatgcatatgatatcaccaaattctttaacaagtatgagttggatcactgattctcaatcctgggtgtccatagaaggacctgtgaagctctgtaaaaaatcagcctccagcctccactccaggccacactcacagatcggaatctctaggttttagacacaagattttatatattcttgaactccataagtgatttgaatgtgcagctagagttgaggaccagagtcagccacacagtgtattagctgtatttgcaaaatatttattaaaacaagccattgttcagagaaattagcctcacattattgtgagagatctctcaataaaataataaaaagcttattccagtagcctttgcatagaaaaagatatacttgggtttctttccttcttttcttttttttttcttagacggagtctcactcttttgcccaggcaggactgcagtggcgctatcttggctcactacaagctccgcctcccgggttcacgccattctccttcctcagcctcccgagtagctgggactacaggcgcccaccaccgagcccggctaatttttttttttgtatttttagtagagacggggtttcaccgtgttagccaggatggtctcgatctcctgacctcatgatccgcccacctcggcctcccaaagtgctgggattacaggtgtgagccaccgctcggcctcccaaagatatacttgggtttcttaagggaagtagaggaaaaggaagactgtaaaaacagacaggtaactgttgatggggcttccattgttctctctgataacattgaaggtgatggtttactgattgagctcatcacatggtaacactatagctaccaaccatataatttaagatgacagttgactaacatcatagaatctcagagtttggacataaacttggaattagctgtcatctattttaaccccttctctattcagctgcctttttagaaagagaggcagaatttagaagactttatttcaaattctgttttcagttctgtttcagagtttaagaatacacgttctagggtcaaactgaattcaactactagttgggtggcctagatatttacttctctaagccttaattatcccttctttaaaatgcggcccagaatatgtatctcaaagagctatttaggttttatattaattaatttagataattaactagaatgcctggcacacaaaagtatcagaactcaataaattaagtctattgaaggaaattgcaatagtcacttttaaggttgtcactgagactctatgcttaacaactatcagtttggtgactcacagatcagttttctggaagatttgatttgccaaagaaaaagagagtgagtccaaataggaatggctttcacatttaattgagccataaaataaaatacattttattaaataaattttataaaatacaattttattttaatgatcacctggaaatgatcattaaaaatgcaaatttctgggctccaatcccagagattctgattcagtttgtaggagtggagtctaggaaccatccaggtgattctgactcagggtcaagggtcttcactttaataaagacagttataaaggaatataaattagccaagcatttatcccccaaataactacagtgtggcttgacctggaagagaccatgctttctattccttaagtcagaattcagttagatgagtttaaaccatgtgcaaatacaaaatgtttatagagtatatttatgcacacagagttaaaaaatctatttctcttcaattaaatatgccttctcaacaattatcatttagccactaacattatcttcatctcttttcatcactactgggtacatgtaagtatacagacaagggtcagatttgctatcgactcatccattttcttcttacaaaataataaacaggtttcataaaattggtaaattccttgaataaacaaaagcagctatttcctcctctaaatgcattgtagaataaagtattttcaaaacgcattaatcgaaattgataatgaaagtcaatatataattgtgagttgaatattttaaatgcaattgattacttcgctaaaatgaatatactcaacttacacatggagactgttctggatctaaggagaaatttaaacattttcattcccaatcagcgaaatcccagaaatgtgtttagagtttctaatacaatataccaacaaatgtgcattaactctctatattctaaaagttattgtgtaacaaataacaggagaattatggtctctaattgcagttgaacataaaattgagctggggagaaaataaggcatcaacatgagaaaagtttttcagcattatacaacaatataggctagtggccaagtgtaaggctgaaggagaatctttttagtacatactgtgtgaggcagggtaagctaccgaagatctgcaaaagtcaggcacagtaactcactgagggggttgtggtgaccacagtgggtactgaataaatgtaacctattatttattataatagttgacagtttattttagtaacacaagatatatcacagataagactatgtaaccggtaaaaggtgaatggtacaggcactgagagttacagggagccaaaactgagagaatgctggcatgactggtaagggttttgtgaggaagagacatttgaatggataatgcaggagagagaggatttggctagacagaggaacaaagatcattttagacagggtggggtgttttgatatgaatcgcaggtcaaagttaaaaagtgtttaacgactgttaaaaaaaacagtttaggatgaagccataaagataaatttgaagtagaacaacagagggttctggattccaaaaatcacttgtagtttctggtagaatttttaattgtcaaaatattttctcagtggaattcaatatctctttagatcagtggttctcaaattttagtatgcatcagaattacctgaagtgcttgttcaaatacaaattgctgtgttccacctcaaagtttcttattcagtaggggaaagtgaggcctaagaatctgcatttctaacatattcctaggtaatgctaatgctgctggtcacttggagaaccactgctttagaagacagtgagataggccgggcgcggtggctcatgcctgtaatcccagcactttgggaggccaaggtgggcggatcacgaggtcaggaaatcatgatcatcctggctaacatggtgaaaccccgtctctactaaaaatacaaaaatttagccaggcatggtggcaggcacctgtagtccccgctgctcaggaggctgaggcaggataattgcttgaacctgggaggcagaggttatagtgagccgagattgtgccactgcactccagcctgggcaagagagagagactccatcacaaaaaaaaaaaaaaaaaaaaaaaaaaaagtcagtgagataagagaagagttggatgaagagtttcatggataagaaagagttggacgactatttcctaaagtcaccatataatggaatagccctctttatttcctataaaatttcaccctccctttcataccaacacatagagaaacctacatgaagattacctagggatcaaaattcttctttggctttctaatccctctattgggttcaggtccttaactgtgggaatgaagaggcccatgatcaaaaggagcccaggcccaccaacctggaaacttgaagacaacttaatcactattaaggatattcaagaattcaaaataacagacccaagagactaaagaaagaaggtggaatttttattccaaaaagcctctgtcagtttcatgttgaacattttgtacttgggctgcacttaactgcctgccccttaatccacaaactaatatcatctcaccttggttcacctttttcttttcttcaaaaggcagtcagaagcaagcaggggcaatgagaactttctacctaggcatgggccactgtttaagcatctccaccttctgcttcaaaatctttctccaaaacaaacttccactatgtggtaactatactgtaagaaatcatttaaaaggcagaaagaggaaatgaaatgctctgagagactattttctcatgcataacttcgagggcagtatctcacaagtcagtactttatttttgatggcagacaaaaaacatgttgtgtttgaagattcatgtagaaatctttgtgaaaaaaggtcaaaattggatttaaaatgttcaaaactccaaaaatctctaaagaacaggagcttgtttattttctagcaatttatctttccttaaaataagaagctatataattacaaagtataattaataataataacaataattaccacaaatacaacagaaataatgatagtaagcaccatgggcccagatccccatagttacaaaggataagaatttgtctcagtatatttgagaacagacagcagcccaataatacaggaaaaaaaaattggaaaggaaataatctttcttgtgctccctggaaaataccacagaaaaatagacaatcaaatttaatacctgttgttaaatatcttcattgtacagattaggtcaggcaatttaaatagacaacaacatgaggcctctaatgtctcttaggaaacagtttcaatgtaaattcctaggaggtcccaattcaatttctagttaagcatccccatccactcgtaacactcataagaaggagaaatgcatttgtatggtgttttacagtttataaattattctcacaaacgtgttatttgattgtctcaaaaatcctgtggggtaggtaagtagagaaagtattaatagtatacccattagaaggtgaaagaattaaggatcagagaaaaaggacataaattaatctttattaaatatccacattgggtcaaactgtgcagacctggaaagaagtccaaataaagttttacataacatggataggcttggagaatttgttaactgcccaaagtaaaaaaatggaagagctagaacttgaatgcagataatgcagctcaagatgtaatggtctttccatcagaccatagactaaactctcagttgtaaccatcgtctagttacagtaactgcccctctcaagaggaggctatttcattgccaagaaataaaaccgtgaatagtggtcaggttttctgtttttagttagactgaaagaaagcacatactccttgagaagacgtgcatctttttaacatgacttagtctgtcaagagaataagagagagaatgtgttatttcattcatgtagaatactgacttttaaaagtcactcaatttctctaatgatcagtgatgttgagctttttctcttaggtttgttggctgcatgtatgtcttcttttgagaagtgtcttttcatgtcctcaggggagggcagtgtgggggcagagagaatcaagaaaaatagataatgcatgcggagcttaatacctaggtgacaggttgataggtgcagcaaaccaccatggcacatgtttacctctgtaacaaacctgcacatcctgcacatgtgcccaagaacttaaaattaaaaaaataaaaaataaaaaaactgactccagctacccatggacacaagagacaacacggtcccatttgtcaccaaaatagacaacacagtcccatttttcactaacatactctttgcaagaaagataaactaaaagactatccaacattaatagctagattctggcatagtctcagcttaaactattagtttctaaataagaggcaatacatatgcatagtaaaatagagaataacagcaatggatgtattaacaaaatgcattttccattaattgttatgaattaaaaagtctcgaagctatagatcgagactttgaaacttctggaacaaattaacctatctctttttatttttactttatgcatgcatttacttgtgtagttggtgttgctatgttttcttaaatttgtttttaagataattatattctccctctacttttatacatatatcttctgaggcatttaaaggtttgacaaagcagtgtcttctcacaagagacagaggtttcacttagaagccatcttgggaatttgggctgcagaaatcaagggaggtctagtacgtaagtaaatattagtgcaataatattaaatttttgaatactaaaggaaaacatttattgaaagaaaattgctttatatccttaacaactaccttgctatcgaggatttttagagaattgcagaatttcagagttgatgctatatgtaggattttcttttcttttaattttttttttagagacagggtttcactctgtcacccaagctggagtgcggtggcatgaccatagctcactacagcctcaaactcctgggctcaaacaatcctcccatcttagcctcatgagtagctgggatcacacatccggctaattttttttttttttttttttttgtatagacagggttttgcttgggggcccaagcttgtctcaaactcctgtcttcaagtgatcctccctccttggcctcccaaggtgctgggattacaggtgtgagctactgtgtctggccccaaagattttatttttataatgacagaatatcagtgttagcagagtccattaaaattatatatgacaatcatctgtttaacccatttatgccaaatgttgcaattttgtgtgtgtgtgtgtgtgtatgtgtgaaaaatcagaacttggtgatgaccttgagcaacaggatatacataactgccacaagcttagcattccaatagtggaacactaggcataaatgggttatggcttcagtatcctgcaaaatatccctgtaaggtagctgtctatgcttaaacaccttggtcttaggaaactaggatttgtggatattaggcaatgttatgggctgattgtgtcccctaaaatacatagggtgaagccctaagctcctaccaactgtatttggagataaggcctttgaagaagtaattaaggtttaatgaggtcataaggttggcactctaatccactaggactggcgtccttataaggacaggaagagacatcagaggttctcttgagctcacaaagaaaaggctgtgtaaggacacagcagcagaaggctatctgcagccaaagacagaggcctcaggaaaaaccaaacctgatgacacctcagtattggacttctagcctccagagttgtgagaaaccaatttctgtttgctagtccacccaccttgtggtattttgttatggtaggcctacagactgatatggtgcctgtatcagtgcctatatggtgcctatctcatcacaacctgtaaggaaggaattacttaaagccaatttataggtatagaaacagactatggaacattcaagaaatgtcccaagagacaaggattcaataagtggcataactgagatttaatctaggtctatcttccatattattttttaccctcctattttttacctttgaacacagaaggctgctacaaagttagtgtttcatattgacttgagtattttattcttgtaggtttcatcactggctgatggtctatttgttggagtaacagaaagcaacataatttatcttttagatgactgtcattcatatacttgaagatagttattacattccttcctcctgaatttcctgttaatcccggttcccttaaccattgctcatatcacatgtttcagttccctaccattctggccacttatacctgaagatgttcctatctatttaaatttcttgtactgggttggaaagtcatatctctgctacgtcattcatgactagtctttttaaaatataaaggcaatatcttgcatttatccatttagaaaatttcatctgttagatgtagcccataattccagtctttcaatgtctttggaattcgattacttcattcaacaacttttctatgtatctggactcatgtcatctgcaaatctaatgaatatgttttcattccagttattgaaaaaaacttgtgaccaagataaggccgaaaatatccttgcaatatgccacaggaatcccctatattatgatattgagccatttgtttgtacctaatagtgtggtcaatcaaccagttactaatccagctgtacctacattagttactaatccagctgtacctagattagtaactaacccggctgtacctagattagtaactaacccggctgtacctagattagtaactaacccggctgtacctagattagtaactaatccggctgtgcctagattagtaactaatccggctgtgcctagattagtaactaatccggctgtgcctagtttagtaactaatccggctgtgcctagattagtaactaatccggctgtgcctagattagttactaatccggctgtgcctagattagttactaatctggctgtgcctagattagttactaatctgtctatatatctaacccaggagatatcagatcacatattgtagacatcattttactgaagccattctattgtctagcaagcaccacttctttcagtggatcatgatacattgttttatactttattgctttaataatccattctagactgttgctcaggactaacagcaagtagttgcatcatcataaattgcctttctatactttctgtaaatcagaagatttccacatctctagttatctaacattgtttctcttctcctcaaacatggatggtagtaattgactatctcattgacaaatcctctcatgagtatatggttctctatccctatttttaggctcttctccttttcctttttttcctgttatcttccaaggaaagagtcactcatgtttaatcatgaacggtatgttggtcagagatagacctgcaaactggaacaactgagaagatttatacaaagtgttgtcctagagtccctgactgtgcccgtagaggaaaatgtactatgattaggtgaggctttgctctcatctccacacagggctctgcatggcttttctatttcacttctggcagtactcctggggaaggctacatccttttcctattcattctgggtgacttcctttgccaaagattcaagacagctttgtatttttcagtctttaactgagaaaggttgtgatatataatgcctttattttcccatgaagactttctctgaggcatgcacatagccacgacctttacctaatcaagaaaagttgcttgggcagtgggggatggggatgcaggttggactttaaatgcacaaatcagttctaataaaaacactgagattcaggtgcctgaggttagaaatactggagggaattcaattacactaattaatatttaagaagggctagagatcacacactgaatgtgggaaactaggccagtcagacatgagcatatggggagggcaagatcaacagataaaagtaacaaacaaatcatacataaatgctccaacaggaatgaaatagagaatataaaataaatgttccaacagacactgaagaggaggtaaatggtctaccagacataaaagcaaaatgttccaacatacacaagacattttattggtttaatgtaaacacatatattataaaaatgatttttccacataagttagtaggaaatgttacccatttatagaaacagacttacgggttctatgaattcacagcatactatatttgctctcatttcctcactggctcatcatgcaggagtctcaataaggcttgactttcataacaggtagttctccaatgcctaagcctacctggatacccaacgcctgacagaaggctgaaaagctgcagagtgtgcctgcttctgcacaagtttttctagttccggttgctctaatgtgatttggttggtgtcacagctaataccacattctctatttgatctgatttttcatctgtggcccagacagttgattctgatttttggtcattcttttatagacttgaaagttttctagagaaggcactagtggtgccaggactatcttgcttccttctgtcctgtctacactagcatttaattacacttttctacctcttttctacctctatgccctctcaccctccttcatcttgggagcttccaaaactagaagccaagagaattaactaggttgctttataaaaattgtatatatgtagggtaaacatgacattttgatatacattggattgcttttgctatcaacggcatcatgtagaggtagtagtagaagcatggaagggtagaagaaaggactgagactgatatttggactcctctttcaagttttctgatgtacacatagagtaactagatggcctggactgtctatgtacaatacggaattttaggctcctggaggaaacaaaccaaaacaaaaataaaaacaaagtccttttccttcagtagctttagctttagaagaataaatgattcacatataccaaaacccacaagatacggtatccccaaaaagttaaattgtctcttacctaatagaggatcagaaaaagaaaagatagttatttcctaaaaattgtttgaaccaaatttgtggttttcaaactatgcttcatggtccccagacttacaaagagatgattacaaaaagattatcaaatagatataaataaataaaaaaataaatacatatataatatgtagtaaatacatatatatcaatttgcaattgtgataaaaatgacatgcaaatttaaatgtattatataaatttaaaaaacactggagaccaatgtgttattacaagttaattatgtacaataagaataagcagctttcatgcaggcctctaattaaggctctcagattggaatacaagctgttgaaaaaaactgttacaatatgcaactacttatcagtctcatgatttttttgataccatatagtatagtacagaaagtcttcacttattgccatccataggttcttggaaactgtgattttaagtgaaacaacatataatgaaagcaattttaccatagactaattgatataaataagagttaagttcttatggcaaattttgggtcacagaaacatcatcaagtttctaaataaagatcaaaacacttttgatattaaacattgaaataaatgtgagctgtacatgcatttaagaaagattaataaaagcaagaaataaatgtgagctgtacatacatttaagaaagattaataaaagtaagataattatttaatcaataattccagttcagggtcatgagtggatggagcctatctcagcagctcagggactggtaaggtgggaaccaagcctagacaggatgccattctatcttagggggcactcacacacagccacattcactcagacacacccatgagcctaacacgcacatctttgggatgtgggagaaaacccactacccagagaaaacttatgcagatatggggagaaagtgccaactctacacacacagtggctcactgggaatagttcttttttttttttcccatcagcgttatgacaccatgttatttgagtatctgctatattccccatacaaaaatacattgatttttgagccaatacaataatccaatgctgagtttttattcctttgtatatttgccattatattcttattgaatgactttataatattcaatatgataaataatctgaatttgaaaatgagtttatctcaataaaatattactcattattccatatgttaagtttctaataagatttagtttgaaaagaggattctgcttgtttaaaagaaatatgaaaaatgtctggatcaaataatatatatgtatcctgcaactcaaggcagtatgaatctcatatggctccaggctgctcagtttctgaatttatcaacttgctggcttagaccactgtatacagcagatgcattgggcccaaactagattttatatatgggccactattccttcaggcttaagaacagtatttttatactgaggaatagcttatttatcatgaaaccatcatacatcaaaagaagtcacgttgccttaaacttatccagtacatgaaatttatcaccctcaaagttctagattatcagaatttaatatattagtttaaaatataaccagttgataaccaagaaataagtcaatggaaacctctttaattatctaagcagctcatcttgtttataataattgtataacttacagatacatactcatttatttttcaatcaaaatatattatattgaaagacttcagaagatttttttcttaatattaaccaacattacttatagttaggaacagagtgagccaaaaaggattctcaccactacagagaataaaactagcaaacctggggaaagatccattttccaaaacctgaactacactctatgatggtaacgtttcaagtatttataacacttaagtataagtcaagagttgattgaatgaggcctttcatgatgtttatgtagagtagtcaaaccagaattatttatgtatttgtttatttttaaaggctgtcatttgaaagttatcacagtataaaggtaaaggatacaccggagtttccattctagctccacattcctggctgtgtgaccttggataatttagttaaactaaacttcagttttcacttctgtaaaatgaaggaaatagtagaggttctattgtcatgaatttctagcaagaaatcaatgaataaatgaaatgatgaatgaatgttgcttagcatgttgcctggcacataaaaagctctcagtaaatattaactgtaattaaaaaatatctaaaagccggttgctttcttttggttatttttttaatatgacttgattttattcataacttactgactatattttcttcccttctggaatgatgttctattgaggtttctttttcttttattccagaatgttctctgagcaatctcttcatttctgcctcattcatcagataggattgtaggcgttcattttggtagttctgcatttggttttctgtcactgcttatgctgttttcttgttctaactcagtggtttaaaaagtaaaattcaagtaaggactaaacataagagaatttactgggactaatggttatcaaaattgggcataaagggatgttattaaaaataaatcacacagagggagaacagctgatgacagcagctgtgaaatggatgtacatggtgggaatcagtgagccccaaagaaacaaacaaaaaacactggagggccatgaaacttacatgatttacaagggaaacccaagctttatgaacagcctctgaagactacagaggccaagcaagtcacttctggatgaaaatttggataagacagcaatactgaaaggagttatgttccctgatcaaatgggagctacagataagaaaagaatgagaaataaaatgaaaatctttaccgagtttgatttctttattgtataacctgcactgaggggacaccatctctgggtataccactatagatacacttaccaaatgcttagtgattattgcaatagttagaagagaatatattttaagagccaaagttacaaatctatggacaagatgaattaatattagaacccatgttgagatatatagggcccaagtagtctatgacacaaaagtttgtgtttttatttaaatagaactctaaagacttagttgtttgaaatatatttaatgtagagaaacatttttttgaaaatttggtttactgtaaagatgaatggagatgtctaactttttgccttttttttctagatatggacccacctctctattttcaagagcattaaattcagttaaaaactaaaaacaaaaatactgccaagggattgagacggtaaagtaacatcatgcctgatagaataaactatcaagacagcatgaacaaacccaactgaaatggaacaagcaagcttaacacaagtcaaagaagctctctagagtgttaaaatgaaaatacaactaaacagaaccaaaactgctattcatgggaatagcaaatgaagaattttcttcagaatctacacggataacttctatgagattattcaaaatgtggaaatttttttcagaatttttgtttccaaatggaatttaatacatttcatgaaacaaatgaaattttatcagaaataaaacatttaaattaccaaaagcctagcctccttaggaaggctgttttaggaagacatgggtagaaatattttcatcaaagccctgatcatcttccctttttgaggtgaaatcactctactctgctggaaacctacatttagttatttataaaccagtattaaatgtatattgtttcaaatctctatgtaggaaaaatatcccacattcattcccattttactatgaactgtataaacttccaaaatcatcatgaaaagaaaaacatcaccctttctgctaattaagtgttcttgctttttttctagtaatgggtatttgaaaaataacaatatgcaagagtatgatcttacagtgaatatagccactaggtcaatatgataatttaatgtgagactttaaaattgagctttccttttatgctactattctctaaataacttctttatttgctatgattaaaatatcttttcatcaaatttgatataaatatactagatatggtaaatatatttatcatttaaaataacaattgaattgtacaataagcactatatcattgcccaatttttattttgataaaatctttttaagtgatatcatttcatgttaggctttttgtgctgcttaatattataattaataattcatatttttgtctttctcctctctgacaacttttatttttaatcggtgggcatgtgccaaattggtttgttatttatttataatgtaaaatgacaagggaattgaatatgtgaaataagatagattttctttcatatgacaaaaatttcttagtaatggggatgcttcttgcttacccttatagattcaagggttttagagaggttaggtcaaatgtcacacttctcatataacaacatgtggtaagtgcattaaatagactgttcattttttaaaaattcattttagttttgtgaagacatctgggcacatgcataaaaaacaggacaaaacaatatcaaaatttgtaaaagactccctattccgataaatcctatagtgtcaattaagtaaaaattctgaccaaacagatgtatttgtattctttcctaaaaactaaaacaggcaaacgtaataggaataaacagagaacgtttcaaagatacagaatttccattgaaaaaatcaaatgttctgtctgtaggactttatagaacattaaataatcttttcagtactgtccataaccagaaaccacataagctggatgctagactattgactagttatgacaaaaaattcacagtttgatctcaagggcatcagcgatcctgggctcaggtgatcctcccgccttggcctcccaaagtgttgggattacaggtgtgagccatcatgcctggccatcgtgccaacgtattgaagtggaaagaactaatgctgagcagagaatgggccatacctgggtggttttaagaggtgctgctataatgaaaaatcacaggctcacccaagaactaccgtggaatcagaacctctagggatatggccctagaatctgaattttaagccagttcctgaggtgcaattcagtttgagaactacagtcttaaggcaaaacctttctatcataccagagcttccaattgtcaggccctttgaatccaccctttgtgtcaaaccttagataattcaagagacataacaaacgtgatcatgttacatgcttcctcacagatttcagtgtctcccatttcttctattagtttaaaaaacatagtccaccatcacagggccctgtttaagccagctcctcctctgtggctctgcctttgtggtcaacctgtgcaaaactttgaggctgtgacatcacttagtcagtctccaacatttggaacaagagaactttttctaacaatttgatcccaattcctattttaagcttgagcattatgaaggctgtatctgtatataatattgaacacttcaaaacaattttagatcttaattattttgttattaaaatgttgggggtgtttaagttgacattgagtcagatgtaggaactgatatacagtgaagttaaatcctttagggtaaactcattcagtggtagaggctgaactacagagcctaggcattctgacattccaccactgtgcttatcagcttgctccttgagcaaaccttttcctgcctttatgagaatatgcccattttatgggctctgtatctatgagatattttacctatgcttatgtacacatggtgtttatctttcaaagctggactatggaaaagcctaattttacaaacatgttagtaaaagattatgtaatctgaggtgattacgtttaaaatggcaatgataatgatgttaattccagtcctgtgaggtactgtttctgatctggaaagagcagttttcttttttaacagcttattttgtattttcataatccattttaaggtttggtattaatatagacatgagaaataaaatataactgttgccatgccaaatgtatatcaaaaagttgctaatagccatgactgctatttggttaactgtatttcactatttaaataaaatgatggaaaatggtgtgtctaggatctcattcataataatgaaagacaatagaaactattagcataggtatgatgctaatgaatggtaaattttcaatagagatccatcgaccagattgtttgaaaaatgtttcctgtgggtacgaaaaatgcacacaaacaaacacatgcatcaaaatgtccataattaagtttttagggaaaaataacaatatatgttggttaaggactttcacttaaatggcattatagatctttcagaaatgagagttgatttatacttcagtattttggttcccaaaggttgggacagtgggtggtagaggagaagtagagtaaatggaaggtatacatgtatgtgtgtgcatatgggcaactttaagcaccttgaatttaatgaacaaaaaatgtcattattctgtgtttatatatttttgtgtgaaacaagtacctttctctatcactggagtttacatggattttctcatgatatcttttgagaatctctttaaacactaaaatacatttttccaaatgaaaactcccataattctgctttattaatatctgaatgaatatttccattgatttgtccagaagaaggaactgagtactgtttagagagcaatctttttcatgataattggcagcaatgtttccctgctatcagaaagaaaactatagaaatacgaaactttagataaacatggagataaaaataatattatggagtccaactggtatctttgaggtgaggacaggctgagatggactccttggcttccttctgtccaaaaatttcctgtttccctatttcctacggttaccaccatggaacatgttaaaatctcagtagggactctgtttcaacttttcctgtcaaaacacagtgaaaaagcttaatggaaaaaaatgtccttcctatctccatgccaggcacagtgtaagatccacaaacttaaaagccaggaaaatattcttttatgtgccccaaagctgggcaagtgacctagtactacaaaaattcccaaataggcatgtgacctgactaatgtgtgctgtgagatgagtcaagaaaaatggaaccatctgtacttttattggacagtcaaataatttctttctgtccacccaaaaacataatttctatgttaagagtgatacaaggagacttttagaaagtctaatttttaaaatcagagatattaaaatatatgaaaagtataacctattaaacactggtggagataagcaaataggcttatgaaatcattattgctttaaaaatttgttacctactcattgtgtactaaggcttctctacgacatacagaagaggccggtgcggtggctcacgcctgtaatcccagcatttcgagaggctgaggcaggtggatcatgaggtcaggagttcaagaccagcctggccaagatggggaaaccccgtctctactgaaaatacaaaaaaaaaaaaaattagctgggcatggtggtgggcacctgtaatcccagctactctggaggctgaggcagagaactgcttgaaccttggaggcggaggttgcagcaagccaagattgccccactgcactccagcctgggtgacagagcaagactgtaaaaaaaaaaaaaaagaaaagaaaaaaagacatacagaaggaaatcagggaaaatgggaaaatgaagggaattaacaaattgcaataatctttaagaagtagagtatgaacaattttccttttctaggatgaaagctaccaacaactgaactcttagagtgagtgatggcagaaaaaaatagcaatcaagaataggggcatgttagtttttagacatgtttacaaaactctgccttttatttcttaaacccataggtcaaccacccatcatacctacattaccccatatgacaagtggatttgttgtatgtttcaagtttttaatcttggtgggaagggggagggcagagaagtatttattggtaaaatatcataataaaggttgagcctgtcaatgattgtacctaacaataataaatatgtgtaggaagtaagaacggcaaaaatgaagccgggtaggatactgtggatatggtgacagacaagtatctatacgaaatcctgagatatttgtcctccatttcataaattaaagtgccccctcttttgctttacagataaggaaactgaggtgcattataatagcaacagcagctgatgtgtagtagatccataccacaagccaggtacgatgtcaaacatttaaatgtatcatttaatttaattttcatagatctcctacaagacaagtgctattattttcattttacatacgagaaaactaaagctgacagagattaaataacttgtccaaggttgcatagtaactaagtgaaagagccaagatatgaactcagatctgtctgatttcaaaacccaggcccttaaacactaggccagtggttttttaaccctgattgcacattagaagcacctggcaagcttttaaaacctactgatactcagaccctaccccagaacaattaaatcagaatttcttgtacctgggccctgatgtgggtgtttgtttcaaagcctttctgggtgactgtaacatatagcttgggtaaagaagaattgttgggtgtctcccatggaggtcagtatatctgtgccaatatgtgaggtagtacaagactcaagtgtcctcagtctgtctgcagtggtttttcccttgccccatcatgttcactttgacatcttttttttattatgatttttggagaagtaatatacaagtgacaatttttttacaaagcattgtcacagcagaacatggtcataagtccatcaaagagaaacctgttcatatctatgtacaggctatgatgaatgaatacaaagaagactatgtttattactctcatccccaaagggaagtataaagctggccttaaaagctgttcataccaaagctaatcactaaaatttggaatggcttcctcctctcctttcacaaatgcaatagggtagccactggatctaaggggaaaagatccaattaccactctttacaatgctttttcacttaggatctcaagacgactgacagtcattcaaaacataaaagtaaagtgaaaatatctctagtagaagtgaaaagaaaatgtctgtagtaggaagaaggcctaaatttgtgtctatactctgccactttactgcaatgacttgaggccaaaagtaaagtgacagagtatagacacaaatttactgccatgacttgagccttgatttccttttctatatgtacttaagccatatcatccttagggcagtgatccaaaaaatgtggtccccatcagcatcatgtggaaacatatcagaagtgaaattatcagtccctaccctagactctgaatcagaaacttggtgaaggggcagtaatctgtgtcttaccaaacattgcaaataattctgaccacctccagctgactctgatgtatccacctccatggggttgttgtctaagaataaaaggagatggtccataaaattgttattttttttactatctactgaaatcagaaatttcaaaattctctcacagagatattttagagaaataatgttacagcctacattagttagataataacctcatttctgaatttcactttgaatgtgtagacgaggcacaagtcaaccagaggttatgcaattagcttggagtcaaagagaaagcaaggagtagagctgagaaggaaaccccagtgtgaacttgatttttattcaatcaaactgttaaggtaccaaccacgcactttcatctataatcacaatgaaccttttaataaacatgtttctatcctcttagcttaaaaaatataacagtagctttttggattttaaaacagattgacttctatacttctgggctaaaggcagctcaagagtcaataagaatcacaagctttccacagtgagaagaaagtgcaattgcccagtcctctctatctatgaagtgcagacagtattcctcttcctcacctcacactttcgattattgcaatggtggaaaccatgataaataaaagcgcttatctagtggtttggttttcactaaaattacagacttctgtaacattatttggataccataaaacacaaaccaaattttaggagatgctttagggtgttttttcccctgccctcctgtcggaagccctctatctttttactgtaatttatctgatatagctaccaagatgcttgatacttttacatgcaagggtgctgaaaaacaaagagcgagggaatgggttgttaatgaaattctctgattgtaaaaagcactctggaatgatcaggtggtaaataataataagaggaaataacataaagtgcttaggtgctacagcgatagtcaccatataaatgcagaagagatcagacatgaatagaatttgcattttatgcagctgctgtgtgtgtatatagaatatacagtagctaatttttcaataatgctggtaaaatattgttcaaaatctattcttgctgtcttctcactttaaaaggcattatatagaaaaacacccatctgtcctagtgcaatggtgaatgtgtgcaaagagcctagaaaaagagcctctttgcatacgtgaaaaaaaagaactcaaataaaaggagataatgaagaagagacaatagtaacactattagaacagctatgcagacaagcacaaaggtgatctttgaaaaacatcagggataaataactctgttaatgtgtggcagagaaactacagttaagacatacagtaatataccaaaaatatagacatgcttttattttgtctactgggctattgtgatagtgatggttgtttttgaatagaaaggaagaagagagtgggaagtaggatttcgttgtttgttgttactgttgctgctcagtttagaacaacaacatcaactacacaccagacccgtccaacagttccacaaacaatgcttaccatgaatctgccctcaattttcttgttgttattttcccttaatacttattgataacccaatgcccattcattagatatgctaaatcctcgtccatggttactctcctttggaagagactgagaagatgctaagagggagttcctcttacacataagggaagagtctgtttaggaatctgagaaagcagaggccaggataaagagaccactagtcaatcaatactaagcaccgaagactgaatcacccaaagatacaattatctcccttcctttgttctgtctcttagtcaaataaaggattgtttgtagaaccttttctgttcctgatctctaaaaagcaggactggacttgcacatccaactataattcaaaatatctcacacttccaacttgaaagaagacataaactgtttcaaagaaactcagagagagcaaatgcatattcacaaaacttacacttattcctagaataggaaaatggagagagaactaaccacataagaaagggctaatcataataataatagtaataatgatgatatcaatcaatactttggattctagagaatgatttatcacaaaaattcacctgtattaagggagactccaggacaaggaggtcattaagctacatttccatcttcaggattcagccaaactcagactctccggaaagctgtaaatgctctcagaacagactttagtaatgagattggaatgaacactgggcctatggcgtaaaagcatctccctgccccttgttctaaaagttaactattaaaccatgtgcggttcatcctgatttggtttactcaattctagaaacaaggacatgctgatcagattgccctgggcaattgaatacctactgaagcctttgggaagacagtgttcttcccaccacccctacttaaaaggcttctgttaccagactatcaattctgtgttactggtgaaggatagaaagtatcttcttttgaaggacaagtttttcactcactgagttttctgctttgggtatatactcaacatgttaagtgcttaatcttttttcccccattcccctttttctactgtagtgtgttttgtttgtttgttttttgtttttgtttttttttaattatttgaagagtcacttgtctggatgcttcgttctagtagaatttggctgatttttttcccaacaccttttagtggaatgcagtaacagatgcatggagggagaattggtcttaacagtatttttaggtttcatctgtgtcagagagagatctcttccctttattgatttcttgcatacactatccacactacagcttgaaacagctacaacagtgtttgaaaaattggttgttcctcactgttcaaaccatttttcaaaacagtcgttacaagcttcattttactttctgttataaggagggttttgtttgggttggtttcattttccttgtggcgtcatgctagcagagaaacacagtcaggaatatagcttttaaatgtggtatgattgggattataaccatatcagaatctatattgaaaatttattagattgagccatgtgcagttaaaaagaaagaagtcagaagtcttcgatatttttcacaaacatgaacaccatctcatgcaaacgttaaaattcaccaaacaaatgataccccactgttggaaagatattttctcatgtcaacaactcaggaaggagtggggagggaatgggacatatacatgtaaaatttttctctatatttttgataataactctctgtgaatatgttttactacctaggtaatgcttatatttgtaaaaacatatagttatatcagaaagtcaattttgaataaacctgagaatggcaaactataatttttaaaatactaaccttttagaactgttcattttcacttttatttccaggactcactatcttaaagagaagaataaaagttgaagatccttgggattaacagaaagggtggaaatagccaaatgtattcatatttttggccaggcgcagtggcttatgcctgtagtcccagcactttgagaggctgaggcaggcagatcacctaaggtcaggagctcgagaccagcctggccaacatggtgaaaccctctctctactaaaaatataaaaaattagccaggcatggtggtacacacctgtaatcccagttcgggaggctgaggcaggagaattgcttgaacccaggagatggaggttgcagtgagcaaagactgagccactacactccagcctgggtgacagagcaagattctgtctcaataaaataaaataaaatgacgttcatatttttaaaatacagcaatattcatttgtttaaaaaacaagattgaggccgggcgcggtggctcacgcctgtaatcccagcactttgggaggccgaggcgggcggatcacgaggtcaggagatcgagaccatcctggctaacacggtgaaaccccgtctctactaaaaatacaaaaaattagccgggcgaggtggcgggcgcctgtagtcccagctactcgggaggctgaggcaggagaatggcgtgaaccccagggggcggagcctgcagtgagccgagattgcgccactgcactccagcctgggcgacagcgagactccgtctcaaaaaaaaaaaaaaaaaaaaaaaaaaaaaaaaaaccaagattgagagcacagttatatagtgacttttgatacatacacaataaaacttattgaattttcaaaaagtgagaaaaaaactactctgctttaaatttaaagtaataaataataatgaagacatatcaacattggtaactgtcagagtgagaaaaggaaattgaacattcaatgtgaccagaggaagggtgaacatgggagatactgcccaggaaaagtgctcatgatgagtaattcaaagacccagaatcttaacataaattttttatagttttcttttcaagggactatttgaaaaaagatggttctggggtttttgttgtagcttctttctttctttctttctttctttctttctttctttctttctttctttctttcttctttctttctttcttttctctctctctctctctctctctctctttctttcttttggctttgttgtagcttcctctttctctctctctctttctctttctttctagctaaaatttcactctaaattccaggaaattttcacgagatccttttagaggttctgacacaaataaagtaaaagtaaacctgttgtggcaaagttactaactagtctacactaactctcagtccttgctcaaagcaaaataatggagtttggggtgcaatctggtgaactcaatggtccaactgcataaaggcaaagaggaaagccaggcttgggcacttctgtagaaaatgaagattactggtttgaaggccagtcttctcactgcttcactgtatgtggtgactattgttaaattagatatccctattctgatgaaaaggcaatgtgctatttttggggtatacatgtttcaagctgtaaactgcaaagtgctgtataaaagtaaagtggtgttaatgcctcataagataaacatatagattgatgatggaggcatttaaaatgctttaattgcccactttaataaagcactaaataattataataaaaacaattcttcagaaaacttggtgggaaaaaggcctacaggatatgtttgttaagaataattagattttagttttggaggaaaaggtaggacaagtcacaggaggcactcgatgagaagtcaggaatgcctagtacataagccacacatattaagttgtagtttcttcaaaactgacaataacatgtcctccaaaaccaaagggaaaatcaaaggatgttgcctatacttatgtaccttttgctactggagatctagtcaatctatagccttggattcatagttctataacatgacaacatagcaaaatctcaccaacactttgttttaaagaaattggcagctgggtgcggtggctcaagcctgtaatccatgaactttgggaggccaaggtgggcggatcacaaggtcaggaatttgagaccagcctggccaacatagtgaaaccccgtcgctactaaaaatacaaaaaagtagctgggtgtggcggtggatacctgtaatcctggctacttgggaggcagaggcaagagaatcacttgaacccaggaggcggagcttgcagtgagccgagatcgcaccattgcactccaacccaggcaacagtccgtgactccatcaaagaaagaaagaaagaaaaggaaggaaggaaggaaggaaggaaggaaggaaggaaggaaggaaggaaggaataaattggctatgcctccaagtgaattatactataaacttctttcccattaccaataatgtaaatatataaccaggcacaagcatgtggaaatggagaaaggatgaacgttagtcttagaaactttggtttgtatcccatttccaccttttaacaagtcatttagcctctctaggtcaagattttcttacctattaaatgaagataatggtacccatctcacaaaattgttttaagaattaaatgtaaaatgcttggcacagagaggtcactcaatacatggcagccaaatcaccacatgcagtaaaacccagataaaatatattcagccaggactgttgctctgtgagtaggtctggtatccatgctacaaaatctattaagcctaaataatttggtcattttagcaatactctttagagattttttaatgacatttcccaaaggtcaagctagcttatggttatgtggaactgctgcatttataagagagtttagtgggttcataaaataagtcttgctccccaaatccggatcataaagaccttctatcataaaggataagagtgacatttaaaaaaccagtttttaaaaaatgatggtagcaaataaatgcagatgatcaggatgacagcaagtaccaagtcaaagcaacacggagaagaaataggccctagcctgcaggttacactttaaacactgaggagaaatgggagagtaaagagcaacactgagcctcatcggactgtaggtgaaaaaagattcaaaatctgactctaaagcaataggtaaagaaatattttaaaatgcttatctgtaggaagaaaagcagtaaagcagaattcctaggaattgagaaacacttaggaagaaaatgcttaagtagtacgatccaaggtgaggctagctgcagaaaatacaaatatttatgggttaaatcaggactgaggaaaatataaagccaaatatgggcagctctgagggggaaaaaataggcagcttggtactcaactgtcatcacaattcatttgtgtttcacgtcccactgtttgtgacattaacagaattttgaatttagcaatggactatttttgtattgtgaatctctgcagccattttccatatgtagctaccactgtaactagcaataacagccttttgagctttaaaatgcttccaattaataagattcaaaataggggtcacctaagagttttccaagttaattccctttgtctactctttgaagcagagtggtattcctgctattcatttgcattgaggccaaattatttgaccatttcagtaagatatccttaggtagcttttgcttttattgtcattttccaaaggattaagttagttttagatttttgaactgcattttcatttaactaaaataactaaagcaatctttttatgagggtatttaaatagatcaaatttataccaagttcctactgtgtgtcaaacattagcaaagcaatttaaaatgttattatttatatatcaatacatacaaatcatatgtgttatatattaatgagcttatagccattatacacaggacttttatgtgttattattgttgtggttatttctgttgttcgcaggtatcagttatcaagtacctattatgttccaagaactctaccaaggactatacacactcaccatgtaatgaagatattattggtttattttccatttgaagatttagtcacaaaaagtaacttgtccatgagcatataatttgtgcattctcttaaaatcacttaaacttccacgtaacacctggattgacgtatgctttttcttacaaaatatacttcaattcaataaagattctttagtcacctactatgtggcacctgctaggatagttatctttgtttgctattatgctaaatcacagatctgaccattagaatctcttccttcctgaaaataccctctttaggtaaaactgtatttcttatcattttccatcactgattgaataaagaaaggtggcactatctggaaaacataagagcgttggatttacaagtttcttttaataaaacaaaccaagttaatcacaaattgttgcaacaaaatatgtgacatgaagggcatttaaggcacatttagacattatttctatctagaaacagaaatttagtccacataatgtcatttatctactgagctaaatcgtattacaattttcatctataaaatccagattcttaatgtgtgttggaaagataatatctctgacccgctctcagtaagaaatgtgttttgaattgttttgttagtaataataatggagttgtactggacaaaatatattttcagcaagtttctctggtaataaaaataactataatagtagtaataatactagtaatcaccaataaataatagatagcatttattgaactctactatgtgccaggtactgtgattagcactttacatgtattatcttattaatttctcaaaatattacatgaggtaagtaccgtaaatccaatttaacagaaaagcacattgagatatagaaatccaataatttggtaaagatcacacagatagaaaagaggtacaagtcaggattggaacccaaggaatctgactctcgtatctatctactctaggtgggggatatagcaggtgctatggtgtttgttcaagagaatactccatttgtgttgttttatctaccttattagggttggggcccatttggtctgtaagccaaatctgaagacagctgaaatgagttaaggtttgaattagtgctattcacactatctgccaattaaaatgctcccttctgagaagctgtagccagttggcataaccttaggacataatacatgctcaaaaaagtatctgatgaatgttaacaatggtttctctaagtggtgattttactttctttaaaaaatactttttcctattgtctgaaatattttcaacatgggcacattacttaggtgatcaaggggaaattcaggactttacttaaaaaatgtttttgttttgttttacaattaggttgttagtctcagttaaaacataactcctgctgggaagcctttcctgttgctgtactctctgaccttttgaaggacagtactccttactctgtctgcctcagaaccttatgaaggccacatactattgttaattatcagtcttctctgctttatgtgaagtcccttgaagattgaccccattacttatctacctcttagagctctaagcatcttgagtgcctaccactcagttcaatgaaaaaacccagaacacacatacaccagaacaagcacaaaagatgaaaaagaattattttagggttgacaatgcacactcttggtatttgcagatgacttgtttctccccttacattatgtgcaggtccccatggaaagaagtttcccacaagaagtgtcttgaatttactggtctcttctctggaggattttacaaatgcatcaaggaatacacacacacacacatacatacacattatgaaataatatgaggataattagaagtaatggggaacacaggaggcaatttctaaaaaatgaagcatattttttatatatataatgtatatatgtatacctgtatataatgtatatatgtatacctgtatatataatgtatatatgtatacctgtatatataatgtatatatgtatacctgtatatataatgtatatatgtatacattatatataatgtatatataatgtatatacacatacatgtatgtatatatatacacacacgtatatatatatatatatatacacacacacttttttttttgagacagagtttcgctttgttccccaggctggagtgcaatggagcgatctcagctcactgcaacctccgcctcccgagttcaagcgattctcctgcttcagccacccaagtagctttgattacaggcatgtgctaccacgcccagctaattttgcatttttaatagagacggggttttgccatgatggccaggctggtctcaaactcctgacctcaggtgatctgcccgccttggccttccaaagtgctgagattacaggcgtgagctaccacacccagccacatttatattttatattaagtaattttgttcctttcctaccccattataatataaacttcatgaaagtagaaactttattttattcactacagtatccctagtccataaaagaaggcatggcattacatcctcaataaatatatgtcgaaaagaaggaaaaaggtatagatgtttccactgtatttcttatatttttctggaaacaaaggggaaaggtgttcccaaaaggtttccaggaaaacttcaatcaccaatgaaactgcaagctcttgtcatgttcctcagaccactacctaattaattcctttatgtgcaatacatcctttctagcctgttgatactcaatttctggcgctgctgtaacttgtggagcaaagagtgccacgtgagaggtgcttgggccccttcatactgtgcctcacctgcgaactggggaggccactgccatttaggctccagcatcttttacaggccagctgagccaccagaagggaaggggagaaagagacatgcaagttctcagaatgtctggtatattcactcacacacatttctcttctcttctcaaaaaggatcctggcaacaaatcactgattaatgatgagagaaatggaatcaggaggaccccatgataccctctcatcctagttttgggagataaaatctcccactgtggggaggaggaagaccctacagggttttcttatgttttgcagcttccaaattgtagtagggtcctattctataaaattgctaccaacaactgtatacttagtgatataataccatatggaaccttgagttttacttaaagagtagattatgtggcaattcatagttatcctagtatggataagaaaatatcctagtaataacataattattctagttatgagtttttttcagacaagaaactcttttattcatctttttatctctagtgcccagactcaacatatgactttgtatatagtagttcttaataaatgatagcttaaaaattaaataatatttttaaaatggtgagatatggcttaaaggggttcaaacaaattcagagttttgtctaatctaggtgtttctagatttatgagcaggcaatcacatattattgagtatgtattagtgttttagttagtgttaatacagtataataaaccctcattgattgttgtagagaaatcctactattttacactcatatactagaaatgtttaaagtcacaattttaaaatagtggacttcaaactttattatgcacaactaacctgggcagtttcctaaactgcagatccaggctacattctcagagcttctgatttagaaattctggaatggggttcaggaatctccattttaacaggtgctctagataatcctgatataggtaatccctaggtaatcctgatacagttggtccttggactacttaccatggactaggctacaaggtaatataataataaatctatacagttcaccttttcaatacgaagagaagagactagcctattaaatgtgacttaactatcaaaattacccgtgaaaagaataggcaatttgctaagacttctcaaaatgaaccaagggaggacataagggcgagaaatattaaatttcaagccagaaatgactctttttaaaacttcaaagagactgacaatctgcttaaagtaaaagtggaagaagaatggcagcagtacagaagtgttttatgaacaatttaggaaagcaacattgattcaagaggtttatttgataacatgttttaatggttattataaaagtgaatgccttctaatctttgatttgctgctaaaatatatatgtatttatttacatgaaattttttttttaaattccccccttaactccctactttccacacatttttagcttgccaacattactgcgttaatggtgtcctttttttctctctctagaaacacatgccctgggattaaaaggggattactttggtctacttccacatccatgtcccagggaaggtactgcttctgcttccgacctgacctttaggtatctgcagccttcaattctttacagtgggagttgctttagcattgatttcttggaaaactaagagctgttttcaaaagccattttcaagacaaataatgaaaattattttcttatgcttatggatgttacaaactgtgtaacaagcttttctctttaactttgctgcaagaaagtttaaaggcaactgtatagcacttcactgaatatagttttatgctgacctcacttctaactccatttttatatcctttcctttattgttttatttttcttacctatttctaattcatgtattttgctgcaatcatgtatttatgtttattttttcattgtcagccattttaattcccttattggtgcaataaatagtaaataagacaaataaacaaaacaaaaacatatgtatgtatgtgtatttggtatttacatcgcatgtactcaaaataaaaaataaaaactaaccacctaaaataattgacatatttcattattctttgggctatagattcacttgactgcagcacttccatttagggagatataaaattaaaataccaccatgaaaaaatccatatgaaatttgacataggtattttcagccccaggtcattaattcagttctgactgacatctttcagttctgttttaaaatttttgtgttcagtctttcgattacacacacaaaaaagttttggcttaatcagcctaataaagtgtatatttctgaaaacatttttatgtaaacaaatatagaagtatacatgatacatacacatacattttttacttagagtcttcaaaccaaatatttcagtcctttgcttccagtattattttcttttaagtaaatacttttcattaagcaacaaagagtgatagtcatctcaacaccaaaaacttgtattcaggctaagtttagtctactttgcatattttcctctgagaatgatccagccagtctcagtctgattctagtaaaactcaggtaatgtggaagaactctaattgagtattagacattttaacaattatattcatattgatatgtccttatacgaccactctaggtgaaatattactatgcttgggacttaaatatgatttttgttcttttattaatttctgaatctcatatccttccagataccaaaggaatacagtaccacctgggaataatgtcaattttcactttaaaaaaatattttgttgcttttcccctcagcatgggcaaccaatagctgattcatactttcattacatcacagttggattacagaagggctctttagtctggcctccgcatgtctcttgcaactcatttgtagacagcccagaaactagcagctggacttcatttttgttccagcagtcaccattttatagtgtttctctaagtcactgtgagtttcactgatgacaagtctaaaactccacaggtattcatatttagtgggttaaatcagagagaaaggattatgcttaactttctataggttcatgtcactcaactatactttgccattcacttaccatacgtcaaaaaggtggaataatactattcttacatagaggactaataagatatacttagcaaaagtaggtggttgcaaaacatttttttaaaaatcagagtgctgtatttttaaaatcttgcatagaactctggttcaatttttgagtccttccaatttctcataactctgtggtattcataataaagcaggcagatggttaagtctctgaacatatgctttaaatgccccctttgctatttctaaataatggaccaaattttgccctcaaatagtcacaggaaactttaaggaggctgcctcttgaaatctgaggacagaatgtgatccagtgggaattaaacctttaaaaaatatattttctaaactttcttatgagctctattccctataccaagacaaattacattttttaataaaataggatatagtaagagaaaaatcctaaccaatacaatattacttggctcaaggaatagattagaaggcaacatatgttttatttatttatattttaaaattctgattttctaaaacatgagagtcatctgattaatttctgtgtgattaccagattttccatttttattattattcctattactagtatcatgtagatgttatattgttaaaacatcttgcaattattaattagttaatttagtttaaattatgattatgcctttgttttaaatcaatgtttttcatagttattaaaagccaaaagcactatttttccagtcacttactttcatttcaaaaacagtttgttgtcgatgaaagcgcattttccaggttatcacagaatatgcaattcatctgcaatggatatatatattctggtaatgttgctcacataacctagctgtacttgtaagagtatctctgtttcttaatgtctatattttatacatggaattaaccttcatttgcacactcatatttctatgtatttaaatttattcctgaaagacctctgaactagtctctcctgtcttacgatgtccacaaaacttagcagtctgattaacattacagataaaaagaccacacaattgacaataaggacactttagttattatagacgtctgaagtttaagtattccaaaactataatgtccctttagaaattctcaataaggattagcttggtcctaatgaaaacagtgtttacttttaaaaataaatgcaatagttgtacccaaatatgttcgaaacactgtatgacgtgtcataatcaacaatgttgaaaataactaaagatctttaaatcaagtgataattttacacatatatccacaaatatctgaacaaaatttataattactattgggacaaaacattaacatattcttctgctaataaagacaaacaactttgagaaaatcctctctcattctcacgtctctaactttcacaataaatgcagcactgaaactaaatttccaactcagaaatacgctgagctccaataaacaagttgattttaaaaactcaccagactaacagttatgctttttcccttatctttcctttgctttcccttgttctttcactttccatgcacacacaatcacacttacctgcacaagtctgaaacatcagtctatgtattttttttgaaatgtactctgtaccgatgcatttttctgtgtttctttctaaccctcgagaatgttaagaatttaggaagagagccacagcttaagagtgcaattatttgccagtaaatactcaatttgcttgtcctgtgatttttcttctaacttgcatattcaataatccgtccctgactgcgtcacgagcacaaaaagtcttttctccaaaggagaagactttcgccaatcaaccttcagccatgccagggcacagcttgtcagggtgatttgttagctttaattaataattcctcacactggccattttcacaaataatgcagtgaggctgggaggctagattgctatgattcagacagataaaactacagtggaaaggggatggggaggggtgtgggggaattcagatgccgtttataaacacctctaatcatactctttcagtttacaatatagaggacatctcagttgaattaccacgttatgtccaccaatttgtattcagatggaaaccatatgttcctccactttatctgctagggactccctggtgccaacacagtcattgggcagacaacattcacaaaagaggtctctagcctctggattgcaaaagtttactgcagggtgaagttgagaaatcagacatatactgcacttctcagtgagcttgggtaacagtctggaaacacagaagtatgagttatgagtgtcagattttctcttatcctgctatgtgatactgggcatttcatttagccttaaaaaaaaaatctcatacctcatcctcaaatcagtttgcaacaatgactgatttgttcatgcattctatgaacatttattgactcccaaatatatgctacacactgtattaaatgctgagaattttgcttgaaagtaagacttttccatttaactgacaatccatgggcttgaacaaagccaccaaacagatagtgtgcaaataaaaataaggatttctaacagtttctgtgtggctcaaccaaataatcagtaattgacaacacacttgagtccattatgcaaaagtaatgctcggggtaaaaaagaatatacagagattaaaaaatatgtttttcaaagattaaaaaatttccctcaaagtgactagagcactaagaaacatattaatatgttcataaacaatttccaaagattcacaatcactttaggaacatacaaataaaaaaattttattaatgtccttaatcttatataagaatatatgcctgtgtttgagactgcaaatttattaatttattggatacatatttattgagcatctactctatttcaggaactgaataatattggagataagtaaagcacagcctcgttattcaagaagctcacaatttagtcaccagactctaaaagagaaaacacacatctcaactgaaaactgtaatacaatatagccagagcaatgacacaaatatacataaacatgtaggatgggcctcctagaagtgatgcatcaactatttgtaaaggttgggtagaagtaccagtggtgagaagaacattctagggagaggcaaacctttgaaccctttctcaaactgttactagaagcagagcaccagttctagaaaagatgggatttaatacatgacaatttcagataaatgtttcagatggtaaatattgcaggatttaaaaataaacttattaagaaacaaatgttccccaaaactataatgtcttgatatcatcaaaaaagcatgcagcatctctagcactggcacatagtaacatacatgtctttctcactttgtgtgtttcagttctctgaggcaaacatgaaacatgcttgacacacactgcctttctgtgttttcttgcctatttatcttcttttactatgggcaggcttctactgcttctgttttcactgtaccataagataaatcatatttgcatgactgttaaaggaaggggaaaaatctgtgtccattttgtggtcacacatctacttctagtcagatagcacatgctatatgggactaagagtgcaaatgttaaatgagaaaggaaataatactcctaaacccccaaaaagctctttcatagatagtaaatactcctagaaactatacagaattcttggtgttatttaacattttgctttatattatatttaacagtgtaaggcaacagccagaatactatttaccatagttcagtaacatctagccatttaaagaatttacaaagtttattaattcattaaatatgtatgtattgagctcctactatatactgagcacttatcagtaaatgtttgatttttattcccacaatgcttacacataataatagttaacattcattgagtgctgactatatgctagggactaatctaaggactttacatatagtatctcatttaattcccacagtaacattatatgttaggtactattaccacctccatttagtatattatgaaactcacaagtagagaagctagatatacactatgtgaattcattctacacaatgagaccagggcaactaatgtccaccaaaaatcagatttattactttatagttacacagtcacaagtaatgtttatgttgtgaaaattaaagaaaataagtccgggcacggtggctcaagactgtattcccagcactttgggaggctgagctgggtggatcacctgaagtcaggagttcgagaccagcctggccaacatggtgaaatcctgtctctaataaaaatacaaaaactagatggggtggtggcagaaagctgtaatcccatctacttggggggctgaggtaggagaatcgcctgaacctgggagatggaggttccagtgagccgagatcatgccactgcactctggcctgggtgacagagccagactccatctcaaaaaaaaagaaaaaaaaaaaagaaagaaaatgatatgcttaatgtgcatagcacaaaatctagcccagaataggtgtaaaatatatggcatttgaagtattcagagttaaagattaccacatacaactaagacttactgtttctggaccaaatgaccatatattattgaagcctatcttagacaataaatgtaaataaatcttagctaaagcaaattagccttggtagtctgggagggttttcctttgaagatgttaataatatagttgaactggttgtgtttaagaaagcagagctgacagacaaaatagagatagatgacacaggaactcaccagttaataatagaaaaaattcttgtttttccaagtgattaatacaatattacattgtatttaatgtagatgaaaaagcttatttggtactcactggggaagccaccactcagtataatcatatgctcttttcaaataatcccatgctgctaactttacagctaactgccagcatttgccaactccgggcactctgatgccctctccacattctttcttctctcttgacattgactaagtccagccacccataattcttgacctaaactatggcacaaatatccatgaaacagaacatttatttttggtgataaagctggttctagatgaaatggtggtatttctttatggaggagctgcaaggaggctctcttcatttgcttgtgtgtgtaagtaaagtttctgatttgggataaaggactgcctggaccctcaattattggtgtttattctatggatattggctgagatattttgtatgggaaaaccagcagatgagttaatgagcatccgtctgagccatactaacctagtggcacctcctgggaagccagggcgttctagaatctgtttatttctcaaatgaaaatcctaattcatagaagttaaaagtatagaagacaacttcacgtactctttcttcatgatacctggattggttacaacttagtaaaattttagcctgtttggtccctccttccttactggctgtctgagtctctagccttatataggaaaaccttgtcttctaattgaaaatgatgacaaacagaagttatgacagacacatttcaaagtagatgctatttttcccaaataaatttcacatacattctaattcctaaacttatatattttcacatactttatataaatacctgacaccttaaaatgttttacttagtgagacctagataatgaaggaataaaaaggtgacttaatcccagtttttctaaacaagaagtttagaactcacgtattttaaacttgttaagtgatgatcaatataatgggctgtatatttggttgagagttaaaaatctaaagttttctcagagtactttaaggcattgctttctcagtggaaatcttcgaccttcacattctcaaaaggagaaaaatgtttcttgtcagaaaactagtcatggctagtccataagaagaagtccaagattgtatcagcttccctgtgaccttgctatgagatttgctacaagtaatttaatgcttttctatgtctcagtttactttttatctatgatacctcaatgatattattaagataatgtggatcaagtgttttgatcattgcatagaacatatgcatagaacatagaatatagaaatccccaaatataagaatgaaaacttaaattgttagaatgacactaactctgctacaaccttaaatagcatatatagtacctcagtgtctccatttttttcagctataaaatgagaatagtcatctttatgtttttcattaaacagtatattggaataaatagagattattacaaaatctgttgaaagatttcaacaaaatgtcatacatgcaagtgaggtgatgaatatattaattggcttgattaaatatttctaaaatgcatacacagatcaaaatatcacattgtaccccataaaaatacataattatttttcaattaaaaataaataaataaaattaaaatgtaatcaaacctctgaagctgattttcaaatatattagaggaattgattttaaaatatcaaagcgtaagaagtaaatgttttcaagcatattcagacacttatgaaggaagactattaaaagacagggagcaggactgccttttctttgtgtggctggctgcattttatgatggattcaaaaccccagtaatgagaaaatataatcagaaaaagtgatttttagcaggctgttgaatgacacataaaataaaatgtattcattaatgagtcagcaaaaatgttatgcatgagctttcagagccagaatttttaagcagctttttcatacttggtacagccatgttcctgaagtatcctctcacaacccccttctacctctctctctctctctttttttttttttttgtcctgtactgccaggttggaataatgaccaaagggaggggcaaaacaaacagatatgctcactgtggcagaagtcactccaaagatcaaagactcgattcagccgtggctgccaaaatcagaaccacagtgggtgctcatcagcacggtgccctcagaaccacatgggctacccttgataggttagcagcttggggtgcaggccccgcatcctgcttagaaccacctgctgagaactggatgtgcacattaccttacccactcacaacatttgatttcaactcaattctgctctagtattatgtttattgaatgacggaagtctaacagacactgtaaaaatccaatttcacatcttatagtacccaaaagggaactgtgattttcctatatcagtgagcaaaatcttgagcaattagtaaacaagatcaccaatttctagtatttctatgagatatatttctttagttttctgtaaggagaaaataatatattggtaccttagtatccagcaatcttatattcatttatagggttatctcaagttaacatagtcaaaaacccagaagagggaaaatagagcccttgggaaatgaaaagaaatgccataaggtacacgctgttgcccaaatacatcattacttaccaaggagactttaatttggaaccaatttattcttctttaatacacagtaacaccagtaatctggaccctccattcatattacatgggaagaaaacactttcggaagaaagtacaatgatatctgtaagaaatgatggctctatctcagaatgaagaggagacagaggaggtgagggagaaataaaagtatgcaaagctaagaactatgtacagcttgcaaacatctctattattgagtcctgcagaaatcattgtggtaaagctctgcacaaaaaatagtgttcataattattatgggtttaattgtgccctcccaaaattcatatgttaaatttctaaccccaagtatctcagaaaatgaccatatttggaaatagggtccctaattaagatgcagtcgtaatggagtaaggtggttctctactcaagtatgacttatgcctgtagagaaaggggaaatttggacatgggcacacatacactgggagaatgctatattaaagatgaaggcagaaatcagggagatgccttacaggtcaaggaattccaacgattgccataaactccagaaactaagcaagaggcatgaaacagattccctcccacaaccctcataaggaaccatcccttctaatagcttgatctcagacttcttgcttccagaactgtgatccaataaatctctgttgtttaaacaacccaatttatgatattctattatggcagccctaggaaactaatacaataatgattatcaggaaatcatcatgtaaagactaaatcaagttcagaatatattgtttaagaaggttgaaaaatataagattcattgcagaaaacgaatcaatatgcttttgcagaaataaagcattcagtgtttgagtggcacaaatatcgaaacaataaatgatttctttacatggaacatatggttttcaatttttcctaatccaatgagatgttgccatctttactaaaaagacaaactgaaatatactctacagaacacgtcaaagaaagagtccccaacctccaagaagcattttgactaagaaggaagataaatatcaacttatttttatttgtttgtttaaaatacacagcctaatatggatgaaacggttacaaagagaagttctgggtaaagaagaggttgtctacttagaagaaaactactaataaatggggtttgaatctacataaaaattaaaaggcattcatccagatgagaagttaaagagaattctaagtatgaagaatggagaaacatgagaggactgaacaaagcaagagtaagagaaggtaggggcagaaacaacagcagagggaatatgagaaggctagctggtattgagagtgttatcaatctgaaatgggcacagaaacggataaaaaagcctgtagacaggtaagaaagacaagaaacagtaacattcccatatttaaacaagaagttgaaaacatctagtgcaagaattaagctctaatctttaaaacaggtgctcttaaatgcttttgcatgaataagagactgtaccttgatttttcttcaaaaggattcaatagtgggatggaaatgtgtgtgtgtgtgtgtgtgtgtgtgtgtgtgtgtgtgtgtataagctaagctgttactgcaggtaggtcaatgaagaaatacttcatggaacaggaagttatagcgttatacaatgtgttccctggagaagtttaaaaaaacacacacaaaatagccctatgaagtttgtttgctctgttaaatagctttaaaattctacccctactaattgttcttaacattttatttcagccaattatcaatttaatctgggagaagaaagatctacttgactttctgacagccaagtcaatccaactagaaaattcaaaccctacaagaaaactgctttgcaacatttttaactgacaacagaaatccatgataacataatcacctttttctttctttcccaaactcattctctctaaagaaaataaacaatggtacaaagatacttggatgaaatgaaaaagtgaagagagctattccctctttatggtaataggatgttcttgttcaagatggttaaaaatgtaacctgagttctttttcaattctctatagaagttggagatggtcttgtctacatatctaaagtaactgaattatatcagcaaatataagaattacagcttaatttcacccattttctatcttaaataattcataaattaattagtctctttattttattcattggaaaaatgttggcttagatgatgatattcaagtagggacccaaaatgttaaaaacgaagataaggaataggttttgcatagatactaccttttttcccactgatttctatggattttctattacagaaataacttctgcagagcactagtacttctgcagaacagagtaggatattctcaaaactgggatggtgataaaatgaataaaatcagcatcaagtgatgagaagcagatgagtaaaggaatatgccacagcactaaaataaaatgggcccttaattaaaagtccttgattaaattttaccttatgaagagaaatattgaaaagaaaaaggaagaaggagagatgaagggaggaaagatggaaggacagaagaaaggaagtgagggagaaaggaaggaagggaggaaggaaacagaaagggaggagggagggagaaaggagaaaaaagtgagttaaaaagcaagaaagaaggaaagaaaaaaaaggtaaagccattatagaggtattttctcatcctttccccactggctggccctctaatcttccttctctgcttcccaccccaatccaaatgtctgggacacaagtaggatagttgggaaaaaggggaaaaaaggaaaatttctttctccagctgatgctcactttggtaccaatagctctaactcaacagttccaagtgtttttaatctcatgtggtcctttgagaataaatgaaacttatcaaccttctctccaaggaaggggtggggagaaagaaaaagcatatttacaaatacatataaagtatacatttagataaaatataaagtatatttgcatacattttcaaagggcttatataaactctgaaattcatccctgcaccatctaattatccattagcttaatatgaaaaaccattggctctagaatctggaccaagccataataaatggttggggatagggatttggagaaatggaaatgagatacaaaacaaaccgagcaaaaacacacacacattaaaaataaaaaggtgttccttctctccaagtcaacccttaaggatctggctcttcattgttcctggaatttagatcaataaaaaatatgacttgaccaataactatttaattaataaaaatagataaaattatatagcaatatatataatattgtagcaattcttcatgttttaatcattaattctacattactccctgttaactgtctttgatagtgcactaatatataatactgccctgattttgaacattagtctaatacttacaataacattgaaaaccaacaccatttaatattgtgattagcaactcatcagacatataggaaattacaaggagactctgcaacagatacaacaaagcaaataaacaataataaactaatttcaatgttttaatggctatatgtaagaggaaacagaccttgccttaactgtactaatgggaattgtttatatttgtttaaaacataataatgtttcgcatagtaattcataatcttcaaatgccttaaagtatatttagctcatctgatgtgactatcaactctggaaagtaaataggagagatatcattatccttttttcataagcgagggaagagaggctacaaacgattaaatgacttcattaatatcacaaatctaacatgtggtagagcaaaggctagaactcacaggttctgatacccagtaattttgctaccatgctacacagtactcaaaaagtattcattacacatagcttgcttaggcacatgtgttgtcttactttggaaatgaggacaatagaatacaccctcaaatgagttgatacccatagcacttattctttcacgataaaattttattttggcacacagtaaaacagaaagtatattagctatttaacaggtgcaaatagatatttttgaacgtgtactgcatatcttatggatgatgtttgcatgtagtacgtgtccatgtgtggggactagtgtacgtttaatcattttgttagaaaaataataccgttgagttaagcctgtgttttattgttaatcatgcatttagtaacagcacaagttgacaaatcacttataattgctacatattatagcagcacaattcacaattgcaaaatcatggagccaacccaaatgcccatcaatcaatgagtggataaagaaactgtggtgtgcatatatatattatatacacacactatcatacatatatactatatacatactattccatcatatatatatgcatatatctgatgcatatgtatctatttgcacctggtaaatagataatatactttcaaatatatctatttgcacctgttaaatagctaatatactttgttttactgtgtgccaaaatgcatatatatatatatatatatatatatatatatatatatatatataatggaatactatgcagccataaaaaggaatgaattaacagcatttgcagtgacctggatgagattggagactattattctaagtgaagtaactccagaatggaaaaccaaaaattgtatgttctcctgatatgtgggagctaagctatgagggtgcaaaggcataggaatgatgcaatgggctaggcatggtggctcagacctgtaatcccagaactttgggaggacgaggtgggtggatcacttgaggtcaggagtttgagaccagcctggcccacatggtgaaaccctgtctctaataaaaatacaaaaattagctgggcatggtggtgtgcacccgtaatcctaggtgctccagaggctgaggcaggagaatcactttaacctggaaggcagaggctgcagtgagctgagatcatgacactgcactccagcctgggcaacagagcaagactccatctcaaaaaaacaagaatgatgcaatggactttggggtcttggaggaaagagtgggaaaggggcgagggatagaagactgcaaatatggtgcagtgtatgctgcttgggtgatgggtacaccaaaactcacaaatcgccactaaagaacttactcgtatagatcacctgaggtcaggagttcaagaccagcctggccaacatggtgaaaccctgtctgtagtaaaaatacaaaaaattagctgggtttggtggtgggtgcctgtaatcccacctactcaggaggctgaggcaggaaaatcacttgaacccaggaggcagtagctgcagtgagctcagtgagctgagattatgccattgcactccagcctgggcaacaagagcaaaactccatcttaaaaaaaaaaaaaggaacttattcatgtaaccaaataccacctgtaccccaataacttatggaaaaaaaaaagaatccacttcatgtagtaatatatgataagcacttagtaaatgccaattgttatgttcttgcctgggcaacttttggttgtcaactgagtagaaaaaagcgccatcttttagaaatctgtaattccttcttatctgtatgttaccttcattttcataaaaggtaagcagtaaagtgtattgtatcatacagtgatgaattttggaaattatgcataacattttaattatagcttgaatatcctttatctacaatatctgggagcagaagtatttaggagtttaggcttttttcggattttggaatatttgcattatatacttaccagttgagtacccctaatccaagagtctgaaatctgaaatactacaatgagcatttcctttgctcatcatgtccatgttcaaaacatttcagattttggagcatttcagatttcagattttcggattagggatgctcagcctgtattttaaatatgaaagacatgcacttgttaaggacttttgcagagattttactttgcaattatgagtcagcccatatatgacttctgttacgcaattgcatatttctcagaactctattttttttcatttgtattacttaaatgtttacttaactgggaaatagaagatttgttttttgttaaagtgcaaataaatgacaaaacaaacctaaataaaaaattagttgatttaaatactcaaaaaacccaaaatgcttcatgaataacatagtagaacatactttgagaaaaaaatataaacatacatatatctgacttcaactatcttgttagttgatttgtgattacttaattagatttattaaataactaaaaactgacttacaaatttataagcatatattcaggtttctgttgtaattaaagtaaaaaaaatagttaaaaatttacaatcttattgtccttatctttcctgtttttacttgggaaattatccttcttacttaaaaattttacttcctgtttttatctctgaaatatatagtctaatatgaaaatacacaagatggcagattgcaggggtgagctcatttcttccttaaggaaatgatataatagaaattataatctagtggatttacctgtactatatttctctcttaatattcaaagcaacccttccatcccaaataccagagccaaccttgaacagaattccaaagtgtggatgaaatttacctccagttcctcttccttatcccctctttgtccacgtttccttttgaccttttggcccttcctttgaccttatctaaagatgtatttctggtgttagaaagtgttagaactttcctcttcattttcagcttaaactgaagtctttatttaacttggattcctaactattgcatccttagcccatattaccaacctatgaattgaaatgttgccatctatctgaccaacctaataatgtcttgcatcctgctctcaataggtcacactctcttagataccagtgaaagacttgagatttttctgtttcctgcatttatctcagccttccatgtgaatcacctgtattaaaattttagtaatccccactttcggaggctgaggcaggcagattgcctgaggtcaggagttcgtgaccagcctggccaacatggtgaaaccccgtctctactaaaaatacaaaaaagtaaccgggcatggtggcacacacctgtagtcccagctacctgggaggctgaggcaggagaatcgcttgaacctgggagatggaggtgcagtgagccgagattaggccactgcaccccagcctgggtaacagagtgagactccgtctcaaaaaaataaaataaaataaaaaataaattagtaatctcatttctgattcacttgatctgggcttacttccttttcccagctgggctctctctatggttctagtatgctttgtagtgattaaaaggattaggataaataaaaccactgccataaaccaaaaaatttctggtctacctcaagccctaatggtcaacttggttttccctcgcccctagttattctgtttatcaaacagaaaataaatactctttaccaagtttcataacatatatattaaaaaaatctactaatagcatttagaaggtgagaattcatactgaatcttctacttctagatcaaaagcactagaatactcagagtactctagaaatgtatgatggaggtaggtgactcattcttttagaattcatctgtgggaggcaaaataattgcaccccaaaatgcccactgcctaaagcccagaacctgtggtacatggcaaaatgttatgttacatgaaaaagcgactctgtaaatgtaatgaaggttgttaacactaaaacagggagagtatcctagattatccaagctggcccagtctaatcatcttaaaagcagagaacttttttggctggaatttggaaaagaggtgtggtagaaggggaaatttgaaagatgtcaagtgtaataatgattcaaggtgctgctgctggctctgacatatagggacagcacacatgcaaggatctaaagatggttcccagctgatagcaaggaaatggagatcttagtcccacaaccatgaggaactgaataagcatgaaagtggattttttttcagagtttcctccagttaagaatccagccgacaccttgattttggccttgtaaagcctacagcagagaaactggtagagccaatctaaacttctgatctgcagaactgtcaaataataaatttgtattgtcataagctgctaagtttgtggttggtacaacagcaacagaaaacaaatatattatccaacatactatcccagtccaaaggccaacagacacattagtttaaaatcatagagtaaagaattgggacaggaaccactactatgaaaaaagaaagttcttaacactataaatacattttccccgatattccttcttttagtcatatcctcagagaaagtaaaatacctcgagactaaaggaaaaagaacacagggagtgtatatctactcaagtgcaaattgtcctcaccaaggaacttcacaaatgtgctcttcctcacaggcaagaatactatactaacagtgcaacattactcaaaccaactaaatccactctcttcaacaggaaaaatctgaaaagagcttgaaagtttataaaggcatgaagataatgaacatttaagaaacaatgaaaaaaagagaaagaaagtccaggcaaatgtacccaaaattcacagatcacatgcctactggggtatgttttgcctactatacaagttgtcttataatcatacctttaaaggaaattatcttcaaaaactatgattatttatttttatatgtcatcaccaaagctagtttttaaaatttatcttccaaaatgaattttctttcttactcatattttttacacagctagcttctggtcttaactgaacaaaggaatattggaagaaaggcagttatttccaatgattttcggcattgaagatttagaaaagttaacctttgaaaatttactcaacttcagaacctaaaactttttgaggtataactaccaacaacatgctgaaaacaaatacttttgcaatcgactagaaataattttcacagtaaaaggtaaattctcagcacgctgcacatattctactttataattatatcacagtatgaaataatatgaaagaaaataaggggaacaaaccaatataatgatttaaaattcttatagaaacaggataaatgaagttaattttatttttctgttgagatagaaaatatactgagctaaaaattactaataccacactttgaatcttcccttttgtcttccatggaggccacacatggaaggatagctccaatgacctgggtaagggcaatgcaggatagaaatggccacgtgagaaaatgtacacacattcctttcttttgaataccacattctgcttcctagaggtccctgtaaacttattaaaaacttcagtcattttgtaaggagataccataatttcaaggggctttgaggctcatttatagcaaattaatccccattttatgtctgtccccatttaatatttctaaagggggtggataacaaatctcgccaactctctttttaagggctattcagatactaaataaaccaggaacatttaaaaatacaatctcacaaaaatctgctttgcttaaccttctctccttctttaaaaaataagaaaggcatgatgttctttttttgttaattaattcattttagacaattccttaaattttcattttaataaatttttgtgtgggtgcattaattactctcaaagatgctttacaactgttacctattaaaagcctttgttagtgaataaaaaaaaagaaaagaaaagaaaaaacttccagcatgctcccttccttctctattctgagcaggtccttgctatcaactgctggagtatgcttgctttgcacctagagctataattattttgctttaattttacaaaaccttttgttccattcccacgagcccacctgatccttatattacactcgctctattaaaacactcatgcagaacaaagcatggctgtactgattcataagtaactttttttttttcctcagtaaaatgccactggctaggcttcgggacacagtcctgggcttcaccatcctatgccaattttcatatgttagaacaaaaaaaatatgttgtatcagagtgttgtactcttccccaagatccttcctttgccccacttgttttttgtgtttttaaacatattttatcttatacttaactttactctggggcaatatacatgacagaatgttgaggatggtggatatattaaaagattgtaatcatgttgatatttcttttattcatgtggttaaaattcttaaaaatgacttctgttgccttatttaattttttttttctttctccttactccacctcttttccttgagatcttgcaatacatgtgggcttttggcaaaaaaaaaaaaaaattgcagtgactcatcaagaaaactgtttgtttgctctgaggagcaccctgaggaccctctgggctgcacacggagccctttgatcctaggaaatttatttcttccagatgttttcccgacagccacctttctgcaatgtccctcttcattatgtagcataagaatactcaagacccactgctatggtacagttttcctgaatggagtgtgacagggagttgacatttgattgagctgttggattcttcttgccttaggcacaatgatggaggaaggttaacactgaggaaaggcagaactgggtctgttcaggtacagtgtctttaggattaggatggaaattatgtgaaccaggccaaagaaattatgtaaaatctacaaatctgcagaccattgatcatggacctagttttcttcaaccctgtaaaatcttgatgcctggatctgccatgttgttactcctccaattttttttctttttttttttttttttactaacatacaaagtgcggacaggaaagttaagcctttggacaactcttgttttttcttggcctggctgacagtgctagcggaaaggagaagggagaacaagggaagaatgcagagcaggtacaaaggtaaacatggtgtggtgggctgaataatgacatctcaaaatgtgtccacgttctaactcttggagtctgaatattaatttaaatgaaaaaaaaaaaagactttgcaggtataattaaattaagaattttgacatatggagcttatcctggattatctagatgggccctaactacaattctatgtatccttgtaacaggaagattccacatggacagaagaggccaacttaatgtgaccagagaagctgagattgcagtgatgtggccacaagccaaaaaacggtagtggtcagcagaagctgaggaaggcaaagaaaaggattctcccctagagcatccagaaggaatgcagccctgctgacatcttgcttctcgcccaatgataccgattttggacttttggcttccagaactgtgagagaatagatttctgatggtttaagtcaccaggcttgtggtagtttgttatagcagccacaggaaactaatacaaatggtaaccatttcaaaactccattgttcagagcatttgtgaaatcactgaagtctcaggttgaaggcacagtggaaaacaggatgccaaggcttgaagacaaaattctctgtggagatactggagatattaagggcacttataatctacagcaagtagggaactaaaacagggcaaagagagtgcacaagggcattcaacagaagattaaacagattatgaatgtaaatgttctaattttctaatgctggtttgcattttttatgaagtaggacaaatctatagtattttccatttaagttaatgcttacacacataatgtattaccagccattttccccctaaatcaattatcagtatcattaactttagtgacatttgatttggcaaatataaactatatttggcacatatatactgtattataaaaataaagatcctctatctgcacttgaggtaactttcctttagctattcaaagaaaaatctatttttaaggtttaacccaaagataatatggaacctaaacccaagaattcttaaatagatatattaaaacaataacttggctgggcatggtggctcacacctgtaatcccagcactttgggaggccgagggaggtcaggacttcaagaccagcctgactaacatggagaaatgctgtctctactaaaaatacaaaattagccgggcatggtggtgcatgcctgtaatcccagctactcgggaggctgaggcaggagaatctcttgaacccaagaggcagaggttgcagtgagccaagatcacaccattgcatgcagccaaaaaacacatgaaaaaatgctcatcatcatgggccatcagagaaatgcaaatcaaaaccacagtgagataccatctcacaccagttagaatggcgatcattaaaaagtcaggaaacaacagatgctggagaggatgtggataaataggaacacttttacactgttggtgggactgtaaactagttcaaccattgtggaagtcggtgtggcgattccgcaggggtctagaactagaaataccatttgactcaaccatcccattactgggtatatacccaaaggattataaatcatgctgctataaagacacatgcacatgtatgtttattgcggcactattcacaatagcaaagacttggaaccaacccaaacgtccaacaatgatagattggattaagaaaatgtggcacatatacaccatggaatactatgcagccataaaaaatgatgagttcatgtcctttgtagggacatggatgaagctggaaaccatcattctcagcaaactatcgcaaagacaaaaaaccaaacactgcatgttctcactcataggtgggaattgaacaatgagaacacatggacacaggaaggggaacatcacacactggggactgttgtggggtggggggaagggggagggatagcattaggagatatacctaatgctaaatgacgagttaatgggtgcagcacaccaacatggcacatgtgtacatatgtaacaaacctgcacgttgtgcacatgtaccctaaaacttaaagtatgttaataataataataataataataataataataataatacacattcaaaaaaaaaagatcacaccgttgcactccagcctcggcaacaagagcaaaactccatctcaaaacaaaacagcaacaacaacaaaaaacccaataacttaaaattggaaaagtccaatagcaaaattattgtgaccaaaccacccagtttatccctttctctagttcatcgttaaaaacacttggtagcagcattattaataaagaactaaaaatacacctgaactctatgattcttcttagctatatggcttttcaacaaccaaaccattaatcttcgtaatcaccatgaagctaatagatgtagactacagatacagataaagaaataagattatggaaagcttaaagagattctagatcaatcagcaaatgagaagaactgagaaaatcaagtagaaatgctggctgcgttctctagtacctttgaaaagctactagagatagaatccttcttttggagaaaatagtccaatgacagaacatgtaaaagatggacagagtcatttattttttgctactttcatattaacacagagtattcatttggcagtagttttcaaaacaagaagaacagtctatttttaaataaaattaaaaaaagtaactgatgattaacataactactgtaccaaaagaaagataacataagtcattcaaagtaccaggaggctaaagaaattctaatagttatccctatacaccttcatttcaataaacatgaaaaatgggaatctcaatgtgttgtcttttcaatttcctaataataccagggggactcaaggcagttcaaatctcaggacttcagaggccactgagttccactatctggggtgctgagcagtcgatatgaattccaacttcatactctccttgtctccttgttctatttgctttaacactatgtacacctaacttatctttagaaggacaggatgcatatcctttctataaaaaaactatgcagattttcatagtgccatataattacaggtactctttatttgtttatgaacccttccaacaacccaataggcaattgttaacattcccatttatcactatctcacctatttctgagttcctagagggttgagaacattcttttcctgttactatcttctcttagttctatcacccctggtaagaagttaagtagtaactagttgacatagaactcacggcaccgaagaatgggtggccaggatcagtgcagattggttcatttgggtttgtaacctttgtgataaattattgagtgctatagagataaaatataaaataatttttaaaaatcctactacaaaactaccttaacccttttagcacagattatgatcctgaaagctaataatctgtactgtgctataacaaatataagaggatgcctttagtatgataaagtttgctgtgatggagaaatggttgagataaatgggactttaaaatcaagagtcaagaacatttggaaagatatgagatacacttaggaatcttacaaatgaacaaggacttgtctctagtttcttagtcataatgtttctaagacacaaattaatcaaaatcccaggttatcagttacttaatataaattttccaataaacaccccttgattacacacttaggtcttcaaagtgggtagatttatacaattcccctctacacaggcaaattacatacacaaaaattatgaagttatttttttctttgaagtagtttagtgaatttttaaaaatctgtaatgaataaaaccagactttaaatcctgaataaaaccagactttaaatcctgaataaaaatgttctgtatcaatgattgtcatgatatgtgtcttggtaatagattattgcataatttttttcttaataaaatggtatctccatcaaacatgtagatcatggagtcttcccatagggacttttaagatcatgtaatccaatccttcattttacagatgaagaaacaatatgtgagtgttttaataaagcctactttaagtttttcattaagacaaaaatggttgttatatgaagagaaaaggagaaaaagaattaatagtagaaagttggaagtgaagagtgaggaaaaacagaaaggctttttcattggtgcagagcactaagcagagatgcattctctaatatatatccatgtcattgctagagactagcttaaatagtacaaagttggtaacatccttctcttttcttttttttgagacggagtctcgttctgttgccaggctggagtgcagtggtgcgatctcggctcactgcaacctccacctcccgggttcaagcgattctcctgcctcagcctcctgagtagctggaacaacagacatgcaccaccatgcccagctaatttttgtatttttagtatagatggggtttcaccatgttggccaggatggtctcgatctcttgatctcatgatcagcccaccttggcctcccaaagtgctgggattacaagcgtgagccaccacgcctggcccgtagtatccatttttaaaataatcacttagattataaacacgtaaacaatttagacaggtttacctctagggaatcatatgacttaccataaataagcaaacatattctgtattaccaacatgctaactgttcattcatttacactgtatattacctctcacttccccagaatatgcaagttgaaggaaacataacaaccattgtaaaactctatcttaaaataaatattattctataaagaaaaaacaaacatttttaagagtcatataaaggcaaattttaatttgaagacttgatactaaggaataaatatatatacctaatatgtattcacaaaagttaaaaactaatttttttaatgtaggctgtggaatcagactccctgggactgaattttgattttgccccatccttgaccttgggcaaattttttctctctgtgcctcagtttcctcaccagtaaaattaggataacaacagtgactatttacaagagttgttgtgaggatggaatgccataaatttacatataaatcttttagaacagggactggcacatagtaattaataaatgttagctgttacttctaatatgtacaagcctgttaaacattttgcaggggggagataaggtgtttctcattaatgggacttgttaaggcattttgtctttcaaatggctgcctaacttaattcataccaatattttatttcagtaggattaatgaaatagtatgaggaaaagccttagtgtggtttctttagacatgtttgagacagatattctcatccttttaaggggagtaatctaaaatgctacacccatttgtggcttaaagtaactgagaagtgactctcacaagatgacatgatttagctgtgtccccatccagatctcatcttgaattgtagctcccataattcccacatattgtgggaggaacccagtgggagataactgaatcatgggggcggtttcccccatactgttctcgtggtagtgaataagtctcatgagatctggtgattttataaggggtttcccctttcgcttggctctttccttctctcttccctgctgccatgtaagatgtgactttcaccttccgccatgattgtgaggtctacccagccacgtgaaactgtgagtccattaaacctttttttctttataaattacccagtcttgcatgtctttattgtgagaacagactaatacacaaggcaaaggagaaaatgggggagcagaagaggcttagcaggatgcatacatcttctgatatggagaacatgaaagcactcactgaggaaagtggaggtgctggctcttcagcaagcaaatgctccacctatatgctcccacagtatcttatacatgtctcaaagcctttaacctgctgctttgtaatgatttgtttacatatacttttttttgttattatatggtcttctacttgaagacaaaaactgtcccattcacttttgctcagtagttgctcagtggcatatttctggattgaatgacttagttaattaataacagttactacaatgggggaggctattgattttaaagcgagagctaagactcacaggttctatccaatggaggggcgtgttgaagtagaagtagctagctattatggtactgacaatggatctctgatctctgtgctggggataaatgctctaagtgagcatgaaatatttttgaagtttatacatgtgtaagttttttttccccttaaccataataactttcttttttaaaaatgcatgaatatttgagtaactaagtgcaatgttaatgttgggtgcaaatataatctgcctaataaaccatggaaaaagcctgaaaataaattcaataaatagagtcctagataatgtgttgtgggagatgagagaataagcaattaattatagatggtggaattaaggtaattttagtagagaaggtaatatttgagcaggatcttgatgcaaatactaaatctaaatctgtgaaaatagagcttatatccttaatgtagaaactggctgatatgcagagataagttgaaagtcctgtgaataggtgacataaacatcaaaggtattcctaattcccaatatacttgaaaaattggctattatttgatgcatatatccctgtatggcaatcagtccagtaaataaaataataataatgtcctttaaaaaattcatttattcatgaatattcattcatccattcactctttcaacctaatgtgataatctactgaatatcaaattccgaactgtgctgagtacattggaaaccacggtggtcaagacagaataaagtctctgcataagaagtaggttcagacaattaaattaataattataatgcaatacatattatgttaggtaaagtactacatgttatggaaatatgtaattataagcaatttatacttaaactcattacataaatatggcagaactatatttggataaagtgctggtggtttttattgaccttgaatttcttctgatttggtcttgtttacctacagagtagactgccacatctgggtcttacttatactgtttgctattcaaaatcttgcctcttgaactacctatttaattatggattcatgaagcacaaatcaatttattttcttaaattccttaagactaaacatggcagcatttttcctactccagtgtttctcttctgttaagatacatcttttggccaggcacggtggctcatgcctgtaatcccagcactttgggaggctgaggcgggtggatcacgaggtcacgagatcgagaccagcttgaccaacatggtgaaaccccgtatctactaaaaatagaaaaattagctgggctggtgacacgtgcctgtaatcccagctactcaggaggctgaggcagaagaattgcttgaatctgggaagcagaggttgcagtgagctgagatcgcgccactgcactccagcctggtgacggagcaagactctgcctcaaaaaaaaaaaaaaaaatacatcctcaggaagatgatggtgatgatgtatgaaactgaaaaaaatatgcttagttttgtgagattagatctacagggctgagaagagtaaaatcttgtttggactagtatattgaacaaaaaccacataggagtcacagtggaaacaattataggcaataccaattcttatcattttaatgaggagaagttaaagttggtcttttcgttgtggttcttaaatgcaaggtataacctatagtccataacaaatttttctttagaaattatcaagtacacagtgggttttctttagaaaccacaattctagattttttaaagcagaaaatatgctgtcctccttcattttaattcttttggaggaatagaactttttttttctttctatagttaactagagttgccacaggcaagaggactaacagagtaaaatactaactgatccaatatatactgcatttatctaactggatttcatctagctcaacatcatggctttgtagtctaagcagtagatgaacagaaacaataaactgggcaagtaatgttttgtgtgaataacagaaaagagtgaacagaaatataacacttcaccattgcacaaaatacaattaaatatgatttttaaaaacccagccactgatccactgcccaatcataaaagaattgtaatcagttcaagtagtcttaaatatagtgaaaatgtcctcaagatacacagcatgagagaacaaagagttttcactatcatctgctggactcagggaaggtgtgctatgtggttatcatttgagtgctctgtgtttaagttaatcaatattataaattatgcatgtattttagaagttcataatttctattaacttgtaaagttattgaaaagaaggatgaataaaccatactacaaaaataagaatgtgaataaatgccagtttttcctcagattacagatgatataacatcgctgctattttaagaaaatgagactggatcagatgtgaacatttatcccttctctttaggatagcctatgaattcaacacattgacactaattataacaatagctaacagttaactggagtactaaccatgtgcaaagcacactgtaattatttcacatatattatctcatttaatgctaacaacaatactatattataaacaaggaaactgaggcaaagggaagtcatttgctctagatcaccagggtagtaacgggtggatgtaggattcaaaccagacatactccagaatccatacaatatcagaatagtctgaccccaaaagacacacacacacaaaatggatctaaccaataccttgggaacatcatctaacttttctgggctttagatccttcagctgaaataggagttgacaaaccttttccaaaaaggataaaatcttaaatattttaggctttgtgggtcaagaggcaaaatcagagatgtcatgctatttaggtaattatataattggagagaaaacttgctgtatctcagccagttagatgaaaaacacataatacaacaggaaaggataatcttcaaactattaaattatattctctttgtacgtctaatgtggagacaaattatattaagaacacggtagctgaaataaaattatttcagattagcacatcaggtgttgaatgttatcagtggttatcttagggggtgacagaagaagattttagggacagagggaagttttttcacttccagttaaaatttattttttaagtggtggaattgattgttatttattattattatattttactttgtgttttggagtagttttcagtattttttcctggttttattgaggtaaaactgacaataattttacacatttaatatgtacaatgtgatggttatcaaatacacattaccacggtcaagattattaacatatccatcacctcatatagttaccattgtgcatgtgtgtgagtatgtgtgtgtgctgagaatacttcagatcttactctctgcgtaaatttaatggatgcaagtcagtattattaactatagtcactatgctgtatatttgatcaccataagttattcatcttataattgaaagtgtgtaccctttgacgaacttctcctgatatccctgtccccagctcctggcaatcaccattttattctttacacttttgaaatctactttttttttcttaatttaattttaagttctgggatacatgtacaggacgtgcaggtttgttacataggcaaacgtgtgccatggtagtgaacagccatgttttcaatacatcacaagccatagtagtgagaaacaccatttctttttttttcttttttaattattattatactttaagttctgggatacatgtgcagaactttcaggtttgttacataggtatacacgtgccatggtggtttgctgcacccatcaacctgtcatctacatcaggtatttctcctaatgctatcccttccccagacccccactccccaacaggccccagtgtgtgatgttccccttcctgtgtccatgtgttctcattgttcagcttccacttatgagtgagaacatgcggtgtttggtcttctgttcttgtgttagtttgctgagaatgatggttttcagcttctttttaaaaagattccacataaaagtgaaatcacacaaaaaaaggaatttcagaaaaactaaaaaattgaattaatatactgtcataggaaaaaacagaatttccaagaggagtgggggaaaataatagtatcagaaatataataataatagatctttttcctgtggaaaatagtacatagaaatagaaagtactgaaaaggagaatcagaaaagattatggctccagaatcacattatcttctacagtttgaagaaaaaaaaatgtggctaaaagaaaaaaagtatttccattacacaccttttataatgactagaataaaaaaatactaatatcaagtattgacaaggatattgacaaggatatggagctactgaaactcttatacattgccagtgggaatgcaaaactggaaattacccaaatgtctttcagtgaattaatggtaaatgatcttctgtatatccatacaaaggaacactacttagcaataaaaaagaaacaaatcgtgaaacatgcaatgatatgaaagaatattttattttatttttttaaagacagggtctcactctattgcccagactaaagtgcatgatcatggttcactgcagtctcaacctccctggctgaagtgatcctcctgcctcagcctcccaagtagctggaaccacaggtgcacatcaccatgcctagtcaattaaaaattttttttccttagagacagggtctccctgtgttgtccaggctggtttcgaattcctgggctcaagcattcctcctcccttggcctcccaaactgctggaactccaggcatgagctaaccatacccagccatgaatgagtcttaatgcatcaagctgagtgaaagaagccagtcttaaaaggttatatatatatatatatatatatatatatatatatatacacacacacacacacacacacacatatatatacatatatatacgtgtgtacacatatatacacgtatatacacatatatatacacatatatacatatatatccatttatatgacacgtatacatatatatccatttatatgacaactcttggaaagacaaaactataatgataaaaagatctgtggttgccatgagttagtggtgagaggatggataaaggaagaagttcttcagtgtgatggaactctttcatattctgatagtggtggtggtgcttgttacataaatctatatatatgttaaaattcatagaactgtataccaagaagtttattaatgtcagtaaaaatattcaacattttcagaggaaaaaagggagtaactgattacatattgaattattggaaaatacaggctcaaataaagccatggtttctcctactaataagataatttggtaagagataacactgttgatgaaaaagaaacctgcagttctacctccctgccattagttgaccaaaatgagaatgtctaacatagctacaaatttaaataattctctgcttgtttaaaacatagtctctaatagttcattacagtcattactgcctgttaatcaaggataacactagtatttgaattttgtaagtatgacagcaaggtaaagactgttacttaagccaataaattaccatatttcataaaaatctaatgattctgtgaacagactatgtagttcaatttttcttctaaaccctgtaactgcaatgtattttcactgatatttttaaagagttttcaaaggtacatttttttattgtggtaaaatatatattaaaaattgaccattttaaccatttttaagtgtacagttcagtggcattatgtatactcacactgttatgcaagtatcaaaaccacctccatctctagaacattttaacttttccatattcaaactgtgtaaccattacataataatcccatttccccttcctcctagcccctggtaacctctattctactttctgtctctaggaatttgactatactaggtacttactcggcacaatgcattaaagttttatccatgctatagcatatgtcagaattttatttctttttaaggaggaataatattccattctatgtatggaccacattttgttaatccatttgtccattcatggacatttggattgttttcaccttttggctatcaactgtgcattccttttgacattattgtcagccaccagttttttcctcactagtcagactcaagtcatattctgacactctttaggaatataggacatttcatttacaatagttaggtttaaacaggatgtattcatttgctctcacactactaataaagatgtacccaagactgggtaattatttaaaaaagaggtttaatggactcacagttccacatggctggtgaggcctcacaatcatggcagaaagtgaaggaggagcaaagacatgtcttatatggaggcaggcgagagagtgtgtgtgtaggggaactactctttataaaaccatcagatctcatgagacttattcactatcatgagaacagcacaggaaaaaccgcccctgtgattcaagtacctcccactgggtgcctcacacaacacacgaagattatgggagctacacttcaagatgagatttgggtagggacagagccaaaccatatcaggggacctttcaagtttggtcacaaggtctaattaattattttcatgcataggatctaaagagcaattgtatatttatcaacttatgtgttcaaatttggtcattagcttaacatatgtgtttgtatgcatgtcacatgcatatctgtgtgatgatacatagagctgtattatgcataatgttaaagctttattattgtctggttagagaagcagtcactatccagaaaaatggtttccaatgtgaagaagcatgttaaatttgacttcactgaattgaaaattttaagatgaaacaggagttgggttcctataagcggttagcgtgcaactagactccatcttttaacaaccaaagcagaacatctgggtgggtccaatgcattaacattttaaaaaaactttataggttttaatatgcagctagaattaggaacctctgagacaaaatgatcctgagttgggggagctaagagtaaacaagtgaaggtaattttaaaagccggttagggcctggagcatactgagatgaagggaagagaaatttagaattataaatagcaaaagatccactcaagctagaaaagattaagtatccttttagagttaagagtagaagaggcatcagttacaaggataattaatatctagattataaggatctgctattataaaacttatactagaacaaaagtcatgaaaatggtctgcggaagtcatgaggtgagaagaagataaacaggtaaatatttaagcagattatagagttctggaaatgtcatcaagtctcttgattgtgtatatttttgttccatttaaacacttgtcctgaggtttataagtgaaacatgatgtaatttatcatctaagtaaacatttatcttatacaccaaagcacggtgaatacacacacacaaacacacacacactcatacacacagacattttcattaacaagaactagtaccaactacagctcaggaaatatttgttgattaaatgaatcagtctgcttacagtatgcattttcttttgtgctgcagaagttgcaatacaaatgaaactaaaacttctgtgtgctgattacttttctcagtctgcttatctgagaattaaagaatttttaaaacaattttatgtattaatttgcaaacttctttaataatagatgttcattgtaactggtgaaacaataaaagctatttaaagaaaaaattaataatctttcctgattcctttttttgttcccaactctgtgaaataaccaatgtgaagaatatggtatgaattattttctatagctttcttcatgttcatataaacatacgcaacatatttattcataaatactcattaccctgaaaattatggtcattcttccaggttaacagctatagatataattcattcttttcctaatggctgcattatcttcaataacatggatgaatcatctgtccatatcatatgatatgcatgtagtccaattcaagaaatcagtatactttttttttttttttttacaaattttactaaaagtattactaaatttttacacaggatgctcaacaaacactgaagacctatctggtaccagctttggtgaccaagaaagaaaatcagtgaggtactcctggttttttgccctccagaaagtcactgactatcataggggagacataacagtaagttttttttttttttaatttgagagaaacttctcagagaatttatagtaacaaatgcttttaaagcaactatttaaaagaagtaatatatcactagcaattcattcttcattgtttccaatgcatgatcagtatttagtagcaacagaagacttccctatatgatgactcaaaaacaaatttccaaccactaagaactcagataaaggaccttactcttgagacctcaaagtgatttacatttccactagtacttctattgtaatatatgatatttataaactagccttattccatggaactctaaatatttaatgcttcacatatatcatttgacttttctgcatgtgtcattaagataggagaaagtgtcccctacagataaggaaaatgatgttaagacaaaactgacaacacctgaatcaagtctccagatagccccatactctttccttccaattatacttgctgccttgctagtggtaagcaatgataacgtagacagtattatgtcatcaattagagagtctcacttagcttgatataatcagtttttatttaaaaatgagagctttccatgcaaactgtttttctatcttctaaaaggcttgtgactaaaacttcactgacaagtttttcaggtgagatgagtgtaggttaactactgagcagccagagtctagtcaggcccctcacactttccagtgctacaagaagatgagcagatgtggggttagatgtggaacccaggttcatagctgtacctgccaaccctaacctagagaagggaagagaacactgatggtaaccatggcaacagtaacaatgctacacatctatcacttattgattatctaacaaagtcttaaaatatcaagtaatgtaagcaaagaacaattcagtgaaattttagcaaaggttaggcaaattttatatggtcaagatagtacatttgcaaacaagtagaagaccttgtcaaaaatctaaatcttctaatatccagtaactctcttgtctgagccaatttattttcctacatctttgaagacattttattaaaaaaggttataactgagaattcgacagtaatcagaagagtgatcttcattctgtattcagtgtctcttgaccccctgaaagaatctcagctcagcatggcttcctcccttttccagttgactcagagaacggtgctttcaaattgccttttgggatacatgaaggggtgcatttagagccaacctgaagtgtaacactctttattgttcctgagaaacgtgtgcccaattccctagaaatttactgtttcaaagagtcacaagctcctgattgcttctcatcagtcttgaagagattagataagcttcctccctcttacaaaagctttttcttcattcaaaattcctttgagaacaaaacattgaaccagaattggatttttaacaaaatattataagattgttgaaaacatttttttttctcctgaggagaccaaacaattcaaaagatatattaatgcacattctgatttagggctactagcaacatattgcaaagagtaaggtggtgccaaagaacaaagtcccttctgctaagcaggaaagatattttttaactgccttactttagaagatttcaatggactgctaagggctttcacacagataatctcagaagtcaaagctcaagaagtagggggaagaaacaactactggaggaccctaacaggtagcattgcttctaattaccgtaaaattgttatgtatactgatgccccacatcccattcccagactcagataattattctacagtaagagttggctttagaatacttgttcaagtgtgtcagtaatagaaaatgacctcttcagaaatgggggtgtttacatgcagtgctcctaaagttggcacacatggaaggtaattcagggttatgtttgcagtggcacccatcatcagcaatgtttcaacccccgtccatctctctgtcctggttttaccaagggattcacttcaaatgtattcctcactggtctttagaaaacagtgctagcaattcataagtatgtttgaattttcaaagtttttctttttctttttctttttttttttttttttgagatggagtcttgctttgttgcccaggctggagtgcaatggtgcgatctcagctcactgcaacctccgcctcctgggtttaagtgattctcctgcctcagcctcccaagtagctgggatttcaggaacctgccaccatccccagctaattttttttatattttttagtagagacagagtttcaccatgttggtcaggctggtctcgaattcctaacttcaagtgatccatacgcctcagcctcccaaagtgacgggattacaggcatgagccaccgtgcctggccccaaagttttgcattttgatagcagcaataaggctgagtaccttcataggcctttacctctgatcacactataaggctttaattaagttagtcttaagaagaaaaatgtacaccaaaccccaattattaaacattggaattattccttcttattggtctaataattacaattttttacttctcattcatttttcaaaggtttttttcagtagatctaggttattggaacgattatatgtgatatgatggggtattgggcacagacacagtaaatcaagatgatgcagaaatgaaagtctaatgctaaagatcttaccaatcttcccagatccccatttttcaaaggaggaaatgtatagaggacattacatttatttccagccattatgatataattataaagccaacctctcaacgcactctctctttttgggaagtctatgacagcaggtattacaattctactttgccagatgaggtgcgtaaaccatagaaaactaactagcatccaagagaagaacagacttggatgtgggtagaataataggaagaacacttacagtcagatatatcagagtatgaatgcaggctcaagcttttttccactaaaatgtatacagcaatgtaatctcactgagcctcagtttctgatactgtgaactaaagattatgacatcaatctacagtcaatgctgtgagaattaaatgtgaagagttttatggagagggcatctgctaaatgtaactatttttcttaccctcctaaattttttcagtcttttagacatttgggctattagagaactaatgacctctgtgaccacactagcttaggctataactaaatgcaacagatttaaaaacaccaagcaggagatagcacagagtttgaatcagtgaggtctaatagtaatacaaacctcacttactggctttgcaattttagatgctacttaatcgttctggggctcagttttttcattataaaatgggaatggttcctactttgctgggtagttgctgagtgtggtagcaaggattacagacaactctttatacagtatctggtatattaggtaaatggattgtaatatatattgttcagattttttattaattaaggtttgtacatagactcatctcctgcacttaatatttctttttctacacaagaccttgaaagggttatgataggggctttgatcacatattagctggtttggctgtggtaatttagctcctgagtattgggattacagtaccagcccctgccattgactatttaactatgacttggataggaattctaggcctgaattttgttcgtctccaaaatgaagaggttagaataaataattcctaagattccctgtcgctataacattttctggttccagggtctttttactgagctatagcagataaatcctcatatctttagagcttaagctacttctctatggtttaatttccacattccctctactctatttcttctttaattgcaaaaggggataatttccatcactttgcaaacaaaccaatatctctattctggcttagtggcataccatgttattaatgcatcatacttaaaaaaagcctggattgttcttcaatccagaaatccagtcatgttgtaggtagtaataatgagaataatgatgatttattttcaaggttttctatgcctccaggtgcccggtcattgcacatgataaaatacaccaaaattaaaaatgagattaaggtttaacagataaaaaatacattctaggaacaaaacacatttttggtatgcatctctacattacacaacagccacttaaaaataaacaaaaacaagaaatccgttaaccaacaacagaattttaataattattaactagaaagaaaataaaattaacttgaccttatcttagaaggttgtcagagatctactctgtttatgcaagtgagaaatatgttttgaattataagacctctatttcagaagtccaagctctcctcaaactcagaggtaaaccttcaggaaggatttaaaataaatgtatggattttgttagcatgtgtatattatttacctttgaattaattttgatcttgtcctattcttgagctatccttcaattggtatttttgtgtgtatctactatgtgctttcccactgcattcagaataaaattaaaattcctcactctggcatttctctgaccacacctccagccattctgctttgctcactttgctctggccactctgaagtccttttagttctttgaatacagaaagtctgattcaaagctttgcatttgaatacaggattttgtatatgcagtttctgtctggagctttctcccctcccatactccgttctctaccccaaattcttcacctggctgatattattttctgtccttcaatgttcaaatcaaaggacactctctctgagaattctgtcctgaacacccaaaggacagtataagagatttcccccactcaatgttgtcttgcatacataacactttatgtggaccacagcttgtaatgttgtaattatgtttgcacttattacatgtctaatttccttaggagactatcaatttcatgatgaaggtctaagggatcatttctatatttctactattaaatatagttgaataatgaatcaatgattctattgtggtagactcagtagggctaagaaatgttaattaaatatggactattcccttaaaattttgttttctagtaaaggaataaggcatacacataaagtgctataaaatatagaaagtaattcctgtctcaataaaagtgtagatgagtattgcattagtttcttagagctgttgtgacaagctaccacaagcttgttggcttataaataatacccaatatttattatctcacagttttggaggctacaagtccaaaatcaagttgtcagcagggtcactacaggtggtaagtaaatttgatagttaggggagagtggattgtttctgtccaggtcaaggaaagaaggattcatgaaattcataacattggaaatgaacttggtaggatgggttggatttgcatatgaaaaaattgaatgatggacattccagatgctggaacaatatgaataaaggtgagtaagagaactcggcctgagtttatagtacatacaacccggtaggtgacaattaactaagaaatgggatcagagttagattttaggatgtcatgtatattgattagggattgttatacacagaattattgaaagttttatctgaacaaaggcgacataatcttagtactcctatattaggaaagttaatggggcagcagtgtttaggataaactgatctccctgctccatctctttcaattaggagatttttgtaagcaagagaagataaaatcctgactggaacaggtatcaaagaaagagaataaatgagacttggccacttactggacatctaggatgtattaagaggaggaaagaatgatatattttgagtaaagatgtcctagagaattggagttagagaagctaggatagtcaaaagcaggatggtttttaagtagaagaataaattaagttttgatatgctgactcagagaaactagtgtgatttctagttgaagatttaaataaggatgttggaaatataggactaaagttctgaagacatatcaggactggagatataaatttctgagttatccatagtgaaataattgaagtcatgtaactctgagaagctgtgtcaagtcatgagaagagtatgaatgtggagtatgacagatgtgatcacatcctgtgtctactatttacctgttgtatatcctggggcaaattgcttaactccaccattttctcatatataaggaagaaaataattttatcccttaattaggattacatgagttaaatatttaaaagctctgtcatgtttaagctgcttttatattttggtgcataattctcataagaaatacacttattttgccatctagtatcttaaaaatatgtgatgtgctttaaaaaatatttattttcctgtgattctagtatatgtgatcttttaaactttcatgacctactaatgcgttgcaacccacactttggaaaactgatcctcccatacattatggttctcatccaattcctcctctagtcactgtccccaacaagcattctatgttgaaatcacaccaatactatcaatgttctcctgactttcatttattactccctcttcataggcttcttgctagtatcacattattccttcatggcctagaaaaaaatgataaccatttacttcctctgctattccatataatgttttgtctataagaaagatgcgattttcccagataaattatgaattccttaataacagaaaatatgtgttatttatctgtgtatcttggtaaaatattttgttataggaggcacagaacattaattcattattataaaggaaagggagaagaggtttgaagagagaactttgttgaacatctacatctaggaccctgctctggtatcaccatgtctcgattcctccttctctatatgccaaagcttccatggaatttttaaagggcagaactattgtctctttgtctttgaggcacaaagacttaaggccactaactttcagtacatggtggagagagggaagacctggatgggttaaaataaaggaagaaactagaaaatgtccagaatttagctttgggtaaaataacaggtttttaccgtagcctctttggattggtaaatgacagaatccaatgaaagcaatgtgaaacaaatgaccagagcaagtaattcattttaaaatattaaagcttatttctttttttttctgactctggaaaacttttctctgatggaaatgacccctggcaacagtgacattctgacaccatgcgtcgtacacacccttgggaagtttgaattccacaccactatggttctgttcagattactggtttcatcatgtctgtaagcccaattaaactactgaagttctaatggtcttatgtccactttgtaaatcatcataaagaatattaagtcaaccaaataaatttgcctctacaggactcgttgctcaaccaaaggcatgatactaggaacaaaattaaaaaacaaaaaaacaaaaaaaaacacacaaaaaaacctcttttgataacaaccaatgttttcaggatactcctttatatatgaatttgagattctgatgaaggggactacaattcaacaagtctcaaaaaatgagcccaaggcaatttgctcctcaggaaacattgcttagaccctgattgtagtggaaagattgaagcctcagattgtaaattcagatagactatcacgtctaggtctctaaggatgatctgcgatggtggtcaatatggtttgtgtaacctttgtgccctaccctgtgcctcaatttgcttatttaaaaatgaagtcactagactttgtttcttacatcctttcccactataatgtttggtgatgctctgcccttacatttgcctaaacttttcaatcttaaaatatataaaatgtttttataaaattcttttatgtccttaaatgttattgaacatgataacagtagaattcactaagcctaaatttcatcattttaatattgcctcagaggtcaagttttatgagagccttaatttgcatcaccagaagctcatttaataaaaatgaaagaatcccttttggaaataaattttaaaaactgatggtggggaagaggggcagataaatgtatgtaaaaaagaaaaaaaaacaacttagaaggtgtcaaatggttctgagttctaaagaatattgtggtcatattagtgttgaaaagttggtcctagctttttatgcactaaaagtacattctgctaatggttccttcccaaatccctggcctcttgacccaatacttattgtaccacttgtcccatttccctgaaacaaaatctataatatggcaagacgaactgaggtatcagagcatcatctaccctggaattgggcatatttatttgtggagttgattctagtgtgtgggatataaaacacacaacttaagtggaaaaatgctgaagaccatttcataggtgaaaaggatgtggtatgaatggtcaattctcactttggtcaggaaaaagaagtgtaaagtcaatgaggtaaggggctgggagatggatacctcgtatgatatgataagcagaaaggttgtgtttggcaaattcctttatcatcttcttcctgactgtcaaaaactgtattcaacctgtgtttacaataaatattctctgacagaatgaaccctggatttctgacttttaaaaagttttgaaattaaactaatagcagctatttcatgattacctattattgtgccaagggttagaaattacaaaaatgagtaagaaagagagagcccctgctcttagagaccttactgtctgtgggtttgaactgttgtagttatgacaacaataacaataactatcatttattcactcataccagccaggcaccatgctcagtgggcaacatacacaaagtgccaaagtctccttcatttcaccagatgcaatcacagtaaggtaaccttgctctgtccgtgcatcatcgcttaacaaaaatgaacttagcaggaattcagaccataggcagagacatataagcaactccagaactgtctactgtcaacacacaagaactacagtcaataaagagtgcaatgaactacagtgaaaatggaagcaattgtctgaatcacctttagtgtactctgttgactgggggctgtgacactctaaaaaccacgatacagtagactccacatctggcattccaacaatagaagggtaagtgttttaagactcttagcgaaagaacttgcaatacattaaactgtaaaactgaggaagacatcataagcttctggattttattaccaaaatgtacattttgatctaaaattaaaaataaaaacagattgactttccttgtagtatttcacaacctttgagtgcagcattaaaaatgcttttcttttttttcttcaccaactataagcttctgttttcttaccctgggcgtctgaatcttttatatgcttgggttctattcactgcctgttattcagacgttgaaatcccaaatgttaattgttcttccaagtacattgacaaaacagcagctaaataagggtagaccagactgtggtagactctgacatgcatttatggaacaatggggctctgagagacagccttgtagctcacgggaagacataagatgtgctattttgactgcttcgtagcagaatggggaacacacgcacacaagggaattatgcattttacttagttttgcccaaagtcctcaaggcaacagaatcttgtgatgtcatcatgaactttctttctctccatttccattgacacaaaggctaaaaatttctaatgacatcacaaaggaaaatgaaatctactttgattccaaaagaaatcttttaccttcagtgagactagtaaaaataaaataaaataaaataaaataaaataaaataaaataaaataaaaaagcaagaatctttccagacagggtgtgtgtcactgtgctcatgcacagtgggtgacaccctccctaatgaaattcaaaccagccaaaagaaaggattcacaatttaggttggataaaaaagacatactgaatattgagaccaacaactttttttttttaagaagaaaatcatttaaacatatatttcttcagggacattcaaatttttactcatgtctggttactatgttaccaatgtttttgtccttttttgggttggtcacagaaacacagaagaaggtacagaaagctttgacttacaggaatacagtgcagctcaatcttttgtttttaaggtgcagtgatttcagtctctaaatgtaacttcaggcagtctgaaaagaaacaggttaaaatctctttcagttataattggtatttcagatttaattaaaaattaaactttcataatgtttcaccatccaaagcaatgcattatcagtcaagcgtggcttttctttttttcttttttttttttttttctgttaaggaaaaaaaaaaaaaagaaaaaaccctcttcccagagtagttttttaatgaaaagaaaaggatctaaagaggagaaaaaaagcaattctgaaaaacaaaatacgcctccatgttaaggacttcataatgatatgactagaaactcaatgtttctgaattttagctatattctgattaaaaaaaaactcctaaacaatttctacagcctaaagattacagaaaatattaagttcagggaataaagaagaaaatctatgggtctgaatacacatattaaagggaaattatgacttcaaatggaattgtaagaaatgctagatctcctactttccagtgactgaattgctggtgaggtagatggtgaagaagggctaaataaacatatttaacaacacaaaatggccattgaaatgtactgtattatgggtttagcgtgccccatttcacatcatattgtacatcttgtcacatgcagccactgctgtttgaagcagcacaggaagaccaagagagtctgaacaacactccctggtttaagtaactgtaagcatgttgcttattttttaaatatgtacttataattccaaattaagtaacagtccaggcattaagagctccaagtatataataaatattaggcttaaaatattatactattttttgaatcatttctttcttcaaacaacaccatctataaataatagtattttttaaattaaaaaaatcacatcacacactagaattaaatcatccttacttttagctttgaaaaactgatacaatgggatttagaaaaatttagtttttaaaatataaaatgaggtaatataattcgctttcattcactttacagcgtggcagaatactttctatatatttataacactaaatgtcatatgtttacatccaatttcacattagtgcaaggtaatattttaatatttccccatatgagagcataatcacaaatcaccccttaaattgtactattattagaaagcatatgtagttcttacttgggattcctgttttctttttctcttgaaatgtatagaggaatattttgggtaattggtctatttgatgtacatagattttaagcgtaaacatgctcaggttcacagtaaattcactcatgaatgagattagatttaaaaaaaatcactgacattgactaactaaacttttccccctcctctcacatgcctgaattaggctaaaaatgaaccagcgtaaaggcagaaattatggaggcgtcaccagggacaactgaatgagaggaggggagtgcacattatttccttataaggcagcaaaatattcataaaagaaactgacaaaaataacttgtgctcagaaattatgagatataatataaatatattgaataacaataatctctgaaaaatgattcagaaatttaaaactgcccacctctggataaatctaattcaccaactggcattgttctactcaccaacaaaatatggttagcgaaacaaattcattctctagtttagacgtgaaaaggtgatagaaactaggctgaatatttacatataaacatataactaacaactagtaattcaattcattcagtcaggtttccttctcctcaatttgccagatgttgaatgaattgaactatcagctcaaaataattaaatcaattatatgaatagatggtcagtgtaccaattttcattccccccccatgccatttctccttctcctctttgatctttttcttctatttctgcttgtttcttctccactttcactttctttcttattcctttttccttcttttttttttttctcttggtgagggtaatgaggctcaaaaataacatcttgtatcctgttgagggaaacttggtcacaactatccttccagatgacaaactcattcttaaatgtctgtttcccaatccaaagaaaacagagcaattgaaaaaatagagactcaacatcacttacaactaccaacaccagccctcttaattcccatgctgtactactcatcacgaggagaactgaaatttatttacattatacctaacctcaaataggaccacaaataagactaataacaggaccattttgtggcactcaggcaaacggctgggcaaaacagatggatcttactttgcgccaggactcaaaaaatatagtcgccaactcactgttggcgactacatatcttggcccaaagatggacctggaagtaggaccagttgtctttgatatgaatagtgctcctcttcttatctcctcatggaacaaatcagtaactctgtcactatatagtggggttatcaggtagaattgcttaaaagactggtcatcaaggatgtaaaatattctgagggaatgtcaggtgagatgaaggaacagaaagtcaggacaaataccttatttttggcacttttgtctattttcaactttctgtttttttttttttttttaattcaaattcactactgtacactgaacccacctttaaaatagatttcagagtatgtgtcatcaataagaaaacttgtttctcacatttcaggttccaaaatctgttaaaattttaagtcacatagatcaatctcagtcattattaaaattgaccaccagtgtcagacttctttaattggaagaaaactatgtaaggctttatagattacagtcaacatccaatgatgcactgagcaacagctccgtaatcaatgcaatatacaaaatccggaagaatgcttctctggcagagaccctttagcaaaagagttgtacattctgcactccttaaagattctgaatggctttccagagaagtagcaaatgcattatattgcagtaacctatcttgtaagtcacaaggccacaaacaaagcctctagtcaataaaaaaacaaaacaaaacaaaacctgaaggggggtgagaactacagatcttaccattgactacgaacaaagggctgcttctgaccacattctactttctaaaatcctcacacagaaggagttttagatatcaccaggtcacagaacttcaaggaaagaacaacaaagcattccagcttaggaggtctatgttaattcaggcacttctcttattgctcttccaactattcagtactgactgtatcttgctcagattgcttttgagagttcactcatctctctataatttatttattcagacattgtgcagatttgatttttaagagacagccctgtttgtggtcagcatagaaggctaattataatactttaattatttattttagtatttttttctttccactatttaaaaactttttattataaaatatttcaaatatatgagagagggcagaatacagaaaaatgaactctccagtacccatcacccatagtcaattgtttttccaattatactttcacctactttttcttccaccagagcatctgaaagacaatcccagatagcttattattttatgcatgaatactttactatgtgttactgaaagatgacaatcataactaatatcattccacatcaaaaataatagtaattctttaatgtcattaaatatcctgtccatgttaaatgattgacttttaaatggtcttttctttttataactggttagtttgaatcaggatctaaataagatgtacacattatattcaaacgataattatcctttaatctataaattctccatttgctttttaaaattttaactttgtattttggaacaattttagaattatggaaaagttgcaatgatagtacagagagtacccatatttccttcactagtttttcctaatgttactatcttacataaccatggtaaatttgacaaaattaagaaattaatattgacacaatactattaactaaactacagactttattcagatgtcaccaatttttccattaatatgttttttctgttccaaaaatccaatccaggataccatactgcattttaattgccatgtctcctcagtctcttctgatctgtgataacttcttggtcattccatgtttttcatgactgataattgtgaagactagtggtcagatattttgtgaaaccttttacaactttgatttgtccaatcccgtaactagattcggattataggttttagagaagaatacaaaagaggtgatgtgcccttcttataacatcaaaggtatatgatatctcggggtatgttaaccttggtcgcttgcttaggagaatgtctgccaggtttctctatacttagttttaataaacataacagtttattgagatataacttatataacatacaatccactcttgttatgtgtataactcaatgacattaagtaaatttagagttgtataaccatcacctcaattcatttttagaatatttttgtcaccctacaaagatccttcatacccttagggagtcaatccctagacccagacaacaaatattttctctctctataaatttgccctttttggatatttttattaatgcaatcaaataatatgtgatctctttcatgtagctttttcacttatcataattcatttttaagattcttttatgttgtggcatgtagcagtagtctattcccttttactgatgaatactattccactgcatggatataacaccacattttatttatccatgcatcagccaatggacatctgaattgtttccagttttttactgttacgaataatgctgccatgaacattcacataaaatacgtctctgtgtggacatattttttttcctcttagatacctcaaagtggtattgctggatcataagggtaagtttattttaacttttaagaaacttccaaaccactttccaaagtgactatactcttacatctcccctggtaatataggaggcttctaatttgtctttatcttccaacacttgttactatctgtctttattacagccattctagcgggtgtgaagtagtcttttacggttttaatttacttttccctggaaataataatgttgaccatgttttcaagtgcttattaggcatgacttcatcttctttggtgaataacttcggtgaattgtcaaatattttgcccagtttttagctgggttgcttgtctttttattattgaagaattctttatatattatgcgtaaaaattcttatcagattatgatttgcaaatcgcaatcttgcaaatattttcgcctgtctttggtttgtcatttcatttctttaatgggtcttttgaagtgcaaaagttttaaattttgttgacatcctaattaccaaggattttattgaatcaagcttttggtgtgatagctaagaactttttctaacccaaagtcatgaagattttctcctgttttcttctagaaattttataattttagctctcacatttaggcccatgattaaatttttgtgcaggatatgaaataagaactaaaatatgttttttacagtcctaggttcgtgaatattcatttatatcgcatataatcctagcatcaattacagagcactgcttattgaaaagactatcccttcccatgacaaattgccttggcacctttgtcaaatttaattgatcaaaaatatgatgaattttctgaactttcaattccattccattgatctgtatgccaatatcatactctataaagtaagttttaaaaccagaaattgtacgttatctaattttgttttcctttttcaaaagtattttcactattttggatcttttgcatattcgtgtaaattttaggattagcttgtcaatttctgtaaaaacgcctttattctttttgacaggattgtgaattgaactgttttcttaatttcattgtttgttgctagtatacagaaatataattgatttctgtacaatatctcttcttatattcagttaacttgttgaattcctttattagttcgtgtgtgtggtgggggaggtgtatgtacattgcttagaattttctatgtacaagattatattgccggcaaataaatagttttactttttaatttccaatctgtatgccactgattgtttctttctgctggtctgtctaacccttctctttcccttcccctccccctcccctgcagctgctgctgcttcttttttttttcctctaatttgcttctctctctctttcttacatgtatttatcattctgcactggattgaatctcctgtacaatgttgaacagaagacataagaactgacaaccttgcctcttttccgatcctaggagtgtatcggtcaggttttcatcattacatacattataagttcttcatagatgccctttgtcaggttacagaagttctcttctattccttttgttgaaagattatatcacaaatggatactggattttctcaaatgtttctgtacatctattgaaatggtcatgtgttttctcttttattctattaatatgctatattgcattaattaattattggatgttaagtgaaactcacattcctgggataaatcctctgtggtcagcactgtataatgcttttctactttgccacatttggtttgtgaatattttgttgagttttggtgtctatattcatgagggaatctggtctgcagttttctttcattgtgatgtctttgtctggctttgctctcagtgtaatattgtacaaataattgaaagatgacctttcttgctctatttctagaaaagtttgtgaaatactggtattggatagaattcaccagtggagtcatctacatctaggattttctcctaactataaattgtataaattgtatgtctttttattacgagtctgttcatattttctatttcctcttgagtcagttttggtaatttgcgcatttctaagatagtccattttatccagctaattgctaacaattgtccagttgctaacaattgtctaattgttaagcaatgacaattgaggtcaaccaatgatcagtcacaggttgtatttctaactatcaagcaatgaaaaggattatgaggttataatatttgttcatagtatagtatgagatcaggaatgagagagaaggtatcaccaccaaccccatagaaatgagaatgattatgaggttatactatttgtttataatatagtattaactataactatacctcataatccttttcatttctgtggggttggtggtgataccttctctctgattcctcattttggtaatctgtcatcttctctcctttttccttgatcagtctagcaaaagaaaaactaagttttggttgatcttttcaaaaaactaagttttggtttcattaattttctctattattttcattatctatttcattgatttctgttcttatctttgttatatccttccttctgttcaaacagaatttagttttatgtttatatcatgtctatacttacctaaataatgacgtgatgaggtccttttgtttaggtgaattttagatacatttttatcatttcatttccacttaaaggatttccttcagtatttctggtaaggcaggtctactagcaacaaattgtctcagtctttgtttatttgggatatctttattttatatttatttttgaagaacaattttgctaaatataaaattcctaaatgacattttccctttttttccttcagcacactgaatacgtcatccctctacctcctggctttgtttctaatgagaagtaagctgttaatcgtagtgttgttttcctgtatgtaacagtcttttttttcttgttactgtcaaaattttctctttttcattcaaaagtttgactataatgtgtctatgtacagattttttttgtgtttatccaacatggagtttttgtgcttctcaaatgtgtagattaatgttattcatcacatttgggaagtttttggctattatttcttcaaatatttttgagccctttctttctttcctcctcttctctaccattacacatatgttagtatgcttgatggtctctcacaggtctccgaagctctgctcattttttcattgttcttttctcttcaaattagaccatttctattaattgatcttcaatctcattgtgtctttattctgccatcttaaatattctgttgagattctcttgcaattttttaatttccattataatattttttaactccagaatttttgttccttttaaaataacacttatgtttatattgatactctctatttaaagggtaattatagtaatactttaattatttaacatgatttcctattattttgaacatatttataatagtgctttcaactctttgtttgctaagtttaacatctgctatctccacttcaacccaaatataatttctttttttttcttcagacactttcttttaaccacttcttaaattgggtatgagtcacactcctgtttattacatgtctcatttttttcttgaaaattgacattttatatagcatattacagcaactctggcttctgacttttccctgttgagggttgttgctgttattgctgtgtttgtttatttaggacttgcctaacataactctgtgcagcctctcttccccatgctgtgccgctgctgatgtttctgctcagtttgtgtaatttccattttcgtttttgagctgggactttcccctgtgttaacacagtttagtggtcagccaacgatcagtcacaggttgtacttaaacacctagggccactatgctaacgcctctaattgatatatacgtgtgtgtgggttgtagaatgcactcaaagttcaggcagtttacaagtgtttttttgatttttactttccatttgttctctcttatcttctctctgtgtgtccaaagccttaggtcttccccagagtatgtgtgcagcctttcagacctctaggaatatgtggtagcttaccaaagttcactatgatagtatccttttccaattctccctgctaaatttctggccaatctgccagttcttttctactctgaattgtaacttcaggctacatatgatgtttattctccctgcttgtttgcccctgagattgtcactgttttgaccacacctaagggcatggggtttttctatgttctgctccatcaaattatcgaatcaccccctttcagcagtgaagttgtgggttttcatgacttgtcctgccctggcagaactactgatacaatggaactgtggggacggataataggaggaagcactcccggctaaaacactgtgggctcctaactgtgctagttgtcccaacataacttttaatttggccactttcactcccaaaagtatccagcttctgtgatatgatttatgaccttttaatctatagtgggcataaacgacttatgccatatgccatttcttcagcgaatgaccactgcctaattcttttcttagtaatgcaggaatcaggggcctagctgcaggtatccatgcatgtggggtggcgggggggaagtctaactgccattgaatgaacgttttcataatggttacatgtgtatagaaaatcttcaactgcccctcctactacatctctagaaagtttaaaggtttgggggggattaagaatttctagggaagtgtatgggatatagggataaggttaccaaaattctcccatgggagataaatagttttgcctcactctatagagtttggagaaaccactcagcgagaaggactagaattactttggttaataatgagttgctatgaactttggagctggactaacctattctaagcaattgtaaagaatatgtcatttagacttaatcttatacaaaacaataatagctcagagatctaagcaggtccaaatacttacttggatcaggttagtatttgccagcttattttctcacagattcctgggctcactcaggttatacttccttgggaacacacaaagggaataagctccttttggaactcaaataacttgtaaatcagaaagttcccatatggatatagagaataatatttactatataataatttttcctttacatgatgatccacaataaagttcccttgagaatacacttccctagagcatttaaattatgaacggatttacaaaataactcctatcacatgaaaagagataaacatatagtatctgcttctaggaattatctaaactcattttccttcagagacttaaatagatgaaaaaaatcagcaaactttgtttaggaaaaattcagaatgtataaagcattaattgtgaatatcttactgatatctttggatcaacataatacttcacttttacaacatgttgaggaaatcaaagtattcaccaaacttcatctcattaaagtgtcataacctttaatctaggaacccgtaatagtaaagattactgtttctgtctggaaaacaagaaatctaatccatgaaacaaaatcctgaaacatcacatacattgcttaaagatgtaagtctgaggatggagaatgtgatggaactccgtcaccttgttgtataagtgtgtccggaattggtgggttcttggtctcactgacttcaagaatgaagccgcggaccctcccggtgagtgttacagttcttaaaggcggcgtctccgcagtttgttccttctgatgttcggatgtgttcggagtttctgccttctggtgggtttgtggtctcgctggctcaggagtgaagctgcagacctttgcggtgagtgttacagctcataaaggcagtgtggacccaaagagtgagcagtagcaagatttattgcaaagagtgaaagaacaaagcttccacagtgtggaagtggaccccagccggttgccactgctggctccggcagcctgctttcattctcttatctggcgccacccacatcctgctgattggtagagctgagtggtctgttttgacagggtgctgattggtgcgtttacaatccctgagctagacacaaaggttctccacatccccaccagattagctggatacagagtgtccacacaaaggttctccaagtccccaccagagtagctagatacagagtgtcgactggtgcattcacaaaccctgagctagacacagggtgctgattggtgtgtttacaaaccttgagctagatacagagtgccgattggtgtatttacaatccctgagctagacatagtttctccaagtccccaccagagtagccagatatagagtgtcgattggtgtacttacaatcccttagctagacataaaggctctccacgtccccaccagacttaggagcccagctggcttcacccagtggatcccgcacccgggctgcaggtggagctgcctgccagtccgtcgccgtgggcccgcactcctcagcccttgggtggtcgatgggactgggcgccgtggagcagagggcggtgctcctaggggaggctcgggccgcacaggagcccacgtaggtcgggggaggctcaggcatggcgggctgcaggtcccgagccctgccccgcgggaaggcagctaaggcccggcgagaaattgagcacagcagctgctggcccaggtgctaagcccctcactgcccggggccggtggggcaggccggccgctccgagtgcggggtccgtctagcccacgcccacccgggactcgcgcttgcccgcaagcaccgcgcgcagccccggttcccgcccgcacctctccctccacacctcctcgcaagctgagggagccggctccggccttggccagcccagaaaggggctctcacagtgcagcggcgggccgaagggctcctaaagtgccgccaaagtgggagcccaggcagaggaggcgcccagagcagccaggactgtgaggactgccagcacgctgtcacctcttataaggttatcaatagggcaatatccaggctacaatgaaaaagaaacttgaagtctcgaacacctattgtgtatacattagagtggattcaaaataaatatttaaacagatttctgttcctgtggaatggtatttttccagcaaacctctccagcgattgtttttattaggctttgcaatttctataaaaggatatcaaccctgtcccaacttcattactatttctgctattaattaacaataaaaaaaataggctaggcatggtggctcacatctgtaatcctagcattttgcaaggctgagatgggtagatcacttgagtccaggagtttgagaccagcctgggcaacacagaaaaatcctgtctgtacagaaaatgcaaaaattagctgcgcatggtggcgcatacctgtagtcccagctacttgggaggctgaggcaggaggatagcttgagcctgggaggcggaggttgcagtgagtcaagatggcaccactgcactccagcctgggtgacagagtgaaaccccatctcaaataataacaataacaaaaaatagttgtatttcaagtaatataatctagataatctaatataatataatctagataatctagaattcactgtcattcaatgaattatatctgtgtgaagtgttctctatttggtccaaatcttttaaaaatgggaatactaaagttcacagtaataagatgttgtcagtctacattgaggactacaaagaagcatttctataaaatatcctttgttgctaatgaaagttaatatttatcttgatatttacattataatacagtgatccctatacatactgaagagcatcctagaaaattgatttttcttagtataagcattgtatttctttaaaatatataatcagagcccaatctgtaaatgtaggtaagatcctttataggatgctttttaaatgtaggtcaaattcttgcctccttctcatgtttttccactgtttacccattttattttttatttacttaatttatattatatatttcacttactgtcatttatatttatataaatatatttatacataaatatatttatattgtacatgtatgtatcatttaagctatctcaatttctttttgtaacaaagagatatctatctgtctctactgtatatttgtctatctacccttccatgtaacaattcatctaaatttactatatgataccccaacatttcagatgcaatctgaaaatagcaaccttagatcctctataaactcatctatgtttttgtggtgactttagttttcttctaccttcgaagctattcaaatcagaatagcctcaaatctgccttaaacttgtctgagacaaagtaacatatttgtatcatcagagctcagtattaacttaaagcttaactaaccacctctttgctaagtcacctgaagatgattcttgcctttctgtgcacgaataaaataatttgggacctatggaacaacaccaaccattttcaaataactaataaggcatataacatagagcagacacaactgattatatagtttgtaccctgtccaaggcacctagtccaggagtgtgtttcactcaataacccacgttccctagcccaagctgcatctgcttgagcaaagggtttcttttaataatttgcacaaaggtgtccgaacaggcagcttttttctaagttgtattgaaactccatatgagataagaaaggccctctataacatgtttctatagtacttctaacagaatataattaattgtattaatattagctggctctctagctgttacatgtaacataaatattcaggtaacttcctagtaatgactaacctcatgagcttaggtctccatgacttgcactaaagaatgctttaaaaatagaatgttaacaagttcggagacatggattatttgtacaataaaatacttttcttttaaatttagcttctggctcccattccttcaggcagattttatatattagtagttaagtcttaatgaattatctacaggtaggctatacataacacatttttacattaacttttcgtgactatgacatgaatacatgcccattgcaaaaacaaaataaaacagtacactgaaaatatagaaaatatgaggaaagattacgagcatcaatagtctgatgacacagagacaataaaccactactggaccttcaggatttcattccaacgtgacacattttaatcccaatttggcttacccattttcccctgcacacaacgagtagcctcctatttttactatttggtattgtgcttaagcaacggaaatatttcaagtatttctatagcaattgttttctataaaattaatttagtaattgatcaagtactatcatatttaatagccctgcaattgatcattattcatgatactactcattgttattgcttattacttcatgaatttggttttattcaatcatgtcatatggagattttatacacacacacaaaacacgcacacgcacacacgaccggctactacataaatattaaaccatttctccgaaataatatggaggttagaagtagcttctagatgaacaaaatgaaatggcaaatttgatgcttaaaagtcaaaaatttcatatcaatgccaaagatacattattttagataacactctttttctttatttttatttttactatctttgctacaacactacaacattaatatgaagaactgagagtcagctacgcctataaaggtaaagtgccataaaagccccaatgcatctctctcaagagtctaatcttattctatctgaggagctatcctctttctgtgaactctgtcatgtagaattacatcatctcccatggctcagattatctccaatttataaaatgctttaacaaaaactgttacaaagtgggctctgttatatattcatataacttcctcttcactttggttaatacggaaatacacaatacatcaatatgtttcattaaaacgattgttttgatatagtaataagctgggcaaatagaggaagtatgctgggtgcaatttatttacattttaataagacctcaaacaaatgataccacacaggaagctcagaattaggttaaggagaaatggtggctaaaaaatgccttgaagtttggaagctgtaagtattatctaatcaatagtattacttttgaattaagatagaataaccattccacagggacaggtattgtggtctgtgacaaacattattcaatgcagacattaaaaatttaggggagatagaaattttcaaaatttgataaaattttaagactaaaccttagaatatatgccaaatgctaaagtttaaaatgaatgggcctatgaaataaaaatctcatgaaagcccaaagtatgggagttttcttccttaatataccaaagcttactgctaaaatccccatttaatagagatgataacttcgccattcacattttgggtttctcctactatgcatgttaactctttgtgaatagttctaaaaatcaagacaagtatgtactttaatcaaataggagattcagaaagcaatgatttcagtctacaattatagtagcctgcactattcctatttccaaactctgagcaggttcacctttgtttgagacaaattatcactgataatatcttacagattaatgtgcatgacatttgtctatccagtgtagtttccaagacaataaaaaaaattgcagaagtaaatatattatttaagctgcaagtgaagaaacaattataaaagtacaataatgataggaaaagcatgaagaggacagggtgaggtaaatatacaaaaggaatcttgtaagaactgacacatttgctaaaagaacaagaatatgactccgtgtgtgtgtgtataaatctctctctatattaagtctatatgaaatatatttatacaacttatacacacacacacacacacacacacacacacacacacacataataaattgggcgtggtggcttacgcctgtaatcccagcactttgggaggctgaggtgggtggatcacctgaggtcaggagtttaagaccagcctgaccaacatggagaaaccccgtctctactaaaaatacaaaattagccaggcatggtggcacatgcctgtaatccgagctactcaggaagctgaggcaggagaatcacttgaacctgggaggcggaggttgcggtgagctgagatcacactattgcactatagcctgggcaaaaagagagaaactctgtctcaaaaataaataaataaataaataaataaataaataaataaataaatatctctctatatatacacacatgcagaggcatacatatatgcctctataaaaataaatatttcattaggagttttgcaatttccttatttgtatctatccatgaactagaaagtaagttccttgaaagtatgacttatgttttctgtgttgtaattcataataactagcatgatactgagcagaaaattggttctcaataaatatttgtgtgaaatacaaaaaatctaatttcattcatgcacactatgtaaaagaacaaaattaaagaattcccaaaaataagacaaatgataccattacatggggaaagcaagttagattatgctacactacactaagccaataaaattaataccaaaaaaacccttcaagtgaaaataaatctatgtaaatacatgctgaaatcctcagatgattcagactccagagaaatgaaaccccaatgacagcatcatgaaaatgagttgccccaatatcacatatcgtttttgtcatactctacaagaagtggtcaggtgtgattagaaattccaatttcctaatcttacagaatataaacaatctatattacataagtctatgaattttctgaggcattataaacttttatggacattttttattagaatctgaacacaatggtgtttcaatataaaaactcataatttcaattgtgaatcaccattttacatttaaacaattttaaaaattcacattgtgacatgttataccattaggttattaaaaaaactctgaaagttttcttaataagatcataaagttttttctagttatgcaagagcaatttgatagtggaaaatcaattatgctaagtcctttgctgaactgtcacatttcaaattatcctataatgttttaaagggaaagggctatgcatcttaatcccaatgtctagtgaacaatttctggcatatagtaagtgctaaataaaatgtatgatgaattaatttgagttgaaaaatacatctcaagaaaagtctatgtccatgagttacaattggacaatatttaccagaaaaaaaagattaataaaagtcaacgtccattcctaataatcaaataaggattcagaaaatagtatgttaatccactttaccaatatatcaaataatatctgtcttaaatcaacaaccaatatctgccttaaatatgaaaaaaaactagagataataccacataataaaaaacaagaaatatgccctctaccacaacgattacttaactgttttggaaattatagtcaatgaaataggatattaaacaggaataagaaaggaaatagacagtcatctttgttaggagataatttaataactttgaaaccccaaaagaacttaaaagaaattattaaaactattaagagagttgaataaaataactagataataaatacagatagtccccaacttacagtggttcagcttaagattttccagttttacagtgggtttatcagaatggaaccccacataagttgaggatcatgtggattataaataggaagtggcttttctaccaaagaattataaatgaaatataggcaattaaggacactaacaagaacatagcatgcctatacctaaatatatgaaggaatttggggatctatatgaataaaaagatacaatctatttatgtatgaaaacatactatgcttctgaatgggaagactgaatattgcaaagatactaatactgatttataggtttaatacaattccaacaaatattccaatgaaacatttttatgaactcaacaaactaaacaaatcctgactagtaagtaggtgacaaaagccaaagcatttttgaaaaaagaaagataaggaaggattttacctaaaagatacacaaacttattttgaagctctaatggaagcaatatagaaccggtgaaagaactgaaaaagcagatagtccagaaatagatcctaatgttgataaaaattagtaggcaatcaagatgatgtcaaaatcagtggggaaatgattctggaacaattgattaaccattaagaacaaaagtaagtaagatgtttacatcataacatgctaaaataaattctgggagaaacacaattaaaaatataaaacagaaccatgatcatactagaaaaaatggtgaatatttactaaatttcaagctatttaaaaaagaagataaaagtaatgaacatagtcacagagaaaaaaatacacaagaaattgaccatacaaatatttaacattttctcacataaaatcttacaaatcagtaaaactacatgagtaaagaccacaagcaaacaatttataaaaataagaaaacaatgacaaacatgtaaaaaacattctagttccttattaaatcactgcaaattaaaactatgtaaactagttattttgcctgcaatttgtcatatatttatataatgctgctattcaaaacagttaagaatgtagttagaaaagcacttttacatacaattggagaagaattctcaaaggaaccttgagaattttacatcctctagcccagaaatcaactttctaaggatgtatgctaaaaacataatccaagatgcagataaaaatttatatataaaaatgatcctcagagtaggagaaataatagtggaaaatgacctaaatgtcaaacatgaaggagttaattaaaattttttggtacataattaagatataatattacacagctaatgaaaatgagtattttatgactcagaattaataaaattaatgctaagtgaagagatcactatacagactatacaatccaaaatgttgtttagaaatatgcaaacaaacacatatatataaacacctgtacactttagaaacacccatacacttggaaagaggcagagcaaatacttagaattgtttatccatgattggtggtgtcaagtgatttaaatttattcgttatatatattttctattttgacacatcctttcaacaagtgtacattaccttttaatctggaaaaaaaagttattttaagcctaaaatgaatttatgtgggttagaaattcacttaagggaaaaaaatcagataccgataaaaatcactttcatatacatgtagaattactgtgctctttaatctgtgaatctccatacttttgtgcataaagaacatctattgagatattgagatacttgacttttttttagtgctgaagaacacaataattttcctgaattaaaacccaaagaaaataaagtcactcataaataccatatttgactacagcattcacccaatgctctgatggcctttcccgttgttgacttattgataaaatttacctacattgctaatattaataattgttttggtaccaatttcaggaataatcaatctgagaatgtttacttggcccatttagacaataccaaggaaaacacccccaagtaactgtaaccagcatagtgaacagtgtatttgcgttttcacatttcttttccatggaataccaaccttgcctagtattttgcgaataacaatggatggaacttggattttcaacagtgcttaaaaaatagctgccaaagtcaagacatgtaataaccttctaagtaagtttgctggctccatattgtgtttgaaggcacaccccctccaaacgtctgcagtcaccatctgctactcaactgcagaataatgcactgaagtctggtgttgtttggcatgggcaaagacagccaatgtccaactccattcagacatgtgcaccatatcaggaaccttatgacacagtcctcaacatcaatgcagcactttcaagccctgctgcacatcaatcaagtatgtatgacagtcaagctgatagataaaatctaagccaactctaaatacctactgtgcatggatctctctagtttgcctgcagctcaccttctattaagatgatagctttggcctagtcttccatgccaaaataagtgcatggagtcactctggcaagaagaagcgtctacatcaatgtcaacaaacaagttccttgcgcccgaccctaccatctgtcctcctgcttcccacctaccgtactttatgtggaccttgatgaatgagattctaatagtccaagactctagtttagccagcctttgcagatggggtcaacatgactgccctctggccaaatacccagggtgacatagctgatgggttacctggaaagtgcctttttgcaaatttaatgtcagaaataaagcaaatgaaggcgttcctacaggttctgagtttcgggtttatggaaaaaagtgatgcattcaatgcttaaagtgaagataatttttcttttaaattatttgaaaatcttataatgctaaagcattgataaattccatttcaacactacgggtaagggaaataaaatgaatgaataaaagtaaaactggggctattctaatgtatttacaaagtaggtttgagagaaagacttgaaaaaaatctcagaaatatgtagaaataagacttgatagtgtaacattaatatagaagcagattatttcattctgcgttagatgcaacaatattagagcatattgcacatgctaaatggggaataatagatttcatacctattctacagaagttgtatggcacttgcagatttcaaggtagagcagtaaaatttaatataatcttaagtatgagatataaatagtttctggaaaaatctaattgtttttgccttaaaaagatattacatgaaatatgataaatcagtattgtcataaaagtagtaaataaaattattttgttttttgaacatgttgacaaaccatttcaattaggtcattaaaaaaacacttaaaatggagcctgagggcatatgaaacaaacagaaatttcaggaaatgccgctagttccaatccaactcaatttaataggatgatacaatgataagaccttatttttccttcaaggaaagctaaatgtatttctagaatggtctctggacacatcaaaaatagaacaagcaaaaacaaaacaaacattctacctaggaaacaacatcatctgaaactctagacaatttaagtaataataagaaagtgaatcttcaccaaatgagaaaatgaatgtgaaaatatgttacatactataaagcaccatacacagaattattcagagcatctattaaagtgctttgtacatagtaagcatttactaaatgtttgtagaattgactagaatttaattgaaaagagaagtataatgagacttctacaagtagaatcagatccttttaataccatgggaaaaagtttcagtcaaattatatgactaggtacatccgttgtctttgatgttatgaatcaagatgagatcctattatatcaaaagaaaaaatattgttgaatttctctttggagaaatcacagtaaaatgaaaaggatgattatttttaatttctaaatatctccaaattttatagcattcttcggtcaactaagataatgctatagaaatcctacataaaacttgaacttacaatgtcctggcctaatcatctggctaatctctttgagttttcctgaaatatgttcacatcccattttctatgggaattctcccactgattaacacagagaatgagaatttggcctgtgctctataggcaccattgaaatgtggccacctgaggcatgtagggagggcatccagctggcacaccacatgttgccctggagtagtgtacaatgagagggatattttggctaagaatacctggatgatctctataaaggtcctgattatgaaaaggacttcagcattatcattgtctcatgggcataatatgagccagggaaacttctgtttctaagttcatatattttccaaagaaaggacttataagaatataagaaaaaatcaaagaactctatgaaagagaaacactgggccattgatactagattttatgtactatccatatcactagaagaaacttttttgagagctccatgcattttaaaacttatgctaaagcacactatagacttgaccatcaaataaaacataatgaaatctgtaaaataaaggatgcaaaaacatagcgtgaaaatttatgcctgcagtgcagttgttgtactatattttataaaaatcaattaagttcacatactactcacttaagaaatatctgctgattttatttttattttacgcaacttgtgaggaagaaaatccatgcatttgaactgtagtgccaataaaacaattttgtcaattttgagtctatttttttcaaaacaccatacgtgattaaaacacataatgcactagtatttttgccaaattttgtttttaaaccaaagctgtttttgaattacataagcacaaaatcagaatttcaaaaccagcaaacatatttaggggtgaattttaaaataagcccacttgattcattgttagacaaactttgagtgccagggacatttttgtgaaattccactggggtaaatagggtagctaggaaacgctcctcaaagtgaaaaataagtatatgcattattttcaataagttttgtttagcattttcaccctcatactaagtggttctggtgatatttacaatacaacatgagcataaatcttaaggaatttatgatgtcatcaaatgctaagagacaattacagctgggttttacatttgtgtttatatgttattttgcatatagatcccaaaaaccaatgaagagaaactttgatacaaaacatatcctgaaactaaaagacagcttctatctatcaatataaccagttgatagtatttctaagacagagtttgacagtaagtgaaacaaacaaacataatgttttaaatatgccacttcagccactccagctgtcactcaagaggctttttttaatatcattaattcaatgccacacaaacaggaattcggtctttccaataaattttggtgacaacttgttggcagaaaggaaactaatatatatgtggaaacttttattttgtcatcatgtatgtttgtttgaacttgcttaaaatattgtaattgtgggcctaatttacaccttttttcctaaaagctcaaacaaatcacaatgatcacagtgtccctaagactaatgagtcccaatttataccacagaaaatagaagctcagagagctaaagagtactggcagaatattatactgcaagaatagcaatatagcaagtatactcacttgaaatcctaataaaaccataaaaactaccactttgtatttttcattagcttatatttttacttaatgcaaaatattttgcagaaaagttttctagctagctttattgctagtaagagaataacttttattaattgaattaatttttgtaatttgtgaccaatgaggtttgactcacatcgcacattttctttaggaactcagatacttcatagatcttaataccctgatgaaaatttaagtcctaaaaggccaggaaatactgagattcaagttggctcctctaccatctttactgacagaaattcagagtgccaaaagtcagcactgctggttgctgatcatcatatctaaacattgattcttctaattgtgtattttgagacttgcttgattttagaattacaggtggaaagtcacttctctttgatataaattgcatgcaataaagaaggaggcagtcctacacaataaatatgtaaggaatggttttccacctctgcatgctgcagaaaatcccactgagttaagtagggttctaccaaggccacttaaacatattagcctattatgctccacatttctttattgttctcaaaaagctaatgaaatgttccagtgtaatgttaatgctggagtacttttaaaggcattttagaagtgatgtttctctcataactccagaagggggttccacttcctaaaaacatttaggaggccatggggagaccatgcagcctctttactcagactgtttagactcatagctggagaagaaaatccttaaagataatcacttaagagtttcggtgtgagctatagcatcatcgcaaagcgacaggaattaaaaggcagtgtaccgtactactgaatagataggtttaaaatactgtgtactgtctattcacagataacattgatttacgttggtaaatctattggttcagcacatcagtgcagtattaaggaatcaattgtttctccagagtcaattatttttagaaaaataaggaaatgtgacctatcactgaaagtcagtatgtagaattaaacttggccagttttcttcctcgctggggtcttaattttttcaactgtaagataaatgaatcagacttgtcagtatctatgatcacttctagcattaaagttttctagttttaagattctaaataccaacactgtatgttgaggaatagcaaagtaggaaaagaactgggaataaaactatcactgaattattaactttccaacaatcaaaattctgtaattttgcctttagttgccataaacaaccacctcaccttctgaatatcaacaataatatgaatgaaggaaaggttgtatactaaggtcacaggtggtatggttgagattaaagccaagactgagagtatagtaatgaattgagaaatgaatcatacacttttgacctaatatgtaatatgtcttcccaaatcgtcatttttatacattcattttcaatggaaaacaacaacttgaatatcttagaggttttttcccccaagaaagacatcaggctgtaatctccccccacaaaatttaatacagttcatagctcatacccctaccggataatccccaaaatgtcttgttcctttttcaaattagacatcagcattcagtataacaattaatcaatgccaacaatgttccatatgctttattagcattcattcaccgaatccttccatgaacactaggaagtaggtactaataaaaacagaaacaattttgaagtacagaatctcagaggtggttatcagtaattctagaatatcagtctgacatatgggtccctccactttttttcagtgcacaacgtgaacactgtgtggcacagtgtttcaagaattaatgtttgatttatatcaaagcattatgttttttacttcatcttaatagtaatcacaagagtgacttaagcctcctacatgaaagcagagatagaaaaaagatgaccttggaagttacatattttcttttcctgtaagtatgaagacatgtctataagttattagaaccataaaaaaccaaaaaactaataagaataaaattgtgaaagaatattgaaacctccttaataagcaggttcttgtaggatattgaacaaggtatgtatgttgtagccctgatgctatatttgtgtcatgctgagcaagctacttaacatttaggtgcgtaagggtttttttccctaaagtgggaggatttagatctctaaattccttaccaatcataattttagagcaaattatctataaagtcaattaataatttgccttgcttcatgtattacataatagttgctaatcaaaatgaatagtattatactcacagctttaactaacttatagctaagatcaggcttgctttgtaaacatctctctaaaaactcagaagtccatgaatactaagactttttactcctcctgtaatttttgacctctactggaaatctcacctgctacccctgacctcgaatattgcaagtattaatacagtttctgtatatagtgtacttaagccaaaagtcagaggcatgagaaaggtaaaggccgggacaaaggtactacaattcagctacacacttgtaatgcttcccattagttcgttagttatattagttccagaaactattttaacacggtaggctgatactgcaagcaaaaacaaaaatcatgagaacaatgaaatagtaggtcttagcgcttaagcatatctactagtagtaatacttgacaagcagcccaccttctttgtgatctggaaatgatttgatgataaagccaaattctagaaatataactgctatcttttgggagatcaaaggtcatgtgagggggagagctaaggtcaagagcaagccccttaagcctactccagaaatttcactagagggtgctcttgggctttcatgacttctcagttcttcaataagaaccaagtattgcttagataatatattctgcctagtataacttggactccatcatggatcccatatccaatacttcaatatagaattaaaagatatctccagcagaccctgggcctggttttttattttcctgtgtaatttccttgtttctactgatagtacacttgtgagtttcacaaatttaagacaggtaagagatcttaagaggtctccaaaagtctacattctattaaacaaccacagaaacttcctaatacatcaaagtaagattaaatggggattaactgataaatctatttttgcaaatatatgttttacaaacatattttaatcttataataggttcataatttatatacctattggaagaattattattccataagatctgtagagaaagtctgattgtcaaatagaataaatttcaattatttatatatgtattattcatatgtctcatgacatcaaatattgagcaccaagtaagtactgaataaatatttcttgaccctttattgcacatacatatttttataacacgttccaacaggatgacatataattaaattttaatctctacaccatatgtttgaaattttttctataaatgcagtttcacctttctggaattcacgtttaatgacttattctgtttatttctaatgataatcgctttttatatactttccatttttgctacgtttttaagagaaaatgaaacatggaaattgttttgttatgtgattaactttttaatgtttctatttgtttattagaagattaagaaggttatttatttctacattaaaatattggcaatggcatatatcaatgcatagtgattttcttaagaattgcaatgagtgactcagtaaaattcttcttcactttcaggatgtaaagaattatggctactagccattatgcagggtgatgttcttatcacacataattgaaaactcaatagttttagcatctttagggttgacagtaaaattctgaggttgactatggaatgctaagtctttgaaggcacttccaatttggctaaacttacagtttcattattccttaattgaattaagtttaagtttctcttaaaatcagcttgaggcttttgacaaattagaaatttgggtcctgaatagtagccctttacaatatatgaatctgcataaagatgtgttttaaatgcctatttgataaaaagataagcctggtcacttatggattctagctcctttcaacatcctgcatggattgcaaccagtgtgaaaaattggggatctttaaagtggtctcagatctcttataaagcagtcacctgggctcttaaactgtatggtgcttctcaaaaagggctccttaagtatcctatctgatgtatgttattccccaattcaacttgcaaaggacagagtcaccagcatatattcaaactgtatttcatccaagtgggttgtcaataagcttaaatcactctatgaagaactggcaaaattcccatggatactgtgaaaataaagggaatcaatgaagagatataattattttagtctcagatttaattaatttgtgggagaggtcattttctctcaaatatattcaagtttcttcaaacacaggtcaatgtttgccagctgataggaaaaaagaaaacatttagtctgagtttcccacgtttatattaatctctgtatcacagctaaataaaatgtttcataaatcttcatataggcaaaagagagttcaagctaaggcagagtaacaagtattgccaatagaaaataacctcttaagtactgtttctactatttcctgttctaatttttctattggagagaatgaaacaaagtaatttcacacctggttttatgaatcagctcactaaagattctaggtagaagttacacgggagatgcaagtataacttcattattttacaattagaacactaagacaaagaaagaataaaagtggcgtgctatcccatgccatgcagttagcatatggcaggtcttactcagagtccccagttcctaatctagtgttctttctactgcaaaggtttccagtgctgcttggtttttcataaaggatctgtatatcatgtcaaaatttcatgttgactttccttgaaatttcagagaaaaagaaggcagtataagaaaaattactcttcattgtctaactcttcaagtcagacagcattcctatgtgcaatgatcctcgatacagtctaggtcaactgatctctatgagttttcatactcattaaaatgtatgcatcacaaagtacaattaatgttctcactgactttagggaccttgcatgtttcatccgttccctaacctatgccatcctgaatccaagaggcaccctgtatttctctgaaagtcagcccagcatgaaaatactgaaataagagtgcaggtgtactctttgctttaagaagacacaataagccaaattctgaacttaccaaacagacaaattatggggtgattattcacattttaaaaggattcaccacaggatgcttttaaatcataagctgctctattgcattttaaataagttgatttataaagcttcctttacaaggacttttcactatccagggttcatggttccttatccaaaggcaatgagagcttggtgagcataaagtcctattacctgctaagccaagcttcctttcccaaataagagaataattaggactgtagttcatttttgaaaaattaatgagtctctcactcctgaaaaatttaatataccctgagcacttattatgtgcctggcacagtgctaggcattttagataatgatcttatttactcctcctcaccacaactctaggagattagtacaattatcccaatcatggatgaggaaactgggactcagagaagttagagttaagtaacttgactaaattcttgcagcaaataagtgatcgtgccaggattcaaagtcagatctgtctggagctcttgcccttacatattttacaatataatttcagatgaaatttaatgacgtctcttacctctgacctaactgagcataattgcgctccaaatgtactattccagtgcagcaatcctgtctgtagcaatagggaccagtcacacagcctgaatacaaaaagatagggggctcactaacaaggttgcctattctggtcactgcactgccatattaagcccggatttatctcctgcaattcctacctattggatctaactttgctctacagtcattgagaacaattaaaatcccttccccccatacctatcatatttctcttatggtttctttcttctttttttttttttttttttttttttttagtatccagtgcctccaacctttttaaaatataatgggtttatccgctatttacatatattttattctttcttgaaactggttcttctggagcacagagaacttataaatgctatttctaagcgtttatgcaactaaaaattattggaacaatacacagtatagtggataagggcgcaagctcagaaacccagactgcctgggttcaaatccaggctttaccaattaatggctcgatttccttggtgaatatatttaaagtctctgtgcttcagtttcctccttcaactatgaaatgaggacaacagtacctagttaatgtggctcttgtgaagatttaaaagaggggcaatattaagcaaaaggcaatataaggaaaattactctacagtgtctaactcttcacgtcaggcaacattcatacagcaatattcatatagcgcttacagcctgctaggcagcaattagggtactgcctaggttgtaagctttatataaatgtttgtcattattattgatggtataggagtgaatgaatacttaactgccttggaaaaatatgacctatatcattgtatgagattgattttattatccagatataaagaagtcaagctcaactagaaaaggcacttgactggagaccagagatgtgcttctagtcccaactctttcaaacactccagatgaaagatcttggactttatctacctcatctttttaaacagaggaatgggactgtacctctgcctctaaaatgatatgtttttattctaggattctaggatcctattccacctggaccctgcttaaatttcattactcattatgtttgaaaactaccattacatactaacattttatctgcatgtttatatctgttgacatttcaatcagcttatctgcattgttttcacgaaacagaataagcctctgagagtctatagacaggtctgaaaaaacaaaaggtgttgtgatagcacagagaggaatttaatgtcactttggaggaaataacctaaagtcctactctgccaagccagtaaaatcctgtcctctgcctgcaacacctggcccagtccatgctatcttgctgaatttcagtgcagctctttggataaactcaaattcaggtttggatggaataccaggttgatacaacagtcattttttttcaacagaagtgcaggttggactaccttttacctaccaaaatcacctcattctttgatatatagaacatttagctaattttattatgacttagtatgccagtactcctcatatactttattgtccatccccagatctagtgaaggcatggtgactggtatcagtatcaaggcaattgtcttcaaagaatgtggcaatctattctaacaaagtaaattccacaagggaacaaggggacagccactctaaattcactaatgacaaaaactttgatattttgtaattaagcacaatgcattattctataaataaaaatgatgtccttgtaaatctaaaagctatgaaacgttatattttctatttctaaaattctctaggctcaaagtcaatatgtaagtctaatttttttaaatgcacaaaaagctatgatatttcaaatcttagatactaaatttgtgaattgagtgaacctggcttctcccgcttagacgtgaacattcctgttagtacataaatattaacgaatattttaggccaaaattttgtgtttggtgattgacttatggaatcagtctaagtaggtgtgaaggtgactagacttattttggaacatgtacaatttcataacagtaacacggccgttaaataattctctttaaatgatatttaactctcattttaactgttagcccttgcattatgaagcagcttgatgctgaagtaaagctaagatttcagtaaaaagaataagagctttatattctagaaggtagaaatcctagaaaaatcaaagaaattaaaattttggaagtttttgattcatttcttatattttaaataggattctaaaataacatatctcttctatacataagaaaatagtctggttcacatattttgatttattgaaaagttattacagtacaactcaggttgccgaatactaacattgctataccagcgttgttttggtaaatgtttgcattataactctggttgtattacagcaaaacactcagaagaaagagagtaacttttacacatattacatagcatctgtacagtcatcccttaaaatgcaacaatacaactgcaacactttaaatactttaaaatacaaatgcctttgaagaacataacttatatactatttattaataggattaaatcaacatttttatggctctctaagcttatcccagaaactcttccattatttcagtgagtaacaagagaattttttttattgtttatttttttttagatatggtttcactctatcacctaggctggagtgcaatggtgtgatcttggtacactacagtctctacctcctggactcaagtaatcctcctgccccagccttctgagtagctgggaccacagatgcataccactacacctagctaatttttttttttttttttttttgagatacaggttctcactatgttgtcagactggtcttaaacttctgagctcaagcaatcctctccttggtctcccaagtactgtgattacaggcataagccactgcacctggccgagggtcttatagataggtaatattaacaccattttgcaaaattttaaaaataaggcaaggaaaggttaaaataagttgtacaagttcaacaagtagtaagtgaaattcagccagactttgaacatagacatcctgttttagaatctcaatgttctttctatttttcccaaagcaatctcactaactaatgtacgtattagattgcactgatatagtaaggacaaagaaaacccattttctgtgtatattgctattgccttagaaaatacaaatagctactgaaaagaccaatgctatgaagcagtttggtaatacctattaaaaattttaaatctctgctacactgtattaatattttatatcttaaaaagttaaagaataatagagcctaacttagatccttccaaatttgtaactcttcaaaatctaaaatgaatttctaattcatggcttataactgctcaagtaggaaacttatgacaaaaccagagacaagcccttccaacagtgcctatgacatcacagatatacaaatctgccccattttacagtacccaaagaagaccggaattcagctgttatcagacaataataaacttcttctggtaagttcgtctcttagtcttagatttacattcccactgtcagcaagaatttttaagttaaacatttttgaaaagtaaaaattcaataaatagcatttacattatccacagaatgtattttcattgctttggtgctaaaatattttattttaggctgttcttttttctcttttccatccacctcttagctcctttgctccaatccttgcacctttccacccttgttctctctctccctgaagcctcagggaagagggctgcaaactgtctggatgcctggaccctcacgctcctgagattaaacccagacccgcccatggcaagagtcccgttctttgtctgaagcaagtgtctgattgagttagatatggagtcgttatcacattgaaaagaaagcctggattttttttatctttggtattaaaatatgttatatttgtattaaaatattcatctaataaactctcccaaagaaaacagtttcattatattttcaccgtattttctcattccattcttaaagccacagtgaaaggaaagttgttgtggtcaccccaaaatactctttcccacttctaatcaaggtctggttaggacaaagctaaacaataatttctactttgtatttaaggacaccagctactgtttacccactgatgttatttatactaatagggggtctctgaagtgacacctaaagcttgctaaaggtttcaggagggcttttgtaaagtcaattttctcccagtatcgctttatccccacagagtaagcagatgggagagttctttttccctcaaaataaggcttatagcattgactagggaatttaaatgtatctttacaattctcaacttgatctcccaggaagagcttttatagatttggatttttttttgtcataaagtattctatttatttcccagcagctggtgtcaaaaaagttgtttttttaatattccttttaaataaataaaatctgttttcatattgtgtaaaattagttttgcctgctgtgagtttgtggcattatgaagtgatcatttcttcccatgaattatttaaagtgaggatatcaaaatctgatggaacaatacaatgaactatacaatacaatttaattttataatacgccagttcataatagtatctcaaaatgcacagtagttgcaatacattggttcagaattagcagatcaagtataagcccctcagtttcatattttagtatttgagaatcagttctaaattttctagtggactagagaatcatgcatatttggtagtccatagatacctaaagacctttttgctaattcctcatgccaggcactgatgtttgcccagcctagatgacattttttttctttttttgtaaatctttaagacattgagtttgacagctgttaaccctttcattacaaaacaatattggtattaatagcatttcccctggagttctctgatcactttgtcttagggaacaaatgcacctatgtagccacaattattcttactacttattctcactgcagagtttctagaagaagggaaacaacgatccattcaaatgccccactgcacttataagacttacagcaaagctgctaaaacttaaattttaaggtgagtgaggtggcataagggaaatgaatgagctgctaatgaatagggcaagacatgattagaagctataacaaagtctgactcaaggaaaggccaaaggttatcttgtatttgatatgtgtgttttaataaattataatcaaaatactacactgactttttcctcagtggattttctagcattctataagagatattttgtctgattaacttgctatattgaaaagtgggagtcagtatatattacttacaaattctcaaatagcctctgaaaaaattccaccacaaagattttaaaaaatggaagtatatggaaacaagatgctacaagatgttggaaatggttttccaaagcaagaactggcttaaaacatagaatagcaataatgagcacttttcttgttagttctacatactgtaaactaatttatgccccaaacagaactctggtttccctattatccatgttgccacttcctcctctaatctaactgtacttctctcgtctcagtgaaaggtgccaccatctgccctgacagttgatcaggccaaacatcagcaactctttttgcctcacccaccacatctaatccatcaataagccgcattaacccaaacacaaaagtacatcccaaacccgaccattcctcactatctctgctatcacgaacaaaaatcacaattatctcttatctggtctcctaactgatttctctgcttccactgttgcaccttataatccattatctaaacagaagctagaattcttgaaatgcaggaaagatgatatcattcctttggtaaaattctacaagttatatatagtgcaataagaagaaattaaaattcaaaaccatgaccagtaagtctctccattatctgttcatgaccatctttctgttctcatcttctaacatttttcctttgttcaccgtgcttctttgcctattctgtctctaaaacaagccaatcttattcctattagccctggtctagctatattgcctctgcccagactgctctgttcctacatctctgcatgactgatttcttcactcgtagctcaaatattatctccacagaaaggtctttccttgtgtggccaagatagccaaagcatccccaattcattctaccctgctttacttttctcttagaactaattactagtatcttccttatttacatcctgtatgtatgtgagtatgcacatgtacctgtatgttcataatctctattacagtataaattccatgaggatgaggttcttggatgtgttagttatctattacagcataacaacttacccccaaacttagtaacttaaaaaagcaaacaccattccacagtttctgtgggtcaggaatctgggctcagtataggtaggtgcctatgggtcaaagtttctcatgaggttgtgatcaaactgtcagctagagctgtggtttcatctgaattctcgactgaagaggaggagacttgccatgtgggggtcttcacatgtgaaggtcttcacacaggggtcttcacacagggctacttcatgacttggactttgctttttctcagggagagcaatccgggagagagtgatagagggactcaagagaaaaaccacaagctttttaaaaacttaaccttggaagtgacatcctatcacttctgtcctttattaaaaatgagtcactaagtccagccaatactaaaggagaggaaattagacaagcaggtgaaaatagaggatgtggagatcaggtggggccatcttagaagctgcctattataattgcttaccagtacattcttagtgttcagaaaaatttcggactttcagtaaacaaattaatttaaaaaatgactctctcatgaattagttccattggacattttgccaatgatcaagaaaaagtagtgaataaaatctcactcaagtagtgacattcaaaccaaaagagatcaccccagtaggaaggtttcattaggatgtgtaagcagaaagtagcagtacagcctcagtttcttcatctgtaaaatataaagagtagttgtaccatactgtcggagacctaatgaggcaattcgtgagggcctcatgaatcaaaggcagtggatagatgttagctattatctattcttaataagtataaatgcaagggaagcatttttagggaaaataacacaaatcatgtttttataatgatggtatttgatacatcaggtttaactcaaaaaagaatttaagaaccactttcaattgtttcctaattatattagcttaaatatgagactgtaaccaaaaagactaataaaattttggaactcatcaagtgtactgaaaataggctagaaagctttccatatatttatgtaaagttttgacatcttcgaatggacataatgatgcatttgcaatctccacaatcatgagggcctaaagggagagagatgtgtagagccctggaattgaagatccatggtgtgactggggggggaaagtctctgaaaagttaaaagaagacagggcactgaaccctgatctaatatgtaatggggttatgaaatttaggcagagggtagtcatagaattattcatgaaatcctagaatagtaatactagaggtcaaacttcatattcagaaaagtacaaatagggtcaggtaataaagcactattccatatttttttttaatgcctgccttggaaggtagcaaaacttaagtaagaagttggagaaattcatagaagatataccaaaatagactgtagtggatgtatggattggagtttgccatcagagaggcaaacaaggatgtctttaaacttatttactgatgtttccatttacaaccaaatggggtagatgcatcccacatttaaagaagccattccaaaagcaggaacagcacccctataagatgttatcattcctgttctattaattacagtgtcactcactcttttactgatagccctgatggagaatcagcatgaaccagccattttcctccctgtatatacattagcaaaactttgaccattaaatagttcaaagataggcttgcctcgctgtctcatgcctataatcccagcactttgggaggccaaagtgggcagattgtttgagctcaagagttcaagaccagctttggcaatgtgccaaaaccccatttcgacaaaaaatacaaaactgtgcttggtgtgttggtgtgcgcctatggtcccagctacttgggaggctgaagtgggaggatcacttgcgtgcaggaggtcaaggctgcagcaagctgagatcacaccactgcactccaccctgcagcctgggtgacagagtgagagcctgtctgaaagaaagaaagaaagaaagaaagaaagaaagaaagaaagaaagaaagaaagaaagaaagagagagagaaagaaagagaaagaaagggagagagaaagaaaggaaatctcagatatatctataatagaggaatctctcaaaacaatttctgcaatatccagtgtggtggatctaatggtgaccttccaaaagaaacgcccacattctaacccctgaaacctgagaatgtgaccttatttggaaaaaggatctgtgcagatgtaatgaggttaaggatttctagatgaggtaatcctggattgcccagggaagccgtaaatccaataacattttcttataagagaaaaaagagaagacagagagagcagaaggccatgtgaagacagaggcacaaactggagttacatagccacaagccaaggaacctctggagccaccagaagctggaaaagcaaggaatgattccccctcacttagagtcttctgagaaagtgtagccctgccaacaccttgatttcagacttctggcttccaattctgggaaagactaaatttaagctgttttaggccatcaagtttgtgctaatttctaatggcaaccctagtaaattaatacacccagaacaagtaattatgttttccagagaggtaatgcaatgtagtaaaaaaaaacattttgagtgagacagatttaggtttagacctggggtttctctatactaattgtgtgtctttgaacaagttactttatatctctatcttcaggttcttctttagtaaaatgatggtaagtttcccttgcagggtcgctgtgtgatatgttatttctgctcaattcagtactcaattaacctgttaatgataaattcacgcatgtgcaacatgtctacagacgttaaaaactgttgttttccttgaaaatcaacatacattttagcaaggtattaattagaacatatgggattgattaatgtggaaactagttgtacaataccaaatgttttaacaaacctttattacaacctgactattcatgtcatttcaaataactttcctggttgtcagtggaaccatattcagtctgttcttttactgtctcatctgtaatatcttccatagtttctaatagagaaataatgaaaaagccagagtattagtagaaaatgtttgcgtctagcttgagcttaagtcagatatagagtcaaaattgtgatcacagaattctcctaaatgttagtctcagaaaattgacaagggcataataatttctaggacagagtagtcaaattcatacccaccattgataccttcctatccctgacattaaaacagacaaaaaaaagtagttctcacaataattttatagaggaagaatataggaatcatgcagtttaggtatctcttattctggaataactccttaatactaaattgaggctctagtgagagctattcaaaatgcataaatgaaagtaaaataaattttcaagaaccgatctttcttacttttctagcaacaaacttttgaaaaaaattaaaaattttaaaaagtaaaatatgtaataaattagctataatatcatttgtagctattgtaatttattttttattcattcactcaacaagcattattaaatgcctagtaaatgtcaggcattgtgttaggcactaaagacgcagccttgaataagacatactactccctaccttaaggataatttaggcaaaacaatcaatgataataaagtgcacattacaggaatgcaatgtaaggcaattataattagggaatcggggaaggcattccatagaaaataagctttaaattgagacttgcaagattggttttatgtcagtggaggtgagcacatgggggaagaaaagagtaatgaagagtattcaaaacaaagagtagaacatatgcaaagaccagaaatgagagtgagcatggtgcaccgaaggcatgaaaacacgtttagtatgactagagcatagaatgctagggggaaaggggcatgaatcagtctagaaaatgagacaggagccaggctggaagattaatattaaggaagtcagaatactgttgcaataacttaggtgagataagatggtaccctggatgagagtagtagttctgatatgaagaagattgaacagattaaggacattcttaggaggaagatcaaaagtaccaggtgattgactgcatgtggaacagtacaggatatggaaaaggtaatgtcaagtttctaatgtcggcaattatgtagcaatactggaggtgagagcatgtttggggcaaagaggtgagtttagaacatgttgagtatgaggtgtctgtgagtcatccaagagaagaggtctagaaggcagtgctcagagagaagcctgagctggagaaatatgtggtggtcattcagatgcagatgctaatgaaacctatgggagaaaatgagattgcctgggaggactgcccaatgtgaggagagagcctaagagagagttcagagaacatcaactttagtactgcaaaggttaagtaagactagcaaggctgcctctaatgagactttatacaacccccttcatagtaagttctcactttctacagcaattcagggctcacacttctcttctctcttttgactctcaaacaaaattataagataagcagggtgggcaacaggacttcttgaagataaaaataatctaggtttcaagaggttaggcttgaggtcatggatctctttatttccagattagttttctttccatgccattactctactcccaaggattagctccttatagcttcttctttgttgttagcctggactgttgcctaggtgtcattttagaggggtgaagtttttttgcattatattatattaaaaattttctccatctggaactgatgaaaggacagaagggctaacctgaggcaaaactcgagagtggcagaactgtttcttagagcttccaacctccctcatctctaccttaccccttctttaaaaacttttgttcatttactcaataattagttattaagataatttgtggatatggaaattaacaagccacaccaagtctctaccttcacggagcttacacagtagtaaaatggcagacataagaaccaatgcactaaaagttaagaaagaggagtgtagaaccaggagacaccaagggcatacctaacctacactgaagaggttaaggaacacttcttagaataagtaatatttcaactaagatctaaaaaatggttgaagttgactgtcttggccactgttgcaaggaggaaaactgattcaaccaacgaatttagaaaattgtaatggaaacgtataggttagtgtgccatcctcttgtatttttcaaaaaagaaatcccagaatttgcaacatttgatccaaaaagaatgaatctcctcaaactgtggaattcctgcactagtactgatatggtttggctctgtgtccccaaccaaatcttaccttgaattgtaatcccagggacctggtggaaggtgattggagcaaggggggcgattttccccatgctcttctgtgatagtaagtgaggtctcataagatttgatgcttttaaagttatttggcagtctctctcttctctctctttttctgtccttctgccgccatgtaagacgtgccttgcttccccttcaccttctgccatgattataagtttcctgaggcctccccagctgtgcagaactgtgagtcaattaagcctcttttctttataaattgcccagtctcaggtagttctttatagcagtgtcaaaatagactaatacaagtactatccaagtataagagaaaacattactctcacctatctcaactcataccatgtaggcaggcccttaatctatctccccctgagtccagatttgaaggcaaggaaagaactataagtaccttgtcttatttatttttcaggactctaagttatattatctccattatacagtagagaaaaatcatctgaaaaattacgcaaatctgcccaagatttcaagccagtaaatggggagctaggtcttcattctggtcagttggctccaaagcatctatttattctaccttgaatatatatacacgtatacatatattttacagatggtgtttcactatgttgcccaggttggcctcaaattcctggcctcaagtgatcctcccacctcagcctcctaaagctctgggattacaggcataagcccccatggccagccaagcatatatatatatatttttttttgagacggagtctcactctgtcgcccaggctggagtgtagtggcacaatcttggctcactgcaacctctgcctcccaggttcaagtgattctcctgcctcagcctcctgagtatctgggactacaggtgcctgccatcacacccggctaatttttttttttttttgtattttgagtagagacaaggtttcaccgtgttagccaggctggtcttgaactcctaacctcaggtgatccaccccccttggcctcccaaagtgctgggattacaggcgtgagccaccgcacatggccatatttttataaagacttgtgcacagatgctcattgctactttatttgtattgctaaaaattgtaaacagtctaaatgcccatccttaagtgaatggataaacaaattatagtatgtctatacagtggaatactatgcagcgaaaaaaatggtgaattattgatacatgctatgacataaatggatctcaaagtcaatatactgagtgaaagaaggacaaaacaagtacagaagattctatttttataatagaattcaaatttttataaaattctaggaaatgtaagctactgtgtagtgatggaaaatagatctatggttgcataagaaaattactggagtaaatatatatatatatatatatatatatatatatatatatatattagctgagagtggtggtgcatacctacagtcccagctactgggaaggctgaggcaggaggatcacttgagcccaggagtttgaggttacagtgagctatgatcatgccactgcactccaggctggttgacagagcaagtccctgtctcaaaaaaaaaaaaaaaaaaaaaaaaaaaaaaaactttcatttctcttgtgtaaacatgtaggcatgaaatggctggataacatggtaaacatacatttaactttttaaaaactgtcagactgtctctaaagtggctgtaccattttactttactgccagcaacttatgaggcttccagtttctccatatcctcaaaaatcttgctatgctcagtcttttaaatgtcagtcattctaaaggatgtgtaatagtgtctcatgattttaatttgccttcttctaacaatgattgatattgagcatcatttcatgtgctcatcatataccatctttttctttttcttttttttttttttttggtgaagtgcctgatcaaatctttgcccatttaaataatatgttgtatattattgagttttcgaagttctttgtattttctggatataagttctttatcagatatattctttgcaaatattttcttacagtctgtggcttaccttttcattttcttaataatgttttcaaagtgcagaattttttaattttcatgaaatctaatttatcaacttattcttttatgggtcattcataaatgaattgtgcactaatcatctcctaacatactacatgagttacttatcttttcactgatggatcccaagtggctagtaaagtactgaatacacattaggtatcaataaacatctgatggataaattaaaatttcaaatagtgaaagcaaaattatagaaacttagttcattggcagcacagaaaataaaatagcctctagtgcaaagccatattcaattttttgttatctgatctagtatgaagtttgatcgatacaaggacccaaatttattaaatcttgttaaagaacctgatgctctctctctagagacaatcctttcttccccaaaatagaaatgtgaaattccatagaacttaaatgtaaagcagtaagtcccctacccacctctgtgcctcacctcgcccgtgactcaagtgctatatgaacccctgcaaataaatcaaggctgctgaattctcaaaagctctaattgtgccaattgtaaataagcctcaggatgaatttcaaccagcagtgtccccaaaaccattatctgcaactataatccattacttttctttcataattaatttttctaataggtcagtactatttgttttgtttaagcgctattccagcaatcccattttaccaacaaccaatgtcaattgtaattatatacatattttctattatatacaacaaatacattcttatattatgcgaaacactaaattgggcagtgattttttaatgagtaataaggtaatatgctacattggtgctcaactgcacttgtcttgaccatatgaattaagagtctagtggaaatttataagcaccttgaggacttccaggtatgtgggtgcttaaataggtactcaaaagatgctgcttattttcatagattttaatgtctaaatcactgggaacaatgacaattaccagagatatagataggtggttagataaacacacaagagatatgtatgttagagacatacacattatagagagtataatagggttgtatacacacctacatatacctatataatgtgtgtgtctgtgtgtttgtatgcatgtgtatgaaatcaaaatgcaattcactggaacactgaagacaaagcggtcaagcagctgagagaattcaccatactgatgagctttcctcctcagagagcttgctcctcaggccctcactcaaaggctctttattctttttagatacaattctaaagagtttgatatctacttttccatccacaacagactaaatgctgaaaactcgagagcataggtgagcttgtgtttgatgctagctgcaagcagcctgacacagggagaaatgagagctctcctagagccaatctggggagtgtcctggtgagggcactgagacctgctagttaggaggaggcctagtgcaaacaggcaaaattgcttggatgaagggtaatcaatctgagcctagttcttttggatgaaacctttgagaactcaatgacaagaggatatggatccaacaggagactagtagagaatacaaattcattattttgctatacaatgctagttgcattttaaacaattgtttctctatgaattttactaccaggcttttctgaaccattctgtgtgaattcaatactgcctggatttttaaaaccacttctgacactataaaccagagaaatctttcttaaaagataataagaagatggggccttgcatttctcataaaaggaaaatgactccaccataagtgtattcattacacactgttgaggcatgaattcagggaaaattagactgaatatgagattaccatcctaactttctgaaacactcccagcgctgtcaccagagttcttacttcaaatatttactcttgatctaaaaatatcttagtccaagaaacggaatgattactccacagttaaagtatatttagtgatctgagagaggagaagtttcatttcactcaagcaaatggttttagtaccacaaccaattaatagcttcatcatgtgtgagccatgattataaaggaatcggactaattttttaaacaaatctataggcttctcacaagggctatttttcacaatggtcaccttggaagaaagtcactccagggataccgtcattacttcagatttgggaccttacctttagaattggttcatgagaaaaaaaaaaaaagaaacactacatgcttcatagttaccctccccacctaacactacatatccctgatcaccaactttgaatatgcctcatttacactgatcaaccaaaagcctcctggaaatggtaacacggcctatttatcctgggctttactgggagggtgggggatgaagagggtttataggaattaagagagtctatttttaattatttcatctgtgaaacatatgaaattcctttggccaaaaatgcaatataaaactcagattatcaagggccttttcgtgggaccagtgaaatggagaaaaaagtctccatgacaaaatagaggacttttgggaatccttttttttctgaggtttgcatgtgtgtgtttctagcttggctctcacctgaactgctctttcataatctactgtagtcattgggtacctggaatctgggaaaactccaaccttactccagcacttgtgcaataacacagtaaggcacatggagtcaagtttaagcacttagtccagggttctttgcaccctgtgggccttcagtaagcacttgttgattgactgaatgcgtggctcactatcaatgtgaattaactatatacatactgcattaaaatccaacaacccaaatactttctagctttcaggaagtaatgcatctaattgacagaaccactcttatgcctcctaatccccacttcctacaaaccagctcaaaggaagagagagaatttgaagaaacaaaaatgaacataagaaaaacaattagctgatgcactctgcaaagcctgtaatattatctagaatgacagcatagccattgttcgtgctgccagagccccgcgtgtttgctagctcacccgaggtcctgagagaataataaactaagcagattagatgtagactgatgcctccatgccaccaccaactcacacaacacacacactgttctgagtgtctgaacacatgcgggcaggtaaacccagaaaatgggcactccatgttggcaggaggggaagaggctgccaacaaacagggcctgtttattatttaacagttggtactgctagaggcctggcaccgctatagagcactctctgtttcagtgcaagtcagcctgattatgagagcgtgtgagccaaatcatgtttaccatagtctgtgagaacctctgtgcccccaacagacatggaaattcttacaatagctctcgtccaaacagagaaaaatcactcctgagatggaggtaaagggccccacgtgcttaaattttgtctgatcagctggctcagtgtctctacatgtagttgttttttccctgctcaagacaagtcattcctctctaatgatacagtttctaatcctctgcctttggttactttactttgggacctaaatcaaccaaatactatgtcaatcacccatctactaatattgcttatgctgtcctgcacgctttggcttttcagcaaaagaatctgctgcccagggcggctacctcctgcttctccttcgccagggctgcctctgcagtaagtctcctctctgccaatgtgggccacaggtggatgccttcctacaaatccaatcagcaggataatgtgctactatcacaagagtggaccttaatgacaaagagccctgcttagatggtcaccccattaactttgatttgattattctgccccagcagaacacttggcttcacaaccacagatggcaacagtccaacataaaacctgtagacagagtagtcatgttgggttcatacattttcaaaatattaaatttcatgtaaaaatataaacatggtaagtattgagagagtccctggttccctaggaaagcactgttttcttttcttttttcttttttttaacaaaccaaggtcagagcactgagacaattgtgctaactaggcaacagggataatctaatcatttcttttgaaattcaacataaatcaacatttcttttaagtgtaagaacctggcttttatcttccatatacaaccaaggcaatctttgatactttatgtgactctattctatacaactgtttttaaattcaagataaaattggctctatataagctagttcaatattttgaaatttaattgtaacttggatacacttcctctgtgaccatgagtaaatcattaaaatgctttctaccaatgagaataaaggcatagcaaactataagtcttacctgaaactgtatgcagtgattgttttgtgttttgttttctaattgacagttgatatttatacactaaattatcaaactactatttgtttttaattaattcctcaactttgccactcaaggaaaatgatatatgctttgtattgttaagtaaatacataattttatacttatcatgttattatggttttcaaagaaagtagttgtccctaggtcacagattatatacacatgcatagcaaaaagactttacaaaaacaaggaaaatatgaaaaaataattgcctagcttggatcaagttaacccctggtttaatttaatcatctcctctactgaggatctgataagagattcttaataacagccccaaattaaggcaatagaatcaggaaatctttttttttttttttttttgagatggagtcttgctctgctgcccaggttggagtgcaatggcgcaatctcggctcactgcaacctccacctcctggattcaagctgttttcctgcctcagcctcctgagtagctgggactacaggtgcccgccaccacgcctggctaatttttgtatttttagtagagacgaggtttcaccatgttggccaggctggtgttgaattcctgacctcgagtgatccgcctgcctcagcctcccaaagtgctgggattacaggtgtgagccactgcgcccggccaaaatcaggaaatctttcccaaaacatcctgtatatagcaacactcataactactactttatggcagaataatggacccgattacaggttcacatggaaaaagttgatatttcagccacgaccaaaatataaacaggatttttcatagggagtagatggtgtgttcatagcgagataggtggtgtgttcatctctgtgctgagatacttcatcttaactagtaagaaacatagtaatccctcacattcattaagaggtatgctgtaagagcttaatatgtatacacccatttaaccttcataacaacctttattttttagtgactactatttacagtgattactattattttctccattttacagacgaggaaactaaagcacagagtggttaagtaacttacccaaggccctgcattatgtaaataaaggggctaaaatttgaactaaggtggtctggctccagagtcaaagtgtaatcactgtgttctgcttctcataataacgatcactctttctgaagcttgtgttcaatttaaaactgtatattccctgaggctgtagaatgttagagctgaagtaatttaaaatgatctaacccatggcctaaagctccaggtggagagaggatgtttgggaagactgtgtagcctcaaaattttgtggataggcacacttttctgggaaaagaaatgagccactcatctagtctaaatgtctcagttgagggattaaaaaaaataaagccacaaagcaatggctgtaaatgctgcatattttaaggaagcaatataaaaagaaccaagcccagaaaccagggctgttttcattatcctgtctacccaaactctcttaggtggctcccttaaagccagaagaaatctgtgtgagggatgccgagtcagcctgtttctctacttggctccacatgactcagtaaagcaaatcaatgagacaagatatctactcatgcaagaaaaaacagaaatctagtgtgatgttttcttgactattcaatgctaatggaaaaaagttggtaacacatttaagaggtaagaagaaataaaattgtctctttacaaagttgactgatttattcatttagtagatacacacacaggtatacacacatacacacaatttatttattttagtggtagcccagaaactttctgaatttcttttgtatttctcttgagtcttttcctgtaatttatatttacttaaaatttatcccttatgttcaaatttttcacatatatatataaagtattcattataatcattttaatttcctccatttctctggttatttccccattgtatttccaattttgtgcatttgtgggatttctcatttagtaattaaatcatgtgatattggtttgtttattgttctgttattctctttgaaaaaaccaactctttgatttattagtgtgtctcttttttattttctaattccttaacttctgactttatttttttaatcaattccttgtttctactttgcagatttgttttttgttcttttaaccaacttcatgagatgaatggtaatacgtttataattattttctttcctgtaatagtcatgtttaaagatatggatattcctccgaacactgttttatctatatctatacatacttattttctgtaaattctgtaatgcctcttaagcaaaaaattaattttaaaaagttattggtcttttttcttatcaattcgcaggagctcttattttttggagatactatttttgtctgagatacgagttgccaatcaaaatgatcactttttcatatcatgtaaaaactgttttttaaatttttatttgcttgatttttcttattcacaattgtggtaatatcagtagaagttcttctccttcctctcccagctttttgcttcctatatggtttttggtcccattagagttttattttcttcttctacttccttcttgttctctcacagacaattttatttctccttatttgtcttatcacttattcaatcctgtttatctagtttttgaactttcattttattttattttattttatttattttattttttgagacagagtcttgctctgttgccctagctggagtgcagtggtacaatctcggctcactgcaacctccacctcccagcttcaagtgattctcctgcctcagtctaccgagtggctgggattacaggcgcccaccaccatgcccggctaatttttgtatttttagtagagagggggtttcaccatgctggccaggctggtctcaaactcccgacctcagctgatccacccgccgcagcctcccaaactgctgagattacaggtgtgagccacaccgtacctggccttgaccttttattttaaggaggccacaatgtcttctatttatttgctagtatggaaaatagatattattttcttgtataattcttcttgtggtatatgttttgatctggtttctttgtattgcttttgtttttgtttaaagctattagctttgcttagctgatagctaaatctgggtccaatgcaggttcctttctgattagttttcatttttcactgagttaattctatcagctgtttgctgcaggaaagaggctggcacagtaaactgaggacttcagggagtttctttttggtaccatatttcctgttatgttttacctttctcaccaactcgaccgtgcacattgttcaagagatatggatctgcttagtgttctcagtgtcttgtcttccccatttagattagcgggagttccaaagggcttgcacaaagtcctgcctgatacattttccaagtcatgatctaatatttccttatttctcttctcctgaaggtgatcaacagtggcaaaggctggtgtggtttatcttctccaccttgccacccatgcatcctgcttttggcacatgtggcaggctggtgtcattcctcattcactgccacctcctctgttatcatctgttgtagaacaagccttagcaacccttctgcagaccacctatagcctcacactttcctgttgcatgtaagtaactggagcatgtgtccatcaacttttggatgttctacctgctgcctatatttaaaatactctcgacattgtccctgttctaaatttcgaaatatcccatggtttctgatttgagagtgtacctgccttctgtaagaaaaggcttttttatatgcatctcattttctatttaattgtttgttgcacagcaacatatgcgacagtgttgcatttagtttttcatctgtggcctcctaaatggcaaaaacaaaacttcacttattagctcctctccaatccttctctcaatcaagtgcttgcccgtccttgtccttaaacccctggactaatcccttgtaaggtgtcctgttgtaaggtgtcaactacagcattcacattcattgaccatttatatttcccctcataagcatatttgcatttaaataggagattttaaaaatctaaactaaactttagactaccagatgaagttataaattaaaactttgattgtagaatgacaaataacatggtatatgtggaaaagaagttagaggaccccaattagtatctgtaaaatgacctcatgtgagtagcaaagttatgtgtgagttgctttaatctttaaaattagcttctgcaatgcttcattgttttctataatagaagagtaataggaaaatgaggcatttgttgtaagtaaattttctagttacctgtttaagcagttttcttttaaactttaagatgaaaatctttacaatgagttcctattttctgaaacaaataagtgacttgatatggtagaaatgtactggagtgagtagttccagattcttaagttctttctgttacttattattaataaagttttgacacatcatttagcccacccaagcctcagttctcccatctgtaaaacaggaatagcaatacttcctttcttgcaatataagttttctgtgagtggaaaatgacataatatgtgtcaaaatactttgtatactaacaactagaaaatgataagagccttaataataaaagataatccaaataaaatattacactactatcaaagataatagaggctaacagggaagttatataaatactttcatgattcttttgtgtgttttttcctagttgtttagccaaggtactcacttctatttcagttctcattgccatcagtgagtctgcctctagaaaaaacactttctgttttcccgcctcctcttctccagtacatttgtatagtttttgtctttgtttctttggtatgttttctgtggctttaaattggctgcaaaagattgcatagggtaatgaaaagagaaagcagctttggagtcagacagacctggtttgaatcctgactgtgtttttgtgctcatcacttaacgtccctgaatctgtttccttatccataaaatgaatttaatcactgataccctgcagggctatctaatatgtgaagttcttggatttcatcaaatctcatttgccttcttaaaagtatattttgcttatttctgtgtttttaattgaagctttatgacatttgacaatggatacattgctgcactctgatcagtaattattttattcaatgaatcatttcactttttttctaaatgtcaccaaagactctagcttccttaaaatctactttttgttaatttccttgactaatcttatagttccaatagtttctctgcttcaatcagctttcttttgtctaaacttcttctgttttctcttgtaaaataatttatcctaatcttaaatctttacgacagagaccatatcttctttggccataatgcatcgaatattctgtaaaaaccacatcactatcaatcaataattatgtgtgtgttataagtatgtaaatgttatagatctcatagaacttatccactctgccttagcttattcctagaagatcacagattactattatatagcatttgtataactctttatcatttgtgaacctttcgtaattatttaatggaggtcttcaaactactagtatagattgattttgttatttctattgttgggaagggaaaacaaagacagaatgatgaaaacttgtcagatatatcccatgttaccaggaaaaacaggattagcacacagtctcttattctctgatctgctgatagtctgttgagctagtgttttcctagcatgaaaggaagaaacatctattcatttccaattattattttctggaaaaggtattatggagatggttctctttatgttcaaaataaataaaatgtccgagtgattcctggaacttgggagaaaggggaaggtaaaccaaaaactagggccagagagcaagaaggaggtaaaggagataaaattcgtggtgggtgaatcctcatccgtcattacatgacagaagtatttaaaaaggaaagctactacctctcctcatctgaggcttcctccagaaccctgtaggagaggaagatacactgctgagtcttcatttggggagcagcaggagaaggcagtgcctccttagccaaatgaacctttcctgacagctgtggggatatgtgtttgtgccaccaggccccttagaaaattatccctaaaataactaatgtttagtcagtcaaaacaacaacaacaacagaaaaatagcagcttcaaagcgaaagttatgtggcgagagtaaataacccaaacttaacgtgaccttcctagcattattttagggaggcgttagggtatagagagtgaaaaacaccctgaggtgggatttacaagtcttaatttcagtttcagcagtttcactttctggctgtgtggtattagacaagtggcttaacctctctggacctctctgatccttcagatttaaaatgagggggttgattactaagtgacgtctaagagcccttctagagataaaaaattccccaatctatgataataataattaacatttgatggtcctttaccacctacaaatgatttccacatacattatctaatttgatcttcatgccagttctgaggtagtattattatgattatgcccatttttggaagagagattcagaaaccacaaaatggcagagttggcattgaacagatgttcccaagaggcaaataccccttcagtaaaagaagcagctgatgctaacaaggataaataagagcagacaattcagcctgtgagctcttgtttaggggtacaacagaatttctggaagctgcattggggtaatgataatccaccatgtggaatgttatctgatgatgtatttatcaaaaaaaactaataaaaagaaaattaaaaaaagatacaataattgttactgcactacaccctaatgaattattgtgttcaaggttcttacaaaaaaaaagtaatattatactcggcttatgttttaattgatttattaatattttatcacaggaatgtaatttaagctcctcatgatttagatctcataaacctttagcattttgcaaattcaaattccaatttaaagccagggcgagcaattaacttttctatcatcttgtcaggggagaaggttcgtgtttaatttgagacaaagtgacagaaatatatatacactgtatgtattactccaatttaatttatgagtcagcaccatccaccttcaaaatgtagatttaatagaagaggaggaagaaaaggccgtgctgtcatgatagggctgtaatatctgccctgaatttcttacatattaaaaaaaagtcactggtttgttgagataccaagctagattgattgcaggcctatttccagttcttttgtttcacattccacttcctgattcttttctcatacagcacataatctcatggatatcacagggagttcttacccccacttctacctctactcctaccccatcctccattttcatgcatagctgcttctacaggtttatcctaaatcttgacaagtgagataaatggtaaatattgctttgagatcacgtcttcatcacctttctcatctttccaaagccaccttctaagtgctctctacctaaaacaaacaaacattaaaactcctcgcaattttatattttaatgtgcagggtgtatctggcacggtaaaacactggcactttcccgtgatcctttacaaaatatttaaggacaggatatgaataaataagctaaaaccacagaaggtagtcaggtgaactgtagggaagtacttccccttggtggttattaagcactggaacagggctgcggagagaggttaaggaattcttactagcgccgttatcctataattcaccaaaggcacacaatgctctatgctgatgagatgagttacatgacatctcctccctggttcaatcaaaggaaagcaatttacatctcaaaccagttctctcatcagtgggacataaaaactgcagaacagagatgcagcaaatgtgcttatttatacagaatcaactcagttgccactgttctttattattttccttctctcccacctcccctgtatggtggccattttgaataggatgcttaaaattctaaaagtgagaaaaagaaccaagaacaattcagtaacaaaattaactaaagataacttgtgcttctgacaatcagtgtcccttgtggtgctaggccaatccctttgttccacttaaaaataaaatcggattcctcttgctggccacaggaaaagaattagaagacgattaatggaaaattctggaaggtagccttgtaaatgtttattcacttttcaggcatacaatgttgtgctacataagtgaatacagtgcatttgtcaaagaaaggccatgttgaattagtgtgaggtcttcattcataaaacaagcttatttttactaataatctctattaatctcagcttaattatattaggcatttttcacttgcatacaacagtaaaaatggccaaaactgcatttactgcacctgcttaaacgcagttatatccctaaaaacgattgcagggaacaagctcccacagacatggcttttaggcagaatatgggattatggcagaggggtttaaatacaggaggtaaaaatggtaatcatattcatcaactacacaaagaagtaaaaacaagaagctctagataattctttttagtggactcactaaaataacaataacagcttgatgaagagaacatgattgtcgaaagcttgtccattttacattttctctttacatagtgcaataaaaaggaagcacctgcagtttctacttgtgcgtgtattcgtgtgtgtgtgtgtgtgtgtgtgtgtgatgttgaaagaaatcatggacatcatatttgctttaggagctactagtctaatcttaagtgcacattccctaccataaagttgtatttgagctccgtgcagtgcagaaacattcttcagcttagaaagtgcagtctttgcttcacacccttttccttcattcagacacatcagcatcttatcactttggacattaaagtaaaagagacttctttgtcatgaatatttttagacaaattacaccaaaatatcttgtattttccattttttagtggaatctactttactgacatataccagcccaccataacatcactgttgtgatgtcctactacttatctaaaaaaagtactattaactacatattgcaggtatttgaagtatataagaaaaccataaactgaattacattgtatggctggtatgatctcacatgaagtttgagctatcattattaaaaacagaaattgcatttagttaatgcatctgacagtaagccagtcaactttcaaggttgtatgatgagaaaaaaaatattttttaaaaaaacagaaaatgcctgaaaaatttcacaagagcatttcacatgacaagagaattcttcctctcccttctgctgcctgcctgcccacctttcttccttccttccttcgttccttcctttcctccttccttccttctttccttcctttcttctttcttttcctccttccttccattcttccttccttcctttcttccttccttctttccttccttccttcttgccttccttcctttcttctttcctttttcctctctccctctcttctccttcctttcttccttccttccttccttcttccttttcttttctcgtgcttctctcccttagtttctctcttctttccttccttccttcaatttggtggaggaggtgcaaaaatttgagtaagaaaataatatttttgtttcagaatccacatgcttttactattcatcatgctaacttagggggaaatttagataacttcttatggcgttttttttttttttttttgagtttatagatatctttcaggggtcaagctatttccaaacattcttataatggcctccaatattccacactgcaatatatagcatgctctaagcaaaggcagtcttttataaaagactgcaatagctagtgaagaaatacttttttttgattacttttataaaggcacagagcaaacgacagtacagtatgtacataaataaagcaaaggttcaaactgcacttttacaactacaatgtcactaatagacctcatcccctctctgctattctatatatataggttgaaatctgaggcttaaaacaatgtttgaacaacaaaacagaataaatgactaacccaatctttcaggttccaaaaacagtactggagagttttctatttttataggtgtttgtcactatggacattcaatatctataattctgaaattacagccgggcgcggtggctcacacctgtaatcctagcactttgggaggccaagatgggtggatcacgacgtcaggagatcaagaccatcctggccaacagggtgaaaccccatctctactaaaatacaaaaaattagccgggcttgttggcgtgtgactgtagtcccagctactcgggaggctgaggcaggggaatcgcttgaaaccgggaggtggaggttgcagtgagccgagatcgtgccactgcactccagcctgacaacagagcaagactccgtctcaaaaaaaaaaaaaattctgaaattacaacaaaattaggatctgaatatgtgttttacaaaatgatttgctataggccttcatgggggagatggcaatccctagtatatcaaacactgtggcttaattttttttaatcttcacaaaactcttcaagaatggttgtcataatgtaagaagtgtcagcattaccagaacaatcagagatttccataggcagaataacattagagattacgtcattacaacagatagccctcatactcaatgcatcttacatggtcagttaaaccaaagggtaggaggcactataggataattgtgagaagagttgctttctaagtggaagaaaggtgaaaataaagcacctgcagtgctgtgctttcactttacttcctgccctcacagtcatcctggagatcttactggtgtgctttaactgtcttgtggcattctctttcaaaagcatcttcagggactaaagttcaggttttatcagaatagacatagtcctgtgctacttgacagaaggcattttactcttttttatggtttcactaaaatcaagagtatcacaaaaacatcttaagatctgaaactgggaatcgcctcataagcatgtcttccaaccctacaggttgtataaggcaagtatgtgtagattgaatggaaccctctatgtctggcttttcagtattgtaaagactttcaaagctcattaagtacttctttgctgatacacaccaagctaagtcccacctcagggcctttagaccttttgttacccatgactggaatgctcttcctctagggtttagcatgcttctctctttattctggtttctcctcaaatgtcacctcttcaggagacttacactgaccatcacatctgaaatagcttgccaactttactctacctatctcactttattatttttcatagtatttatttttttccggaaattatgtactgcttattatctgtctcccctaataaaatttaacttctttgaaccaaatactttgtcttattccttagtttattgctagtgtccagtactgtgcctaatatatggtaggtgctcactatatatttgtcaaataaataatacttaaaatttaaaaatttattctcctttaagttgtacagtttaagcctcaccttattttctgctgataagagaaggtatcacctacaatgacccttcacattctagacaattaacaaagtctatgtggaagaataactattccaggaagaatgtgttcagacctggtttgaaatcacagcctgttgctgtggggcatttattacccaccatttagctagattactgaatagatggagttaaccaaaatgctgacaagacacacaccacacacacacacacacacacaaacacacacacacacacaccccccaaaaacgaaacctcagccctccaaaactctccttactcttgtaattggagtgcattgccactttgctccaagccaaagaacagataagaaagagaagcaaaaatcagaagaactttggaagccatttcactagagctgccacctgtcacttacgtaagaagatgcaatcatccatctgtccaaactggtgaatcataaggtcttaaatactatttactttccccaaaatagtgaatcccttgcaattttatatcacataataacaaagggacatgattcttatttgtttttcctttagatacacatagaacattttctttaatgtggcatacaactttaaaaatataaacaccaattcactgaggtatttttttggtagaaaaaagtgtctatcataattttagtagcaataatagttctgtacatttcttttagcaattacaacctcagatttctaagcactgtgcaaacattaatttactaagttctgctgtgttctctttgtgaattagaatattatcatatcttcattatttttaggtgagagtcacatggctatgacttgccagggccacacggtaaataattttttttaaagtggtaagatgcctctgttttgaaagtggatgcccagggaagattaataaaataggataagaacatacctaaaatggcatctgtttttttttttttaacctagtgcttccattcaaattttgttttgggatatgaagtcacctgatagctcagttcaaaactcgaataaacatccttgaaaatagtagggttattctttaaaaatagtagttatcaattattgagtgtgcaccttgtgccaggcacagttctaagagatctagttctaggagggaaagtgtacgagtccatgtgaacaaggacttggtgtcttattcactattgtatgctccgagcctataacatacctggatggtagtgagggttcagttggtatttgttgcaataagtgtataaataagggaagctttcttggttccagaaaactaaactgtctgaattttgaaacacaacctgtttgtaagttgggggcatcatattaaacattttcttttggaagcagaggagaagggaagagattttatttgacccaatatataaccaaatctaggataatagtgatcctctttacaataaagttcatttattcaacaattatttattgaatacatactatgtgccaggtattggaagaggttctaggaataaagacaaggtccttatttcagaacttaaattactgtttatgggcataagaggaaaatatcttcatatacaatgcaattatgaggcaagatttttctatgaaccagtgacttctgtttgtttttaccatgttaccctcctaatttactaaggcttcaattacttggttttcttctgagtagccaggaggacattatagcaaaaagtaagtatactgattaattacaacatatatccataaagtggaggggatatctgaaaatcacctagagaatctgaccaatatctaagaaattaatttaggtcaaatgattagttctgaaatgtctgagttatctatattagttattcatattgccagttcttaacttgttctatacaaacacaatctgaagcttcatctgggcttcttcaaattggaacctagttacaactcttaatggataagttcaagaataatgccactacaataaaaaagaaataaagaagggcacaaagtattagaagataaattatctagagattaataaagtctttggtaagagtttgcaactctatcacatatgggctaattggaaatcactgcttccagggctaatgacctcatttgaggttaccctgtgggacaataacatggcctacctctgtccactaaacaaattctgtcaaaacataacttaccaaagtatagcttgttgaggggtatacatatctgaatttattttactctgataatctgcccgagaggttctgttacttgaaggcaatatcacttcctttgggttcacttgtaggacacaaaatgcagcttttacaagtatttctgcttgtaaactaattcttcagctatagtatataaacttcactctataagaaaaccaaagaggccaagggacattaagtttggtgtttaattgctatcagcaattaaaaattgctagcagcccacttaacattttcttcttcctctaaaaatgaaactgaaacgtatcttttagctgagagttctgtaatgctgagaaaacatcctaaatacatcttggcaaaggaagaaaagaaaaaaatgtgatattgatgtatttgctttcctagtatattgaaatcaagaactagatacaggtgacagatctgcttccacctgctggctcagtgaatttgtaaaactgaaatctgttatctaaaaatcactagtacattcagaattacttagcattccctttctgtttgtacatgttcatgacaatgataaaacagccccaggaattctgctaccaatcttcatatatatgtccattgacattgtctccatcaaattcaatccaataaaattaaatggagttaaataaagcagtctgcttgaacctcagtatctctcatttcttattgtattgtacctcttatcatttcttatttatttagccaaggttaaaaaaaatggtttccagattcaattataatttccctcctggtctcctatttcttaagtattttttcctttttattttcatataattacaaggatttttttttttggcaattgacatgaacaacattattcaaaggaaaaaatacttaaagtagctactatcttatagcaaagaggacatttccatctatgtttaccataaaaattttcactggattccaacattttcatataatactatctacaaatattgcctgctttgagaagactccaaattttaggaggtagatgggcgataggtaatgcatggaggaagttggtaaagaagacaaatttctaactatgacttccggagttaaattttaaaagaaattgagaagtatacaaaagtgttaagactgaaatatatgcaattggcttacaatttctccaaccacttgaggcaagagggtaactccaacttttgccccttcattgccacacttcttcaatctgcatatggattttatgtttcccctttacggctgcccttaatattaattttaacctcaaataaaatttttttggaaggaagagtaatatacacattataattttctctggagttttcctcccataagcaacagccagatgacaaccaacttctcattagtctcttgaaaaacgaatcagaaattttcttatgtccttcacacaggattgccatctattataaatagtgctgaaagaccccacacacagcaaactgaagcatgtggcatttaatacatcacacagaaggatcaagaattgagtcaacacttctagggcttctacccctcaactatgcatttccatggtacccatttccatggtttttagacttttaaacaaacacatttgtctaaaaacaaatacatatgtaggaaacatttctccagggctctcgccttttcagctgcttttggttgacagatgagaacccacatacagtattctgaaattctgcgtcttcttgtcttaagtactagagaaagaaatatttggtcctaggtggcagatcttacttatatcacttctattaaacgggcaagatagagtcacaaaaagaggacttatgattttcaccttataatggattccttcttggcttccttccacctcctatacatggatttgaacttcattttgaagacacttacaattattctgaatgaaaactatcattttcattctccctctcaaaaaagtttctgaagaaatttgttgcaaagccatgctatctgtaacattacgaatatgttagcatatttttagtgcttcactagatttcataaatcttacttacccatatcaataacaaccagtataatttgaaggaaaaaggagaaatcttgtgtcttaaattatatcatttaaaattcatggatgaaggtagtatccctagaaatgatctgattctatgtgactccgggaaagatactatttcatttctgttttagagattaagaaactaaagtacagataagttaactaacttgcctaaagccttctggtgaatgagatagccaagatttgaaccgtggagtccaacgccagaggcttaaccattacattattctacttctgtgttaagattaatagagaggaattaaatgcataattttggaggcaaacagcttaagttcaaatcccaatttcaccagttactagctacatgaccttgggcaaagatcttaaccactatgaaactttatttcctcatgtatttaaataatagctgttcttcactgagtactaagctatgttccagttatcgatgctaagtgttttacatgcattattccatttaattatcataataactcaaccaagtatgtagtgttatcatcccagatttagagatgaagaaactaaggttgagtaatttgcctattgttatacagtaaggggcgaagacagaattctagtaagggcaatctcactctagacaccttactcttagtcattaaatttggtgataataaccaatagtgtctacttcatggggtttggggttgtgttttggtcaggattaaattaggtaatggaggtgtaatggctaattttataggtcaacttgactgagccacagggtgctcagacatttggtcaaacattatttggtgtacttcagtgagaatgtttctggatgagattaacatttgaatcagtaactgagtaaagcagattggcctccctcatctccaaacagttggaggctggaacagaacaaaaaggctgactctctcacaggtaatagggaatttctcctgcttgacagcctttgagctggaacattcctttttttttcctgtcttcagactcaaactggaaacatcagctctctgcaggtctctggcctaaggaagttcagactaggactataccattagctttcccaggtctcaagcctttggactaatacgttggactaacgcaattggctctctggggtctctagctttctgactatagatcttgggacttgtgagcttccacagtcatgtgagtcaattccttataaaacatctcttctatacaggtatacattttattagttccaattctctggaaacatagtacatagtttctgacacccagaaatagttaatgaatgtttcttaaactgctttcccaagaaaagccaacagaaaaggaattataggatgaaaaagcccccttcagtaagagcaaagataggtccagatgaggaggataatgttctgtgggcactcggctcttaagagaggagcaggggtaggggcaaattttaaaacacgatctgcagctaggtcagatgataagcttgtttatgaaataagagatggcaggaaaaccaggttgatccagatatcaagaagaaaagccactttcatcttccactaccctaactggaagggaatcttggttccttaccatgatagcaagctgactagaaatatagatgtgatctttccctttgaaaagtaacaggttacagggaaagtgaaggaatttatagaaaaggtcaagtttgtttagtgccttactgtgtactacttcaaccaattcagctctatcacccaggttggagtgcactggcacaatctcgtctcattgcaacctccacctcccagattccagcgattctcatgactcagcctcctgagtagccagggttacagacgcaccccaccacgcccggctaacttggtattttcagtagagatgggatctcaccatgttggccaggctggtctcaaactcctggcctcaagtgatccacctgcctccacctctcaaagtgctgagattacaggagtgagccaccgcacctgccccaatccaactcttacatacatactttgtttccagctataaaccataggggcataaaaagacttctctatggaacaggttaggtccctgaagttttcaggtctaaacatgctggagatggcaattaaagctttctaatatatgcgagttacattaatatctttgaaatacccattcaattaccccagctcaacacctgttagacaccctctctgtcaaatctcttctgaataactttgtttagttagatttggggccagtatcgtaacttcacgtagtctgtacaggaagaaaataagtaagctttactctggatctcagggaacatgtgtttctcccatcatctaagctaaaaaacaaggaagctgcaacagctgggacaagaaggaaaagccaatttgatttttaaagaaaatagaaaataaaagcaatttgtccaattccaatgtgtggtatctatgctgatttttctcaaggaaaagtgcttatcattgccaaaatccccaaagtaaccacagctgacaaacttctcagcatcagagcacttggcaactgacaataagacctgctccttccccaagcggataaaaagccaggaactccccaaacaaaaccaacagcttttctgtactcttagtctgccttcatgtcttttgagcacagtatattgtcctgtgtaactggaggttcatgtagcacactgattttacccaaagcatcaaaactaatataattaatttatataatcttctagttacactgactatagaacttaccttcactacctacccaaatgtctgctgctgatatatacatatgattgcacaaattctaaagagtactctcaataaacagaaatgtaagtctgctaaaaatgcttaaatatacaaagaaatgcaaatataagctctctaccatacataggatctttgtttataccagttgcacatgatcaatggaaaaggacattcaaaacacttttgaataaacaaattattatcttgcattagcttgtatcaatagaatccttccaagtattttttgttcataataaaaatgtgtataggttggtttgattattttttactcttatcatggcaactcaatataacaatactgtgcaggtggaagagggaagaggggaaaggagagaagctgcaaataaccaatttaattaccctaacagtcatttttttttgcaggaaaaaggttccatatgataagaatgtttgttctgatcaaatatctttgctccataaagaccttatgaatcttccttcaatgtgaagctaagctatttctgaggagctactggaacctcctcattttttctagaggtatccatgttctaaaaatctcaaatgatctcaacttaggaggttactgaagctacataaatgtcaaaagaaatgatagatttacacttctccaatttctgcatttgttatgtagcataaattcatgacagaaaaaaaatgatcctcaaaactccttagaagctcgctcaaaatcttgttttaagtctactcaaaccaaaccaagttctgctaatgtaaacccttaagatttgtggtagtttttcattcccaatattaaaatagtcttttattaattctccatcacatcatattttcccttgactactaaatcaggtccacatttgttgcttctatgtttttgacatcatggaagaatctggagcagtggtacattttgctcttcagagatattttattggtttaaaatgtttgattactaaggggtttaatctagtaatactagattaagtactgtctaccataggaaaaaattcatcagacttaaggtgtttcctcttaagtggaagtagaaagccaaatttcaaagcctaccgtgttaataacaaatgcttccttttatattttcatcaaaaaacaagcctatttccttatctaagttctgtgcaagtctttctgattttctcacaataaactatatgtgtgaaatcccatcagtgttatcaccaatatttattcctgatggccacagcttttctaatctttgtgtagccatatgcttaatgttacataacccacttggaattcctttcttacaaacaaatagcaaaaatgtaagtttatgaagtatgcattccttttttaatgccaaaaataaaaacaaaggaaaatttctaaattggacatgtgataatacataaaatctatctgataaaaagtgtgtaattactgtcacaaaatcttcacacaatccttgaaatctcagcagtagggtggcaccaagttcccacacatcaattaaagcatgtacatatacgtcattggcaataggtcagtctcacagagaataatctcatgatgccaaagctatcctacctgaactttaattcctgaataacaatgttggctaatagtgttttactggatattgtcttacttgctaacatttcttatggggatcttgattaattggctacctaatccccaaagattattccagaaaataataatgtctgaaaagtagaggtcttttctttcacctatgcacaaatttgtcatagttaatatgaaattactttgttcatctgacccctatcaagtaaaaacacatgaattaagatcagcatgtaggtgaaatgcacaagaaattagggccatcttgagaggactgtcatctagtatgaatcacatactggttgaccattctccctccaatcccatatttttatggggttatacttaatacgaagaacaagtgattaatggagcattaatcacagaagtctactgactaaaaaggactgaaaattctgagccttgcttcagtggtgatggtggtgggaatgtgggaacaaagttgctgcacaggtaatccctagttttgatccaaagaaatagcagccaagcagaaacagacagacagacacacgcacacacccctcaatatatattaaaaagtcaaatttcattcagtttctcaagaaaataccaagaagaataagacagaaaatctctgttcttagtcttggccactttattctccacatggacaaccactttgcatcaaaagtctctctctacccttactttcacctctaagtcttttctccatcccttctatcccttatgggtacttttctttcctccctcctcatttttcctgtctctagccccttccttttacccaagtgaaattttgtcacttttgagttcccctcccctatgatcacttttccagttctatttttcattcccccaattccacactacccaagttttgacacctagctggcatgaagagagttcttagaagaaatggaagagaatgagaagaagaagtcttttctgtgatacaagaaaggagaaggccatgactactgacatgaaattaaccttgtcccaaccacatacacgtacacctcaaagctttgtaaaccactggcaaataccctcttattatctcccctgccccatctcccctttcttttaattttttggttagttaccaatcacaggagttaacttcctacatagagggtagacaaatcagggcaatctatgatctctttaggtccatggatagatgttcacccccaaatgcagagctctgctaaatacatctttcagtatctctgccttcttagatactctaagctataactctactttagttttagggtcctttttgcctttttctggccagaacatattgcttttatatgtcttccttttcatcttcccaaatgccctaataccagcttaggctaaatgtgctactggtataaaatgtatctttctccttaaaaaacaccaattattctcaacctctgggatccaaagcatccggaataggggccctcttcaataataatcagtgagtgagtgatcttaaaagatatgtggtttaggaagatgaagttaagtatttaaggtcacaaatcaagtgtggagtggggctgcaacccagatccagatgttctttctgacatgatctctcattgtcttttttcttgtattaatcagttgctaagtcttattatttcttcttcataaaaaagctaatgatcatcttattgcaacaccacactctctataccacaactatatatacttattttggaaagctaagattattcaagtaagactaaacaacacataggaccttcaaaatatgctcctaatcttcccttcttgtcttcgtttctgtctcctggtcccagttcctcccaactttatgtatgcatgagtcttttcatgatcttctctctgcctagagtttactttcacttcccgccaggaaaaaaagaataagtaccctttttaaataagcaaactcaaatattatttgctccataaagccttcccaatatctattccatgagcctttcccaacatctccactttcctactaacagatcatatatcctgttgctttaaaattcctactgctttcaaattctttcttcttgctagattgtgacatgcttactggcagaatccatgctagatactgggaacacaaggattaaaaccacaacccttgtactcaagaggtttccagtacactagtaagtcaaaaatataaacaactacggcacaggtctgatgtagaaaacatatttctatttaattgacttgaattatagttgcacacattttgtgttgtaaccaagattatgttacatatgataatttaagtagccaaaagttgactcaggttgagtagagaagtaaaagcacataagaaagagaacaggaagaaataaaactgtaaagatgtaatgggagagaaaatactgagttaactgaagtaatggcttaatgcagaaataagacgtttggggaaaggaagttgaattagttgaagacatttttggtaacaagagtcatgaagcctacagttgccagaaataaaaaaaaaaaaggactgactatggagtatttattaaatactcatactcactgtttgaagtacaaactaagaggaatcagaggatcaaagtggttggttatgacttgctcagctagtaactgcaagtgccaaaattcaaactgtggaatatttcaaagtccgccctttctaaattcaattttggcctaaatccaaggaggtagtgtccacagaattagctagaaattacttatttcctaaaagatcaaagtcccaaagaactctgtatgatttcaaggctgctcatatggtaataatggatacatttcacttcatagtctaatcaactaatagactttaggacagtgaatatgaatgacatgaaggtgccttgagaaccatcaagtcctacctcttattttgagactaattgaagatactgaggcccagtaattgaatcatatagattgctaaaagaagttctgagaagaaatgaaatacaaaagcttggtttctaaggctgaatatcatgagaaactatcatgttatcctgtgtgagtgagctccacgaggccaggtatcttgtctcttttatggtcaactgtatctccagtatctaggagagtttatggtactataactagcacatagtgagcacttaaaaaaaatcaggtgctcaaataacacggtttagtgaaggaattaacgggttcatatatgtgaatgtgtgtaaagtgggtgcaagcatgtaattaaatggaaaactggtcatatttagttagatgttactaaatttatttttatttgccatttggatcacatgattttctcctttaaacatcccagtgacattataaatgtcttatgtagcaaggtctttggcttcaaatgccttcaccaggaattaagagtttagtacaccatcaatgaatagaatttacaaagtaccctttgggcagaatcattaaggaattaaggaaagttttttaacatattgagaaataacacaaaaggttctgaaaataaaggataatatgaatatttcatctttgtcttagttttggggggtggggaacacagaagcaatatttcatttctaaaaccatgttcccatgaagctgagcagaaggactgcttataacataattttccagccaaattcccaaagggcccccaacaggctttctcaatttgtgggcgctgtcctctaacaatctatttctttccagactctccttggaaaccaaagatttatgtcattctcttcatattttaaaatgaaattgttccaggttaaagaaattatgaaaactgaaagcctgtctttatccaagaaccaacactgcctggacaaataacttatgaatacatcctattctggaggtatcatcaatgactttgcctctgtagcactcttaccattatttggacatttccagaaatcaagatccacttcagtttgtgaagatgagctgtgcttagacataggcttaaaaagaaaaggtaaataaatattctgtcaggttatatagagggaagcagaccctcccttttataaataacgtatacatttgcttaaactccagagtaaaggaaaaatctcatggactgaaaacattttttaaaaaaatgaatattcactaaacaatcctgaaatgctttttgctctctgaatacattcaaacaagtagatatcacagcatttcattgatagcttatcaaaccacagaatagaacaggaggacagaatacaaagggcattcttaagggagcaccatcatgattgttctgtaaaaacatatgaacatattgctataaactcatcttcacaggaagtcacacagcttaataagcacagacctgcaagttaatattaaaattcactttgatttcagcagcagcaaagctgatccaactaggagctattacataaaacccttattgtcatattcgtcatcaccactctcaatagagaccactgccagcaccaagaagccagccctcagttcacctcaggaaacaggctacacagacggccgtcccagtaacaatgcagcagtgagatggccctgtttattttatcagaatggcactcccttaatttttcagttctctttattgatgtcctttttcatgtacaggtctattagattctacttcctttactgtcctcccaggaattggtgcttgccaactacaataagttgttttgacaacttgtctagctatacaatactctgtttccttccctctacagtctttttggcttcaaatgagtgccttcaaaatatagcagagactatccaaccaaactatgctacaggggggaggagctttctatgtgtaagcaatgtcctgcccaaactacaatctttcatgtgctcatagtcctctttcttttcctatttatttttatggataaatcccccttgctatcttgtctactcctatcttaataaggaatgactgccgtgactacccccatctagctatgccattcaccgccagcacctctgctctcctcgtgtgcttcaagaagaactgattagcactttgcataattaacctgattagcactgtgcataatcaaactgattagcactttgcataattaaaaagaaataataataataacaataataagcactaagtaatatcaaaagctgttagtcccacagccctttggttacctccaagattagttcagtgcagcatattttgcaccttcacattgaaatcttttctttaactcaaaagtcaagaaaataaattaaaatgcttgcaatccacagactcgttatggttttcatatccataccagttaccaaaataatcagtttcttacccatacacatctccctcagtttgggtcttacatattttacccatgttaaaatggagaaaatggggatataaaaccaagtgaatgaaaaatatttagaataacattagaaaacaagatatatgatgcgtatagaagcatagagagagttatatagaactatataaccctcccttgtgttgcttctgggtgacaatgaggcatgtggaaagaactggacaacctatcagaaaaacctggctatgacatttcctggctaagtgatttaactttttggaacctcagttccctcatctgcaaaattaaaataataacaccagttctgctacctcaataactgtaattaaaataataatttaggaaggtgctttgtgaactgcaagacactttacgtacatgaggtattccattctaggtccctaaatctcctatcccccaaattttatttcacaccatggacaatattatacattatgaataataaattttaggctcagtgcagtggctcacacctgtaaccccagcactttgggaggccaaggcaggaagatcacttgaggccaggagttcaagaccagcctgggcaaaacagcaagatccccatctctacaaaattttttttaaaattagcggggtatggtggcatgcacctgtagtttgttttttttttttttaattttttattctcataggttattggggaacaggtggtgtttggttacatgagtaagttctttagtggtgatttgtgagattttggtgcactcatcacttgagcagtatacactgcacacaatttgtagtcttttatccctcacaccctttccccctggtccctaaagtccattgtgtcattcttatgcctttgcatcctcatactcagcaggctgaggcagaaggatcgcttgagcccaacagttcaaggctgcagtaagctaagaaggtgccactacactcctgtctgggcaacagagcaagaccccatctctaaaaaaataagataaaataaaaatttatatttataatgccttaaaattaaaaagttataaagtcctgttgcatgctttgccttatttcttattcagggctgaatgtgactaaaattttgacttggagttaaaactggactctagtaattattgtttccatcacagctctcatttgtgtttctgtggaggttaaaatcaagctgttgctggaaattcacaagagaggagaagaaaatctagtacattactattaatttgggactacaacataagagaattctgcaactctgcttttctccaccctaccatagccaaccatctgttccttaccaacttcgaggcttagttcagttccactttcctccaagaaaccacctatgatacccatagattggaaattctctctttctctctaatgcttccataatattttatctcatgcttccatagtacagtgtactatttattaaatatgtgtatatctatctgatacctttagtagattagctgctcctaaacagaactatgctgcctattcatttttgccccagaaatagctgccacaataaataatgtagtggtgaacactcaacacctttgttacagttggcttaaggaaactggatggtaaactatttttttcactaggcatttactatataattgctaaatgcaagcctgagaaattgtttcaataactatatgctagagaatacaaaggtgtttgacatacccataactacttaatcaaccattaaaaccaaccattcatttattaaaaaatagatagaagtgctagtaaatactaggcattgtgctaaacactgaatacagcattgataaagtttaaaaggaactgttggttcctctcaaggagcttatagtctaggtctctattaagaagttcatattagagaggctggagtggagtagtgtggaaaggaaaccttaaaatagcaagatacacatcatggagccactaagcctctatcaacctacgggaaaggaacccaaataagcagtcagtgttcttgggcaaatcattcattttacaattcatttaattcaagaaggaaaatgctgctgtggagattattcaagtccaaatgttcctggtgaaggtgcttccagtaattctgggaaagaagccaatcccttagttttatatgtaaatatttttaaaacacacacatatatataagcacaaaagaaaggtcaggaagacgtaagtcttttaaaaatctattttaataattttttctataactgtccacaaaagtttgggctttttttgtagccttacattttcttttacacaatacacctgcttttttttctaaactaaatatttcttccatctaatgactctctttattagacagcatctaatttgcatacatttacatacaatttaactgctagcttgtgagaacaaagaaatggctctgtattgtactgaaggacaatactcagtaaaggaaggtataaaaaccaaccagcttggtgactgtgtaagctctttgtttcagatataccaggctccctctttctcttttaacataccatttaaaaggggcaaaaattatttcatcaaacaatgaaaaaaagaaacagccctactttgtttaactgtccatttcctctccagtttggttactacaattcaggggtccaagttccctgaatctactacaatttcctctattatatttgatagatttaatccctttatctatttttgtttcgtgtctcattcctaaaacaacctgggattccactgcgataaagctctgttctgatgctaatttgtgctgccatcggccttgttcccaagcagacagggtagaatatggcatcatgctctccagtgaacaatgcatacacttacccttaacaggttaatagattttattgagactttgggtctttatcatatgaaccagctcttcaaaaagaaatggttttcagcatctactggagagatgatggaaaagaagacttgaatatagggagggaaatggtaaaatagatgttaggggtaaaagagtacttgagtcaaatgtttctccactcagcaatgctatccctttgtaagtctccaaacctgcatgactcttggagaattaaaaaaaaaaaaaaaaaaaagaactgaaaaccagggacccttgactctcctttgaaagtaaattcacatactctgtgatacggggtgagtcactatgactcttctctctgtagctctcatccttgacacatggaaaaggagattatgtaaagcaatcttgaagaggtttgttcagtgttttgtaaatattaacaattattgaaaacacacaaaataactaataaagctgcggtcacaaccaactgaaaataaacactaggctcattcaagtttctgaaatgccatgtctaaaataacacacaaaaaagaaatatggtacacaaaaatgcttcaagattataacaagctatacaaatgtaaagcaggacataagggcaaactgaaaattataaagccaggtacgaattggcaccaaagcctcgatggaattatcatccgtatctgggtgctgcaaatggtcatgggagatgcatttccttggacatatatttaacattattaatttggcctgttttctgcatctgataatgcaaatttacaattttagtgacccaaagaagtgtgaacttgtcagtgataagtgaagaaattctaccactctgtggggctgcagaatgcccacataatttggaacctttagcagccaaacagattgcacaatctcaactagcgatcttgaagcatgtctgattttccacctggtgagaagaagcctgagttatggggactgtatgagtgctggagtgctggcataaaccaactctgccaacttcttaacccataaacaattatgaataatgatccaaacagcatttaaaagaaataattagacactgcactttaaaaaaaaaccctcagtagtgactaaaatctagtcactggaatgagtagtcaggaagttgttgatcctccgaaaaccacggcttagttctaaaaacagccttaaattgcagagaacctgaccctgaccttcaaatcccttgctccatgaggaaatgagactaccgcctcctgagtgctatagtgtctgttctttcagagattgtcagtaagttttacaatacaattcctgtttctgaggctcattagatcttccttatttatacggatttgaggcagtacttgcttttgtgtgatagaattatctgttggtatccgacgtcagacctattttctacactctaacatattaaattctgccttgtttgtttctaaagcacctcttaataccaactcagccaacatcacctgtgctggaggtggttaagatccacctccccaatgcatgttaccacggtgacaaagtagtgacctaatttacacacacctgctgggttaattgggccaaaatgaaagatgatatatatgctcaaaatccaaaactgatttttttcctcaaaattaaatatttgattttttaaaaattagcagtttctaaagctaagtaacatactccaggtgtgcatttgccagttaatgtaccctgaatgtttcatgacacttgaggagcaaaatatattgagtgatgaatacaaatcttttatgtattttctgtgtgcaatgattagtatgagtaagtggtctcgatcactgaatacatggggtgtgcttgaagggtcaggccactgccttaaagcaaacagagacatctcaactgtgccaagttagcacgcagagtccgggccgcctttgaaagtgcaagtttgctttggagaaagctgttctccatagcctgaggctgcctgcaacatctcttagacaaaaacatcacttacctctgcttgacctcttcccacctctttgtattcattcttcccagaccactgagagtttttctttgaaccatattaagttttatgccaagaactgatgaggatatgaacaaatagatactttcagagactgctgggacagacacagcaatgtgtaaatggtatagctaaatgtatcaaaacccttaaaatacatatatctttgattcaattattacacttaagtatttacctgatgacataatcagggatgtttataaaaaagattgtcacaataatattcattgtaattcatgtttactggagaaaaattggaagcaacttacatgtccaaaaattagagatcagctaggtaaattataacacatccattgtatggaatactatataatcaattaaaaaaatcatgtcacaaaaaatattgacagaaacaaatattcataatatattgctagttgaaaaatcagaatcataaccttgcataatcctatgttgttgcatgcacacatacatatacacaccaaaatattaagaataactttttctttaagtggtaatagtaatatcaatggtgattttcttgtcttctttctgtctttttgtgttttccaaatagttttacactgatagcgtactacttttagaaaggaaatataaatatgatattaaaaataaaatgaagagtaggaaaaaagttaaatgacatttcctaatccctctctcctacttagatttcacatttcacctatatttacttctctccttgtcaactacagatgtaaatataatagatgttaaactggtcaatgttcttttattactgaatattcaacttttctagctgaatggatctttcacttatttacaaatcttacaaagatgtcagtcagcacaactcttagaaagagtctccaatctgctttttatgcttacaaaaaccatgtgaaataattgccttttaataacaatgattacttgaagtgaacttttcaaggtacaaataaatctatttatcaccaagctattgtgtcccgcttaaattacaactttcacattttgatttcatttgtacagatatagggtcttactgataagtaagtgcttttgttaagtaaataaaattagtattaccatatgaactggatttgctgttaaaagtatctcactaggggtttgatttattctatgatggtttcactgatttaatcattgcttaaattagcaaaatataattatatatttttataaagaagatgttttcttgggattttcctatgtcaccaagaatagacatcagggattgataagtaataagaaatgtcaattttaaaattacatttcttggtctaatatgctttctttttaccttagtgatgatcgctgccttcctaaaaagttcataaagcttcagaaaaatctaaaattcatgaaatttcaaagaattaaaaaaattggtgcttttatttcaagtgataaaattaaactttattttcattctcaaaaataagttttggttgaatcaaagatgtaaatattaagagactaaatcataaatgtgctagaagaaaatctgagtaatttttctggtgtaagaagttttctaagccataaaggaaattattgaaaaaatgaaactacataaaaaatttttctacatatacaaaactcaaaaagcaaattaataaccaagaaatatgtctaacacatactacagaaaatttattttccataatatacaaagaggctatacaaaccaataaaatatttttaaaaactcaatagaaaaatacagaaaagtattatagccaattcacaaaaaagtaaacaaaaatgtaaatggccagtgaaattttaatatgttgtttaatctaactcctgagtaaagaaatgtaaatcaaaacaatggtgaaatatcattttcacttttctgattaggaaaaatttgctaaagcccagtactgatgaggctgtgagaaagcaggaattctcatataatgttgttacatgtgtgtgtcagaaaaatgtttttgaaggaaaatttttaacaggcatcaaaattttaattatataaacatatctaagaaagtatgctatgtggatattaaaataaaaacaaggatatatttagaaagctgttttgtaatatttttaaacagcgaagaaactgtaaataaccaaatttccataaataggcagtggttaaatacattttgtgacatccataaaatggaaatattaagtagctgtttaaaaagaggaaaaggtaaaatataatataccaaaatataaacactataaaatttctagaatatataaaatctctaagacatggcattaagaaaaaagtacaaatgtatttgaacagtatgattccctttctgtttttaaattaaaggtatatagacacatttctctacgcaagtacagttgaaactttttatctctggtgaatagtgctatcagtcggtaaagacatacttttcactttatatccttgtgtaccattcaaattttttaaccctgtgagcacattttaaaaatacaaatagcagaaagattgttcagtgtaatggtaaatggtgaaaggtatatacatggaagtaaagagtactgcactgttaaatttctcattctagacttctctagtcccacagtaaatcattcaacttcactgggatttcatttcctcatttgtaaaataataattaaattagctcaaagaataatctgtaagttaccttatagttctaacagtacatattttcatgtgttaataatccaatacagaatggtggaaaaatatgtttgagacttaaatatcaattttgagcacctgtacctactacaataaacaaatctctacttggtattttgtatgtagactgtagccatgtctttatgacaaaaacaaacaataaatgtactgaaaattttggctcattgaataaactaaatattatcttaaagaccatccccatgcacaagtacctctgggtctcaatggtttagttctgccaaggtgttgaaacaagactatcaaacaaaactgatcagaaatgtattacttacatacttcactgccaacttaaagccacaaccacgaagctgacttgttgaatctaaccttgattaatgctctcatatatacaaaataatgtcaaaatatcaacattcatttataattcaggtatatattgccacaagcactcttaatatgtttttgatattggataacctgatagtgcatgctcacaagttaaaatagtaatatccatcttgtttttaatttgtggtacttgaggcttcagtataataatggccttcttccattgtgacttaatattcctatcatttggttatatatttttaaagcaaaaatctctcgatcgttattcagatgacaaattatatggtcatatctgttagatacagcaaagtctgcactgtggtatttctaagaaagcaagtagttcattccttcatttctgggttccattgtgataaggacagaaccatgggaatttccttggtaagattcaaggggtataactggtaagaatggtgtgttctttttttttttttttttttttttttttgagacggagtctcgctctgtcgcccaggctggagtgcagtggcaggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtgtcgatctcctgacctcgtgatccgcccgcctcggcctcccaaagtgctgggattacaggcgtgagccaccgcgcccggccggtgtgttcttaatcacacaccataggtacatttgtaaattaggatgtggctaaagcctactaaaaagtatattgatagatttttagtatctgtagtgaaaaaagttagattctcacatctaaaaacctcacaatttctgaaactgtcatctgactgtgtttttcaaatgttcacagtagacggcctacttccttgtgcattttttcacatagtatcagcctgggtcatggtaatactgttatctggtataacatcgagcaatgggaaaataatgtggtgaatgaacagttgattagacacattaaactaaggaaaattcaatcaaagatcatcagtttcaatgatttactaccatacatctttgcttagctatgaataaaacattttgaatgaagcttttggtgaaatttctgtttcaagatgaaagtagaaatgagaaaaatagacatcctgtgctcacctcaaatggagagataactatatattccgaaaaagttctatgttaaatcttgggctcctatgagactaataaaaaaaaataagtttaacccttcattttcagtttcagtcttgatatacagaaaaggaggaaaagggctgatactactacttgaagaagtgatttgcgaaagggagaaatgatggctcaaaaacccctgtagctcctctaacaaaccctggtaccagagcagacaatgaaattgctagggagagctaagagtagcaatgaattcaatccctccctttgtggccaaacttagttctgctttcagaaataacaaaatttcaggagatatggttaaaatttataggatatggcaaagtttaaggagatttggttaagcatttttaatccattcccaaatgcttactatggctatatttagtaccaggataaagaggaggataaactggttgcccctgaagaagcagacctcccaactgtacattgttaatagttgacagaacactcctcccttgccacagctactctaatacacacaaaccttggatgcacaactctgtgtaacctgtaatgatttagagattgcatttcttgtacacaagatcttcccttgaatggctccttcacgtcattcaagtcttataattcaaactttatttcctcagaaaggacacctacaccctgcctccggattaccagccattcttcatcctttttgttgtagttgtatgttaatttgtttagtgtctctctctcggtcttctagttcagagctctgtctctagtgcctgagatcaactgaattgtaattatttactcatgatagaagagtaatcaacaccagaaagaaatctgctatctaacaaaataatagtttcttcttttttttttttcggcaacagatacaagacaaactaaaacaggttaattcaattaatgtgttttgggtgcaaatcccagtttggtattatcaaaggcatattttcacatttaactatattatcatttcagggattacttaattttcattttcatttctatttcatcctttcttttctggcagggaagcctaagctcatttgtaaaatttttctgtcctctgagcatacaattatattttatccagaacagaagtgcaccaaaagagctgaaagttaaaagaaatgttcagtagatgagacctataatactggttctgattaattaatataatcactctattaattatctatgtttaaaattcaaatttatctatgttggcttattgagcattcttaaagaaaacatacttgtaatatcctacaaccatgaggtggaaagggtcagcaaatgcttccaattatatcccaattattttaggaatggtttacttcaccttctgctccctctacccactcaccctaatagtggtctgctccttacttaaaaggggaaaacacaaagatttcctgcagtttgagaatcaacttgggagaaatagaaaaacaggtgtctgagttgagcagagctgagtttagtcctgtgtcagccatttactagctatttaaagttagaaattaactttctgagccttgggcttgctcttttaatctagacctggatattcatgattccagtgttcatttaatggatgtgtatttgtacgtatggccatatccatagttctctaataaagacctggccgatgctaagcagagaaattagacggattgtgatctcaacatgcagtcatccagcacaatacttttgtccatctacgacactaaatttcaattgtatacttggcttatattatctggagatcattacgaaaaacattttctgcaactcttgatttacttaggtcacaagtaaagttatgtgaaagtaccatggactataagagtatatttggcatctcaacacacatggattgacagaaaagttggatgataccaatgtcagtttttagttctgcagtccatctgcagagttagtgactgttggttacctattctatgcctcaaccttgtcatctataatgagaagtttcagtagtttaaaaaagtatgacagaaaatgattcataattccatgaaattcataaaaaataccaaggtgctaaggctacaagtattctaaaaacagaggacaggataaactttgtcaaataccgaggggaaaaataattaacatgttagcatatgtcttagtctgtttcctgtcgcctataacggaatacttgtaactcagcaatttataagaaaggaaatttatctcttatagttggaggctgggaagtccaaggttgagggagcaaaactggtgaaagccttcttgccgtgacaacactctagaatcctgagacaacgtaggacatcacatggcaagggggcagactgtgctagcgcaggtctctctttatgtttctataaagctaccagtcccattcccatgataacccagtaattcattaacccaagaaaagactcatccattcatgggccctcatgacccacctcttaaaggccccagctctcaatactgccacactggggcttaactttcaacatgagttttggaggggacaaaaattcaaaccatagcagtgtgtaaataagtcttccatagatatttactaccaaaaaataacattactctctatagtaggttgaatgttgactagagtccccaaaatttcatgttcacctggaacctcagaatgtaacattcctgggagatacggtccttgcagatgcaactaattaagaaccatgagataaaatcatcctggatttaaggtgggccctaaatccaataactgatatgcttttaataggaggagaggacacagagggacacatacagaggggaaggtgctgtaaagatgaaggcagagtttgacgtcatagtgccaaaagccaaagaataaatgggaccatcagaagctggaagagccagggaaagattttcactgtgagccttcagagggaatgtggccctgctgcattttgatttctgatttctagcctccagaactgtgagagaataaatttctgtcgtttttaagtcacccagtttatcataatttactacagcagccataggtaactagtacactttccctgtactctctaggactaaaacagaggaagacatacagaagttttataagtgtaaatagtgatctcaaagcccccaattgataggagcacataaggacaaataaaaatcaatgagaaaacttaagaggttgcagtgatggtttctggtagtagtaagcctcaaacgaaatgtactgccctctatttggagctgttccctcttaaatcaaatgcagatgccctccaaaagtgatgcaacatcttctgatccaatcctttcaagcaagccagaaactgatcttaacgtggaattggtcattaaaaaaaaaaaaagaaagaaagaaagaaaagaaaattaataggctgggtgcagtggctcacgcctgtaaatccagcactttgggaggctgaggcaggaggactgctggagcccaggagtttgagaccagcatgggcaacatagtgagacccccatttctacaaaaaaaaaatttaaacatctgctgagcatggtggtgcacacctgtagtcccagctactgggaagctgagatgggaggactgcctgggaggttgagactgcagtgagccatgatcatgccactgcactccagcctgggtgacaaagtgaggcctttatatttttaaaaatccaagtggtatattgatgtaaataattaatatcttacaatgatatatgatcaatagcaaaagtatactggaaattacttaattggacataaatcagttctcaaataaaaaattatttatgttcctgaagaacttgattcagagagtaaatatacctatttttcatcaatggaaatttaaatataatatcagtaacaaatttacatagaggaaaatcaattttattttggtctagagtatatactatcatgagacttggcaaagaccctaataagtatacagatcacggcttgaggcatcagatcagcatgattaaagattatgtttgaattgtctcctgatatacaaaattaaccatttcttaagtaatactaaactcagctatcctatttgctacacaaatttaagccattatagaagcaacattttagttaattttcaatatctctatttactttctgtgcatatttttatgtacttacacttaaatcttaactttcagatagtcctaccttatttaatttttttacctttaaaaagtcataacctgtggtataatcttcttttgatatgcttaacaaaatataacaatgaaatgtagtgtaaaaagtttaaatacttttaaaaatatatttttaaatagcttaagaaatatattttgaaaatatattttacacaaatatgaatgtgtgaaatatctattcacacatttttaccctaatgcacagaaatcctttcgtttagaaaaatagaaattgtattcataatttcccttaaagactctcaaaaccataaggatgatacatgcagatattaactattagatattacatgtttaaagcaggaaagaatgaaaacgttaacttcctagaaaactgcaaatatcaaattctttttcttttggttttttaacttaagagttgtgcattaattactattagtaattaattagtcaccaaatattctaaaggtgggaacaaaaggttcttacaactcagagatgaatctatttatatttgactttttttctcagacactggtctcctaacactttataagttcaataagatgtgaatatagataattagggtattcctatataatcaggtagaaagtgaatacatttgtgtcagtagctacaataatttgcattaaatgaatgagtgaataaaaaataaatcataaaaaggcactgtttgggattggtataaaacatttacttttaatacataaattattaatattaagcagttatattacaaatgacagagaactgttattgaggtgcaaataactcaacagtaaatattagccatgactaggttatagggtgtttctggaattcttgcttctttttagattagtataatgctctactcaaggtgtagagtaaatctgcaataactagagcaaataataagtggtagaaaaaaaaggatctatacagaagaccatattttattacatggtttcagaatagcattatgattatgatgactaatgagaggaggaagaagaagagatgtttttaattttaaagtgctttggtatgttgtcatctctaatttacagatgaggaaactgagcgtaaaagcacacgaagagctgcctatatctcatagccaataagtgataacagagaaacttaaatccctctcttctatttctaaaccctgtactctttctactctattatattgtctctttattccctgaaaccagagatatgtattaacagtaaaattcttaaatactgcagttaaaatagaaattcctccaagccagtgttgaaagcaccacagtatttataaaaataaaaatcagcttcttaaaaaattattgttcttaaataaatttaaaaagaacaaaatcttctttgagttcccctatattcctcatacagaatcttggcagtgataatctgcaccgtaaactgtgaagtaaattgtgtatgtgaatgaaaacaataagaacctacagaaacacatgggagatctaactcggataggatggtctgagtagcgtagggacatggatgaagctagaaaccatcattctgagcaaactgtcacaaggacagaaaaccaaataccgcatgttctcactcataggtgggaattgaacaatgagaacacttggacacagggtggggaacatcacacaccgggcctgtcctggggtggggagacgggggagggattgcattaggagatgtacctaatgtaaatgacaagttaaggggtgcagcacaccaacatggcacatgtatacatatgtaacaaacctgcacattgtgcacatgtaccctagaacttaaagtataataaaaaaggaagaaaaataataataatattatcacatttcacagagtttacagtctggcggaggagaaaaacattaaactaataattatataaccacttatttatttacacctgaggtctattcgttatctttgactatgccacataattccaatctgaactcacttgtatgcattacttagcttggcgatgcttgatgttctcctttctatttccttatgtcctatgcttcatgtttttttcaaggcccagcttaagttcagcctcttcccagcagttcacagagatctctgcctccactaaatatctttagcacttaatgattctttttcaacaatggcaaatgggtttcctattacatgaaacttccaacaattggtatggctgtcaaagtactgtcttcagagggactctgaggtcaagttttggtgtagtgacagagacagccataatggattagtgttgtttcatggacagtgaaggggagacaggggatgctgaatttagaacattgacttcacaaatagactgcctaacttaaaaaaaatgtttgtagcatttattttacaccaaatccaggtctaagcatgcaatttgacactgagagtgccttgttttattttttaaaaaacctgtatcatgtctcctcaagtatcataagattcttgcatgtaatacttctctatgctcacagcatgtagtcatgccttgaaacataggcatttgctgatgacaataaattaccattttagaattcactcttattactattgtgaactccatttatgtcatagcttctctcaaaatattatcaatattgaacccattttagaaaaactttgtaacataagctataaaatgtaagtaaatatattgtctttaccatgaccagattcaaattcaacattaggatattgataacacttaacgattaaatatatacctgccaaataataaaatgaaacaaagagaagataactacttcttaaatgagtttaaacattttttaaaaatccagccaggcgtggtggctcatgcctgtaatcctagcactttgggaggcccaggcaggtggattgcctgagctcaggagtttgagaccagcccgggcaacatggtgaaaccccgtctctactaaaatacaaaaaactagacgggtgtggtggcgggcacctgtagtcccagctactcggaaggctgaggcaggagaattgtttgaacccaggaagtggaggttgcagtgagccgtgatcgcgcctctgcactccagcctgggcgacagagcgagactccatctccaaaaaaaaaaaatatccaaatctgtgtatttcaaaatatattttacatacttattatgtcctaaaatttgtatctctcttttagtatacttcattttcctgcacatagtaagtgttgaagaaatccacagtggttagtttagaccttattttagagagatagctccattttacattccgtcttgctaaggaagtgtattcatcatattccataacagctcacagtttgttatacattaactgcttattctctgtgccaataagactgtgctggaacagcaaataaatttggtgcattcatttaaatgattctgcaaaccacaggctacccagttgtctaatgataagagagccccaaagccacctgatcaccattatactcccttatttttttggatttgcatggtcagtactgtcaggatctgaatacagagaagaatgagaagtaaaagtatacctcagacctaatcatgaaaagggattttattaatttcggcaccagtgatgatgtggctaggttggaaggggaatgggatataagatctggagtgctttatctgctccaagaccaatgctggttttggcacttctctcactctagtgagttgcaaaaaaacaagcaggtgctagcaatctgagagaccacatgccagctacagctgcttcaaactgattcaattacatctgcctgaatagtcccaggacatcaaactagttgaagagatccataggttgcaaggagactttgtctatcctgatggacaactgtctctgagataatgacctgcaaatttccaggttgtgatataaagtgatcattccatcaccaggcataagagaaaagatgggggaatgcgatgttttattcactttaaaattaaaaattggttgtagaaagcacaaaggcctctttgaatttaaatctgaaagtcactgaggccttatggataccttgaaacagcccaattttgtgagaacatttcccaaatcattgggtacagcacatttacagaacatgctcttgggatccggacttcgctccaaaccttgtttgtacaaaaaggggccaagcagctgggaaattctggagtggagtgtgtcctcattagttcccatctgccaccagaactcagctcatggcaagtttggctaagtcctggtgtactcaggtccaaatgtgggtcagttttaattacactatacagaattcagtgtgcagttttaaaatccttattatacagcacagaggaatgggcagctctccagctaatcaattttttaaaagtacatatataaaaattttaaaccaggctagacagacagtgggtggaaaaaaatctttaaatgagtacaagggttacttaagagaattattagtgaaattgggtcatgaacaagttctgctttaaagcttcaaagtgagaaacaaactgttttcattggtaagttggaaaacttatgtaaggtacacaatgtgccttgctctttagtgtgaataacaataagcctgtggccagggtacacaacacacctacaagtgaactggctttcatgtaagcagaaatgttcccaattttgtgactcttcactccatccccttttgatgtttatcacttatggcaaagactggataaaagaaaaaaatcacaagctacctggtaaatagtgaaaaaaaaaagatgaggaaggggagggagtgagagaaaaggagagtagaaagcacaagtgctgagtagcagactctgggcatgacttgtctctcagtgccatccatacaaatgggggccagaatcaacgcttgcagtctatgttcagattccatcctgtccaaaagctttatcaggttcaggagcgctaaaacactaagccttcgaagacaattgtcagtaaaaaattcaggagtaaacacgtcggcagtcagtgattaggcatttatgcaccatttttgatagataaaatgtcccttgacacaagtcctaatgacaacaacaacaacaacaacaaaacacaaaaaccttaaatgttcaaagtatctttgggcttttgactgagtttttatcaggtttatccatttaaaagcagcacgggatgctaggttcaaataccagcattgaatatttacaagctatatgactttggacaaattgcttatcctctctgacattttgttttctcacctgcaaaatgggagaaataacatcttcctcacagggctgttgcaaggatcataaaacatatatgcatacatatattggatattacatatctatatatacatacatgcatatatatacatatacactcacataaatgtgcatatgtatatatatagcatctggaacatgaaagtcactcaataaatgttaactatcattaacccagttatgatgaactaaattttgttccccaacccctccaaaaaaaaacatgtgttggagttctaaccccaagtacttccaaatgtgatcttacttggacataggtctctaaagaggtaatcgagttaaaataatgcaattagggtgggcctgaattcaatatgactgatgtccttataaaagcagagaaatctggggacagagacagatacttacagagggaagacagaggaagacatatggagagacataggaaggagatggccatctatatgtcaaggagaaaggctggaacagatccttccctcacagccctgagaagaaccaacctggctaataaaccttgatttcagacttctgaactgtgagaaaacaaatgtctgtttaagccaccaagtttgtggtcctttgtaatattcccaactaaataaaaattccattaatcatcaatatttaccttgattcatcatggtcgaaactatacatttgatattaggcaggtctgtattacctctggtgagtaataatcaattctatatatattatctagtgatgttttcattattttaaaagaatccttttctgattgctgtacaagaagatactgctgcaatataaacagcctggcagaggaaaatggtttactataattaagatcatctagttattattaaagataattaagggaaaatcatacatataaattcataaatccacttttctactgttgagtttgcatagaaggaaatcagaaaatcttaccacactaatttccttctcaagaaaaaataaaaccttacacagcgatttatgcactgacaactatgctcactaaacctgaggctgcttagattaccaacaggaccacttttaagtcattttgatgcatatgaaagtaactcatcaagcatgggttcttcatcctttgcaagagactgcttttaaaggtatctgactttcagaagagggatgagagttgtctgggttgtgtcaacacgctttctattgcaagacatacctccataatcaacagacattgaagtgaatgtgagcatccccatcttaagtttttctttaaacagccctagccttctatagaaatgtggcatgtatagttagaaattatgagtctaattatgttgaactgagataagcaacagatatcacaagagccataattggaccaaagttaactttcttaatgtatgtgtcccacacttccttgaaattcctatactactgattataaaaatttttatattttgtcaagagaagagaggaaaaaataatacacagagactactatgcaataatacataggtggtagtggtgcacaaaataaagtattttgtatacctaatttactttaatccacatatccaccattaaaaaggtaggtgttgttaccaccatactatacataggaaagcttgaggcttagtaagctctgccaacctcgatgaggtcgcacagctactgaataatggagctagacttttggtaaaggtcagtgggagggaatccaaagctcctaaattcaaactcaagcatgagatttacaatccagatatcctaagtgcatcactgggttccaagatggtgatttatttaaggaattcacaggcgtgttgaaagcatttgaactcacataagcagtagatgtgttcttgctaaacctaactcaacttattctccttatgaggaaatcaatgctattcacaaacacaacctaaaaggctttattcaatttaaatgaaattaatcttattataagaacacatgaaaatggaattaccatacaatctagcaattccacttctgggtatatactcaaaagcattgaaagcaggttctcagagagatagttgtacacctatattcatagccaaattgttcataataattaaaacatggaagcaatccaagtgtccactgatgagtgaatggacaggcaaaatgtggtatatacatgcaattaattattattcagccataaaaacaaggaaatcctgacatgtactaccacatggatgaatgctgaggacattacgctaagtgaaataagccaaacacgagaagagaaatactatatgattccacttatataactacatagagaagtcaaaatgacagagacagacactaaaatggtggctgccagaggctgggggtgggagtgcagagggaaatgggaagttatattttaatgggtatagtattttagttttacaacatgaaagtgttatatagagatgtattgtggtgatggctgtgcaagcatcataaatgtatttaataccattgaactgtataccaaaaaatagttaagatagtaaacttcatgttgtgtgtatttttcccaaatacaaaaatttggggaaaataataaaaatatcacatgaaggtcttttagattcagtacattgcttcatgatttttataatatcttctaaggccagggaagcagaggtaactttgtatagaacctctgagtacaatctatgtgataatgcccaaccaggatccctgctcccaggcaattagatgttcttttttcagagtctaaactgcagtagtggtgatggcgagggaactggtagtgatagaaatgacagtagcatagctaagatttcttcagtacttgctatgtgccaaccagtggaccaagaatcttacatgtagtgtgttattaactctcagacaacagatactattattttcccagttttacaaatgagtaaacaagggaacagaaacattaggtaacttgattgagaccatactaataataagtggtgaagtcaaaaagaactctattgatatatctttgtctctcactagcctgtatcctcttgagaacaaagattttgttgtattcatctagcctagcacaatttctagcaaacagcagacatccattcaccatgcagaataaaaggaaatgaggaaaggagagagggaaagaagggggaaaaaagaaattatatctagtcatgctatgttcttaataaatgtggattttctttctttatttccttaaccctgaaatcgcaggggaacctgcaataatgctcaggaatcctagggcataggaattcctccctctttgagattccaggctaattcctgacacaggaccctcaaaaagctgctaatatctgtctagtttaatgattaatattctagcaaatatatattcttggctcatctcctaatttctaatattgagactaacagagagatagagttcaatctaccacactaagattcactggaaaaaaccgatgtctttgatattggcctcttgcacactggtgtgaactgaggtaaaagaaaaactgttcccagaggaaaggtagttccatgcctaaaagtacatgtgtcataaaccagtggtactaaaatttgagaagcctaaacaaaaggttttaatgcaatagataactggcttattatgtaaactgtgccaatcttatgtgacgggcttatgccacacaaaacggaacattagaatgatctatctaaagcaagtcttaactgttctattttgactctactcttgcttggctttacctctatttataattaaaatttagtgagtcatagagaccataattataaacatgtatacagtaaacacagggtccattacttttgcttagaaaaataattacagattttttaatattctgatcttaactgacccaaaggaattaaacacacattttatttttgtgttttagtgagatagagatagggagggagaagcataagccagtgctcaggaaagacgaggcattaaccatataacatagatttgtttatttatgggctgcaaagtatttccaaggtgacaagtaacttagccattaatgcctcagccttatgtgtataatgggaataacatacagacttcttgtaataagtaaaagttagtttaaagcacattgcaaatagtgttatttcaattattcattaaaatagtcaaaaaggatcagttcttatacattaatttctcattttaaggacagaatttatcagtattctcatatctatgtaactggcagtatgagaactaaaggccatcaagacttatctaaactgtataacaagtaataagattttaggacacaatccctctatttctaatacaactccagaaatgttttattcataaatgcattcattcaacatttactgatcaactactatgtacaaggcattgtataagaggctgtggcaatcctctacttacctttgtactgtgtttcctacttccaaagaggttaaattaataccaaagtgatttgttaaaaatacaaaaaaggattccaaatgggccaataaaaggaaaagacacaccaactctaagaccagatttatgttactaaataccgacggaaactcctcagcatttaaaagaatacattaaggagagtaatgcaagtcatttggatgttttcaatatgagaaatttgagcctactgaataaattaattaaatatctttaatattgagttgcagctttttattgcatttatagaactttacctattagtaaaatatacaatctataatagcttgtctatatcaaaaatatagatatctgtcagaaaacatacaaagccacaactaaaatacatttaatatcattaccagtaacatttgtgaaaaaataccaagcatctagcatttgttaaattaaagaataatattccataaaatctacatctggattttagcccctcttttagaattactatttaatcttcactttttttctctctcacttctaccccaacagcaacagaaacacatgcacaaattaaggaattatcttacaatatacccttaaattttctgaatatgccccatgtgtccactaatagccaaatgctttcaaatctgttcagctaaatggatcaataactacatccagcctcacatagtggggctgccaacacggtgaaattgagccaaacacaaaatgtctctaccaggacaaaaattattatcaacccagttatctgaagagatctactctcccagatattctttcgagaagttggcatacacattatctagggcagtcaacagctactaaaaaaaaaatatttgagtcataaaacagaggatttaaagaaaatattcagaagctaaaaccagtgagttttagaataaaccaatgtaacagttcaaggtctacatcaagtaagaatctttcagagtcagagtacacaaaacacgtaagagcacaagcacactgctaacaagcttctctgtgctctcactcatatgacacagctgcaagcaacaattgagcaggtgcaaccaagcttttgagaattcctgcctgttgcccaggaaccacaacactgcatggttgagattttaaacaggtgcaaacatttttttttcccattcgtctagtgcttgagacagtggagcagacagtacatctgcaaccactccatacctaaagcaaccatcacagaaaataaactcaaaagcagcaaaataaaaaaaagtttaaataaaacaataatggcaaaactgtggttttgcaatggtctgaccccacatcaccgttcactttaatagtacaattccataaaataatctcttcaccagatgaatgctttgtaattaaaattatttgccttatcaaatcttagaaatgtttacttgattcttacaatagaataaaataaaatatatgtataaaatgtactatcctttgaagctgtcattatctgtaagtaatcaagaattaacatttttacattatgaaatctataagcaattttaatacataaaaatattataacttgttagttaatatatagatttacatagttataggtaattcatatacatacctgtgcagctatggggcacaaacttgcaattcatcaattctgaaatgtaaaagaaatatataagtaaaaattaatttactaagttggaaccagtatttatgttgcaacaattcctgcagagaagtaggaaaagtttcagtgcataaagaggtaaattattttttatcaatattttccctataggatatttcatatatctgaaaatatatacacacacacacacacacacacacacacacacacacagagtcccttagcagtgtatcataagcactagcaagggactctgactcaccatggcctctgaaactcaaatgctttcactagaggacgaggcaaacactttaaaatgatttttttttttggtattcttccaagactattgccttcctaatacaaatatgactgctgctctctaaaatgaaactactcagattcatctgcactcagtttggatagaatgttgttaaggaagaaaggtgcttttgtagagcagtccacaaaaaaatgcatgaataaatgaaagtaaactttgaatgttcgttaactttgagttacaacagcaaatagaaatgaaattgattgctacaagaaggaatgctaacaccacgtcggatataatgcaaaatgcctcaactcaacacactttgacaaaactgccagcgaagtaggtattgatacagaagactatgtaagtccacattaaacaaaagtagcagtttacaattagacctgaaaaacatttggatttaggtggaaactgtattgcaacatacagcctgggaactactggtactcttaaaaatatttcctagttctagccaggagtggtggctcacgcctgtaatcccagcactatgggaggctgaggtgggctgatcacctgaggtcaggagttcgagactagcccgagattacgctattgcactccagcctgggtgacaagagagaggctccatctcaaaaaaaaaaaaaattctttttgaaagcaaacggacatgtttaatttatatagttcttctgagcacagtcgattacagcaacacattatagtcagtaagtccactttataatactgcttaaaagtatatagaggtaataattttgatgatggctcaataaaacaacatcttcgtatattctgatgggaatgtggattacaaaagactttctagaaacccactgagtactatgtatcaagaacccaaagttcaatatttttactcagtaattttagtcccaggaatcaaatgtaatagaaaaccaacagaaatttatgtaaaaaagataatttttatgacagtaaaaaactataagcaacctaaatatctaatagaaaaataattaaataaagcatagcacatctatataaaggaatatttggcaaaatttaacaaggtactttaaagaatattttaaattttacggaaaaatgcaaatttatagtattatgatgctaaaatattatataaacatgtagactaccaattacatggacagtatgaaattatgtgaataagaaaaaacaaagaacaaaacaaagaattaagagtgattatatctggataataagactttggatgattttaattttttctttttactttcatatatagttaattatctacaataagcatgacttttataataggaaaaaataatagtaggtagggtaggggtaaaaggaaaaagttataaaatgctatattgaattcataaatgtaaccttcctaagagaaataaattaattcagtcacaaataaaacccagtaactgtgcctacagtgagaaacaccctcactgcttcctcaaaggggcatagccagggtcttttttatcccagtgctttggaatctacacaagtaattcaataacacatttttaaatcatcttagtaaaacttctttacttattatgcagagtgaaatgatggcaagaataatttaggacttcaaatctcttcaacctagcacagcctaacttattcactaattcaatcacattcagtgagcatctactgcctgcatggtgctgtgtttggcactgcaacgtgctaacagataaattaggacacaccttaccctcattgagctaacaatttaaaaacactaaaaaatgtttagacacagctcacatgaagaagtaaacacaatacagttcaaagcatttgtgacagatttggtacattttaaagcaagaaaacatacactaggtttattttttatatttctgagcaaacacctatctttaggtaacaataaaaagtcatgtgtattagtatcacttattaatgcactagcaaattaagtatttaagttttttccttatgtgatctattttttgttaatggacagttacataataggagattaagtatgaaggaatagtgacccaatctggaatgcagatgtgtaagattgtctcagtttatctgaggccacataaaacacatgcacaattattaacaggctgcagttatttattggaaaccaaagcaaataagttagttactggttaatcctgctaaaagacactgttatgacaacaccaccagggaaagaaaagaagatagagcaaaccacttttgttatgcagataaaatgattcagcatagagattctctcaatagcagttcagtttcctgctggcctgtaaacataatcagcaatgcccttctgaggccagtgctgcaggattattccaatgtgaggtcaatggggtcaatctgtgtgaagtggtgacaaacactaagagaaggtaagaagctatttgtgtgatcagtgatccatagactggggctcagagttctgggaagcagtagagttatgaggtagggtggtagttaagcacttagcttttgccatcaaacaaacctggaatcaaattccagctccccatctttagttctgtgatcctaagcaatttaaattttctgtctgtaaaatggtgatcatgttactcaccctacgaggttgtctatgcaggttatatgttatagccatataaaggaactagcacagtgccagccatgaggtaagcatttgataaaagggaactgttagtactatcatagttgtatgaaaagggaaagcatgtctgtccctttaagctaaggaactaagctaggcaaggagtaaggagataaagaaggcttgttgaagacatcaccctacagtccagcagctcatccaaaagccagtcatgtgcttgatgttcacagaacatttctgaatcaggcaacactgcaacaatagtaatagccacaataacaattctaaccagcacttttaagctccattcctatgactgaaaagaaaggcagtaaagtctaaataatacgtgcagcaacactgccgaacttctctgggtgaaaaatgaaggatcactttccacatttaactgaaacaatcaggaaaaggaaaataaggacaaaatgaatataattactcaactggaattggaccaaggtgccgtgtaatggtcttagcaatcacatgtaggcacttatcacctttttatgtattctaaggagatcctgcagatgaccagagccttatatatgaggtttgcaactctaagtaaaaaaaaacgttagagtcagtttttttcttatggctgggaagacagaaatggatgcatactgatgttgttctagtccttatttgtgttttgatttaaaggacagcacagatcctgagttgttaagtggcgtgtcttcagattcccacacagttcatgtaattgctagagttgtttcactcgcattgggtgaagttactattagcaccattccagatgcagatatactatagagtgtttgtttgtttgtttgtttgtttgaagttctttttacttctaggttggcatagctgtgttctccagtgggataggtccaattctatgttacagaatacagaaatagttcatcttcccttcatactagttgggcctggctagagatgccccttaagccattaataaatctacttgctaattcacttagagtactaacaaggatctcacctgggcctgtgggtacaaccactccatagaagagctctaaacctaaatttaaacaaaaagaatttcacccatgactgaggaagcatccacaggactattttacatgctttacatttaaatttgatattttgagagaagactatgtaattcaaaataattttattttatttaatatgtatttagtccttctggacccactacagagctggatgttgtatcattattatatggttattataaaatgtacactttactcatcaataaagccaattttacttttgaaaattgaggtacctggcttctgtggtttctctcaacagaaagtcctatgaagagtaagaactataaattgtcaagtagacttgaaaaacttatgcttattttgtaaattactgagctaggtctggcccttcattttgaaaagctatctgcctataagaaagaggaagtatgaggagcacagttatctattaatcaacactgtgaactggaaacagataaagtgcaataaagaaggaaaaggaaatcatatggtaaacaccgttaacccaacggcacagttgatctgtctagaccttaggtcagataagctgtaataaagctataaaatccacgaaaaactaaagcttatttacaaaaactgcaaaatttgaattttctataattaatgccacttaaaatgaaagaatttaatatcaaatttcatgtataaacatgataaatttgaactctcaagtagaaacctcatctacaatacactaagtgttaataattctaattgtcctataatccacacttcacagcatattctagagaaaatagctgttgggtttttatgacttaacttaaacttcacaacttttaaaataaaagtttaagagctaatttaaaaatgtatttaagaacctaaaatttagaaaatattaaaaattatattttcaaaatatcctcaacttgaagttatggctattgaaatcaatgatttattctcagaaaatgtgaaaattttactggcctgcttgtatacatccctggggtcttagtttagatattatctcctccagaatctgatatcctgtgtctaatcctgtcataataatcattttattgcactggaattgtcttttacataagactgtaaacttggggaccagcatttgtatcttattcaccattacatctgtagtttttacttagcacagtacataatgtgtggtaggtaggtcttaaatattggctaaaggaatgttgcatgaattgtgttagcttgtattcttgatgattaagaaaattcacactgcataaaaaattaaggaatcacattcgtaaacaagttattcccaatctttaaaggactaatcttccaatctattttcttgtgctttttctacctatttttcctcttaatcagtacaaacttaaaatatgagaatttgagtctcaaatgttaacaccaggttagaaagcctcgttagtttggccccacattggacaagaatgagttgtccaaatcctacctgttaacagatactcggtatggaagaaactgttacacagagttcactgaaagagttctgcagttcctaaccaattatgtggttcttatactttctctaaaaaacttcttctagctatagttcctgagacagatacctccactattttattcttttgtggcatatatgacagtttaaattattggggtgattattggcttatgtgtttattatctctttctttcccactagattgtatactccatagaggccacactactttattcactactctatacccagggtctagtttagtgcctgacacacagtcaacacttaataagtatttgtcagatgtataagacaaacatgagttcaaaaatatgagcagtaaatttagagcagtagctttcaatcaagagactataaaagtaggcagttaacagctacccctaaaaagtgttttcatttgaactctgtggaagccttgatgatgtagaaaatcttttattgtaaattctgttcaatcaaaggcaaggcagaaaaacttcaaaagcaattctaggtaggatgaaggtatagtacctagaaaaagcaatggaatcacaacaacagcaaccactttcaattagaagttttgagtttgaattaaagcttactaggtatgtgtcctaggtaaacttacataaccatctctaatattcagattaatcatatttaaaatgagggggattttatataatataaaatttttatattatataaaattttatgtttttatgatgacttaatgagattatatgtatacaagtagctattagcattatctatggcatttaggagaaggggctcactattgattagttcctttaccttggccagccagcgtctgcaacaagattgagctaaaacttcatcaagtaaccaggataatacattttaggtaggaaaacatagatgaaataagggcttaaatgcagagaaaagtaagttggtgttagggttaatacataaaaaaaaatgtgtaagacagagtagcgagaatttcacagcagttagaaatggaaaaagatttcaacatgatacaaaaactgccaagaaatctattagcttttcccttaggtgacgcagtcttcccctcatataaataaaataattgctactattatagttggagaaaaatcaactgaaatgtacattaaacacgtattagagatttaacattcttcacatcatttcacatgctgaaaactcaacctttgtaaatatagccatgaaccttattatttactataataaagtaacagcatatccttttctatgtactacttgcagaagtataaaaggcaaatgtgttcttgctctttaggtgcaattacaaggcagcagaatgtagttaggctaattttttgcattttgtgctcatcagacagtggctaccaaccctgcaagaaaaaactggtaccaaaaatacttcatcggaaattctattttcatacttagttgctttcagtattcttactaatttggtcaaacttatgtcagctccctcattaaaattgttttctgtctaaatcgttatcttttctgtgtacgtatatgtgtgtatgtgtattatttggtcaatattcagacagaacaagtctgagatgcaccgcataacaaaagtaatcaccccatccccatacttctcagggaatatctacctggtaccaataagctcatcaagagttcatctgaattcatagcctttgtcaatcagaggtgataaactgtgattttagtagtctatgttccctgcaagaccatcgtcttcatgagggctagaatctggtttattttctttcttttttgtcatcaccacctagttcaggacaaagcacacaatatacaaccattggatatttcattcatttattctaaaatgtttattgagtacttactatgtgacaggcattgttccaagtggtggtgatttaggagtgaacaaaatagatggaaatttctgatctcatggagattatatatatttgttgtggatgtctgataataaatatatagaatgacagacaattatctgcgctaaggaattaaaataaagcagggaaagggaaaagtaaatgatgggattgggagttggggttgaaattttagatagggggaccagcaaagaaattatggaaagatcacattcaagtgaagacccaaaagaaatgaaggagggagttagccagaaatgccttggagaaaaggcaaaggaataggaaagagtttcctttaaaatgccaggctatattcagatagaaatgtttctattaaaatataaaggtatacgaaaggcattcaagccaaagaaataggaaagacttttctttaaaatgtcaggctatattcacacagaaatgtttctattaaaatataaaggtcctatagaaacatttctgtacgaatatataaacatcaaatacataaaagttttaaaatgtttcataagaaaggaacttagaaatcaagaagatagagctagggtatttggcattactatgattctaccacaaccctcccaggggaattatccagctcagtaataacctgagaaatttaggggtacaaataaagtttgcaataactgtaatcactgagaatggcaacctcctaatagatctggaatacctagaagaaacaaatccacttttgcaggataccttcaacaactcaggtcatgtgggagtctcacagaaaaagcaaacaccaatgaaaaagagctcatatatcaaaaatatcaaatccgaagaaaggttcatccataaatgagtcagcagatgaaaaactttaaatgaaatgtacgcattaagttcaaaatagggcacaatcttagggaactaatctgagggccaaaataaaaaaagaaagaaactatgaaaaaggcagatttgataaatatacagagatttatagaaataaaattgtcattaaaattaatatctgaagtgagaatttatcatattaaatggagctaaagggaggattactgaactgaaaaataattccaaggaatttacctaccataaaacagagatagaagatattttttaaaaagattaggagatataaatgacaaaataaaaaactctaacatatctaataagtatttaagaatgaaaaaaaataaagacaaaaatgcaatatctgaaatgatgatgaatcttttccaaaactgataaaacctcagaaaactgtaaaacagcatcaggtaggtccttcagggaatatttcagaaaaaggaatttttatcacaggagatgacagctccatgcatgttattacgccagaagaccttccagtgggacaagatgtagaggtggaggacagtgatatggatgatcccgaccctgtgtagacctggctaatgtgtgcatttttgttagtttttagcaaagtttaaaaagttaaaaaaaattaaatggaaaaaatacagaataaagatgtaaagaaaaaatattttgtacagctatacaatttatgtgagctttaaactaagtgttattacaaaaaattcaaaaagttaaaaaatatgtttataaagtaaaacacttaacagtaagctagggttaatttattattgaagaaatatgaaacttttataaatttagtgtagcctaagtgtacagtgtttataaagtctacagtagcatacagtaatgtcctaggccttcacattcattaaccactcactcactaactttctcagagcaacttccagtcttgcaagctccattcacggtattaattataacttataagcaaaagactataccatacagcatacgtgtacaataggccataccatctacgtttatctaagtacactctatgatgctcacacaatgatgaaatcacctaacaatgcatttctcagaatgtatccctgtcattacgagatgcatgactatatatcaaaactcatgcaatgcagctaaacagtcttagggagcaaagtacaactttaagttaatatgctaaaaagaaaagacaagactaaaattatcaagacattagaaaagttacaaaaaagtaaaaccaaaaaatgtaaaagctgaaacgtaacaataatactgagcataagggaaatgaaaaacaaaaatgtaaagacagtcaacaaaattaagtgttgctttttttaaatgactaataaagtagaaaaatctctgggaatttttattataaaaaagaagatagaaataaaattaaaaagaaaaaacaaatctatttggacatttaagtgattactgaatactatgaaatactttatgctaatttgacttaaatgttcaagttattttacaagtgaaataatatgaacaattttgtagaaaaatataacttgcctaagaagaactagaaactctgattcgacaattataaagatatcacatatgtggttagaaatttatataaacatacacacacacatgcacgcgtgcacacacacacacacacacacacacattaccaggcccaaatatatttaaatataaaatttaataaacctttaaaaatctgttgaggtctatgtgataaaaattggaccatagaaaacaggaaagcacctcaactcttgtataaggcccttgaacactgatatcaaacccagataaaggtattatgagaaagaaaaattatttacaatggtgaggatttagaagaggtacaagctagccaaaagacactcagaaaaagaaaagtaacaatagctattatttatttagctactactaagtgtttgataagagttttgcatatattatttaatctgtatatcagccatataagtggttttattttcattattatcacaattgtataaataaaatgatgctcaaaaaaaataaatgggctcaaagtcataaaattaataagtagcagcagttgatagagggagactctaaagaccatgtacttaaacactgccttgtactatttactcatctttcttaattatgttcacagaggacattatgctgtctccctaacacttcacccaattttaaataaagcataatttttggtttttagcagctttactatgatgttcccaagtgttgttttcttcacgtttattgtgtttagagttcactaagcttcatgtctttcacaaaatttgggaatttttaacctttcttcttaaagtctttaaatattttctctgtcctattcttgttcttcaataccctacatgagagaacaggaggtccctcagacatatacccccacagcaataaaaattttctagttatcccaaaaaaaaaagtgccctagttgaaactttggggctcaagtagggggttgtgaacactagtgacacccaagacctaagaaggccattttgagagggtagaatcaagcccacatgacagacttgccaatgatggtcccagcttcagacatggaaatagctccaacatcctgtatcaaaaacatcgacaaaggggcctggaagaagtcatgcacactaatgcctcaggtgacagtcatttgtcttggctgaggatcctaaaagggagctcccacttagctccagttcctcttggctgctctctcagagcagtcctgccagcacagggaaaaagaactcaaaataatgattttcaataagtccaatgagatgtagaaaacacaaataaaccacaaaatataattaggaaaataattcattaaaaaattagtttagtttaaatattatattccataaaaaaaggaccaaacagataccctatagctgaaaagtatgaagacagaagtgaaaaattcaatacagggcttcaacagcagactcaatcatacagaaaaagaattgatgaacatgatgacaggtaatttgaaattacccacctagaggaacaacaagaaaaagactgaaaaagcatgatgaaagtatgaggaacctatgggacaataccaagtgtacaaaaatatgaattaggaattcccagagaagacagacagagtaagaggacaaaaactaatataaagaaatactagcagaaaagttcccaaatcctgggaggcatatggacattcagattcaagcagcataaaggcttccaagagagatcccaaacaggaatgctctaagacatattataaccaaattgtcaaaagtgaaagacaaagagagatcttgaaagtagtgaaagaaaagagccttgttccatataagtgaacatccaaaagacaatcagtagatttctcaagaaaaaccttgtaaaccaggagggaatggaataatagattcaaagtgctaaaagaaaaaaaaaaaaaaacctgccaaataaaacagtatatccacaaaagctgtccttcaaaaatgaaggagggataataacataaccagacaaaggaaaactgagggaggtcatcacaagacttagaagaaatgctaaagaaagctcttggagtggaaataaaaggatactagatgataaaataaaattatatgaaagaataaaacttactggtaaaaataaacatatagtcaaaatcagaatactctaatactgaaatggtaatacgcacatcactttttaatagggttatttgtctccttattatttgttattaggtatacttttaaactttttattttaatatttttggaacacagtaagtatatatatttatggggtacatgagatattttgatataggcacataatgcctaataatcacataaaggcaaatggagtatccatcacctcaagcatttatgctttgtgttacaaagaatccaactacactcttttagttattttaaaatatacaattaaattatttttgactagtcaccctgttgggtgatcaaatactagatcttactccttctttctagctatcgttttgtactcattaaccatccccacttccccggctcctactccccagttacccttcccaacctctggtaactgtcattctactctctatctccgtgagctcaattgttttaatttttagctcccagaaatatgtgacaacatgttaagtttgtctttctgtgcctcactgacacacaaaaaagaatgacagaacctcattcttttttaaggctgaatactactccattgcatatatgggccatattttctttatccattcttttgttaatggacacttaggttgctaccaaatcttagctattttaactagtgctgcaataaacatgaaagtgcatatatatcttcaatatactgatttcctttgttttgggtatatacctagcagtcagattgctggaccatatggtagatctgtttttagttttctgaagaacctccaggctgttctccatagtacttatacttatttacatttccgccaacagtgtacaaagattctcttttctccatatcctcaccaccacccattattgcttgtcttttggatgtaagtcattttaacgggagttagatgatatctcattgtagttttgatttgcatttctctgatgatcaatgatgttgagcactttttcatataccagtttgcgatttgtatgtcttcttgtgagaaaagtctattcaaatcttttccccattttttatttggattattggattattttgtatatagttgtctgaactccttatatattctggttgttaatcactgtcagatggacattttgcaaacactttctctcattctgtgggttgtctcttcactttgttgatggtttcctttgctgtgcagaagctttttagtttgatgtgatcccatatgtccatttttgctttggttgcttgtgcttatggggtattaagaaatatttgcccagtcaaatgtcctggaaagtttcctcagtgttttttttttcagtagtgtcatagtttgaggtattagacttaagtctttaattcatgttgatttcatttttgtatataatgagagagaagggtctagtttcagtcttctgcatgtgggtattcagttttcccagcaccatttattgaagagactgccctttccccaatgtatgttcttgccacctgtgttgaaaatgagttcactgtaaacgtatgaatttgcttctgggttctctattctgttccattgctatatacactgttggtatgccagtaccatgctcttttggttactatagccctgtagtataatttgaactcaggtgatattcctagttttgttctttttgctcaggatatctttggctattgtgggtcttttgtggtttcctataaattttataattgtgttttctatttctgtgaagaatgtaattggtattttgatagagattacattgaatctgtagactgccttgggtagtatgggcattttaacaatgttgatccttccaattcatgaacatggaatatctttccatttttttgtgtgtccctttcaatatcttgcaacaatcttttatagtttttattgtagagatctttctcttcttcagttatttcctaggtatttaattttatctgtagctattataaattgaattactttttaaatttctttttcagattattcaccattgacacataaaaatgtcactgacttttgtatgttgactttgtatcctgcaaatttactgaatttattgatcagttctaatagttttctggtgaagtcttcaaatataagatcatctcatctcccaacaaggaaaatttgacttattgctttccagtttggatgagcattatttctttctcttctctaattgtactactatgacttctagttttatgttgaataacagtgatgaaagtgagcatccttgtcatgttccagatcttagggtaaaggctttcagtttttccccactcagcatgatactagctgtgggtctgttgtatgtggcttttattatgttgagatatgttacttcgatatccagttttttgagggttttttttttatcatgaggggatactgaatcttaacaaatgtttttttccagcatcaactgaaataatcatatggttcttgtccttcattctgttgatatgtggtattatattgattgatttgcatgtgttgaataatcattgaggcctgggataaattccacttggtcatgatgatcctaatgtgttgttgaatttgggttactagtatttgcttatggatttttacatcaatgttcatcagggatattggcctgtggttttctttgttttcttttctttttttttttaaatgtgtctttggttttggtattaggatgatactggcctcacagaagatggacacattccctcctcttctatttttcagaatagtttgagtagaattggcattagttctttaaatgtttggtaaaattcagcagtaaagcgatcaggtcccagggtttcctttgctgaaggactttttattacagctaccatctcattacttattactggtctgttcaggtattggaattcatggttcaatcctggtaggttgtatatgtctaggaatttactcatttcttctaggttttccaatttatttacatgtattaatagttgcttatagtagcttctaatggtcttttgaatttctgtagtatcaattgtaaggtaacctttttcaattttgattttatttatttgggtcttctatctttttttctgtcaattttgtttatcttttcaaaatgtctgtcaattttgtttatcttttcaaaaaaccaacttttcatttcactgatcttttgtattattttcttcatttcaactgcatttatttctgcactgatctttattatttatttaattctaccgattttgggtttggtttactcttgcttctctagttctctaagatgcattgttggtttttttattgaaagtttttctactttcttgatgtaggcacttgtcactacaaatttccctcttagttttgatatgttctgtttccattatcatttatttcaaaaaacttttaaaatttccttcataatttcttcattgaccaactgatcactcaggagtacactgtttaatttccatgtgtctgtatagtttccacaattcttcattattaatttctagttttattccatggtgatcagagaagatatttgatattatttcaaatttttgaatattttaaagcttgttttgtagtcttaggtatccttgagaatgatccatatgctgatgacaaaaatgcgtattttgcagccgttggatgaaatgttatgtaaatatgtattaggttcattcagtctatggtgcagattaagtccaatgtttctttgctgattttctgtatggatgatctgttcattgctgaaagtgggatgttgatgtcttcagctattactgtactggggtctatctctctgttaagctctgataatatttgctttatatatctgggtgctccagtgttgggtgtatatttatttacagttgttatatcctcttgctaaactgacccctttataattacatagtgaccttctttatctcttcttgtagtttttgtcttgaaatctgtattgtatgatatcagtatatttcaagtatacttccaaatatgattacagtattataatgttgtttttctatgtacatattacgtacataccagtagtattatgtactatgtaatagtaataatatttttactgttactgcaagttttgtaccttcagatgatttcttattgctcattaacatccctttctttctaattgaagtactccatttagcatttcctgtagaacaggtctgatattgatgaaatccctcagcttttatttgtctgggaaagtctttatttctccctcatgtttgaaggacatttcaccaggtatactattatagggtaagagtttattccttcagcactttaaatatgtcatgctactttttcctgggctgtaaggtttccactgaagagtctgatgccagatgctctgttgtatgttatttgtttcttttctctttctacttttagaatccttttccttatatttgaccttttgggaatttgactattaaatgctttgagatagtcttctttaggttaaatctgcttggtgttctttaaccttcttgtgcttgaataattatatctttctctaggcttgtgaagttctctaataccgtcctcagaacaaactttctacctctacctctctctttacctcacttttaagaccaataactgttgccctgttgagtatcttgtaggcatgcttcattcttttttattctgtccttttgtctcctaaatatgttttcaaacagtccttcttcaagctcactaattctttcttctgtttgatcaattctcccgttaagaggctgctgcattcttcagggtgtcaactgcatttttcacctccagaatttctgtttgattcttaaaaattgtgtcaatctatttgttaaatttgtctgataggattctgaattccttctctatgctatcttgaattttattgagtttcctcaataattctgtctaaaaggtcacgttatctctgtgtttctgagattgatccttggtgccttatttagattgcttgatgaggtcatgtcttcctggatggtcttgatgcttgtggatgtctgttaatgtctacacagtgaagaagtaggtatttattgtagtcttggcagtctggacttgtttgtacccacccttcttggggaagcattctaggtattcaaagggacttgtttattgtgactaaatttttggtcaatgcagctgtgtctacattgggggcactccagggtcagttacactgaggctcttacagactcatagaattaccatattggtggtcttgtacaagatctggaagaattctctggattactaggcagagacttttgttctcttccattactttctcccaaacagagtctctctgtgtgagtgtgcttagctgcctggtgctgggctgggagagacataatacaagttcccctgtggccatcaccactgagactgtgctgggtctgacctgaggccagcacagcactgggtcttgcagaaggcccactataaccactatttggctgctgcctacattcactcaaggccctggggttctacaattatcagttaccaacaccagccacatctgtgtcctttttttcatggcaccgaatgcccccggccccagatggttccagagaggccctctaagatccagggcctggagtaagaaaccttaagaatctacctggtgctccattctactgcagctgagctggcacgcaagccacaagacaagtcttttccacaagcacagaagtctcttctcttggacaccactgccacaggcccatggggagtactaacaagctactgtcaatgttcattcaagacccaaaggttcttcagtcagcttgtggtgaatgctgccaggcctgggactcatccttccatgtggtgagctcccctctagcctagggaaactccccaaatgccattcaagaaccaagtcctggattcaggaaccccaagagcccacttcctgctctacaacactatggccaagctagcatctaagctgcaagacaaagtccccttttctctcccatctgtttttctcaagcagaagtagtctctccctgtagccaccacagctgggaatgttctggatcacacctgaagccagcatgtttcagagtctcactcaatgcccatgacatgtactgcctggatattgctgctgattaggaaaggcccaaaggctctttagtcagcaggtgatgaatcctgccagggctgggtccttctcttcaaggcagcacattcccttctagcccagagtatatctagaaatgttatctggaagctagtgcctaaagtgggtgcttcaagactctacttggtgccctatcctactgtggctgagtgggatccaagttgcaagacaaagtcctgtttactcttcactcctctcctcaagtggaataaaggagtctctttcagagctaccaattgcattgcttggtgtcagaggaggggtggcagaagccctcccttggccaccctgtctggtgtctcactaggtcatatgacccctgcatccactggctccaagcctagcagagcactaggacttgcctaggagttgcagtccttgtggctcagactgccttaaagtttatttaggaccccagagaattttagcccatagtggtgaagtttgttgatacttgagttccaaccactgggatggacaatttctctcttgtaaatcccttttaagcctaatataaaagataaaagacaaaaaatatcaaaaacaactatagctagaatatttgttaatggatacacaatataaaaaggtataaaatgttatatcaataaagtgggggcctgggggaaaagcaagatacagagtttttatatgcaatggaaattaagttgttatcagtttaaatttgatggttgtcattacaaggtgtgttatatatgcctcaaggtgaccacaggaaaaaacctctagtagacacaaaaaatagagacatgaatcaaagcaaaaattgaataaaatacaaaagaagacagcaagattggaagaaagaaacaaaagaactacaaaacaggccaggcatggtggctcatgcctgtaatcccagcactttgggaggccaaggggagtgaatcatgaggtcaggagttcgagaccatcctggccaagttcgtgaaaccccgtctctactaaaaatacaaaattagccgggtgcggtggcaggtacctgcaatcccagctactcgggaggctgaggcaggagaatcacttgaacccgggaggcagagtttgcagtgagccaagattgtaccactgcactctagcctgggtgacagagcaagactccatctcaaaaaaaaaaaagaactacaaaacagtcagtaaacaattaacaaatggcaatagtaagtccttatttgtcaataattactttaaatgtaaatggattaaattctccaatcaaaatacaaagagtggctcaacagaaaacaaatatgtaaaatccaacaatatgctgcctataagaggctcactttagctgaaaggatacagagccaaaaagtgaagacatgagaaaagatattccattcaaatgataaccaaaagagaataggagtggttatagttatatcagacaaaatagactatcagtcaaaatctatcagaagacacaaagaaggtcattaaatgataataaagtggtcaattcattaagaggatataaaaaattgcacatatacatgcactcaacattagagaatctaaatatataaattaaatgttaacagaacagaagggaaaaatagacaccagtataataatagtaaaagatttcaatattccactttcaaaaatggatagatcatatagacagcaaatcaccagggaaacagtggtctttaaaagtactacagaccaaatagacctacagacatatatagaacattctatccaacagcagtagaatatacatttttctcaagtgcacatggaacagtctccaaatagatcagatgttgggccacagaacaaatcttaacaaatttagaaaaaactaaaattatctcaagtatcttttctgactacattataaaattagaaatcaatcaaaggagaaattaaaaatgaaaaaataaaagtggaaaaatcacaaacatgtggcaattaaataatacacttcttaacagccaatgtgtaaaagaagaaatcaaaaccaaaatcttgcatatctttaaacaaatgaaaatgggcacacaacaagagggaaggacataacaatgaatgcctacattaataaaagaagaaaaatctcaaacaacttaacttcacacctcaaaaaattaaaaaaagaacaaagtgcacaaagtcagcagtaataaggatatattaaaaattagaccagaaataaatgaaatagaaaatagaaaaataatagaaaagatcagtaaacctaagagttcgttttttgaagacagataaatctttagctagattacccaaggaaaaaaagaaagaagactcgaatttaaaattttgtaatggaaaatggacaattaaaatgatagaacagaaacacacaggattataaaaagactacattaaacaattacattccaacagattagataacttagtaaaaaataagttcctagaaacatataagatgcaaagactgcatcataaataataaaattcggaacagattaatagcaagtaaggagattgaatcagtaataaaaaattctcccatcaaagaaaagcccaggactagatgtcttttattttttgagacaaagtcttgctctgtcacccaggctgcagtgcaatggtgtgaccttggctcactgcaacctccatctcctgagttcaagtgattctcctgcttcagcttcccaagtagctgggattacaggcacccaccactacacccagctagtttttgtatttttagtagagatggggtttcactgtgttggccaggctggtctcaacctccagaattcaagtgatctgcatgtctcagcctcccaaattgctgggattacaggtgtgagccaccgtgcctggcaaaagaactagatgtcttgatgagcggattctaccaagctttaaaaaattaatgcccatccctctcaaacagttccaaaatgtttacaagaatgacacacttcctaactcatttcaaggccagcattgccctcataccaaagctggataagagtgctttatggatatacaccatcagcaagctatcgcaaggacaaaaaaccaaacaccgcatgtcctcactcataggtgggaattgaacaatgagaacacttggacacaggaaggggaacatcacacaccagagcctgttttggggtggggggaggggggagggatagcattaggagatatacctaatgtaaatgatgagttaatgggtgcagcacaccaacatggcacatgcatgcatatgtaacaaacctgcacgttgtgcacatgtaccctagaacttaaagtataataaatatacacatatatatatataaagagtgctacaagaaaagaaaattacagagcaatatcttagatgaatatagatacaaaagtcttcaacaaagtaccaccaaaccaaattcaacagcacattaaaaggatcatacaccatgatcaggtgggatttatctctgggatgcaaggatggttcaacatacacaaatcaataaatgtgatacatcacattaacacaatgaaggataacagtgcgggaaaagcacctgacaaaaatcaatgctttcttgataaaaagcctcaacaaatttggtacagaaggaacgtacctcaacataataaagatcaaatatggcaatcccatagaaaacatcatactcagtggtgaaaagctgaaagcatttcctctaagattaggaatgaaaaagcatactcactctcactatttctattaaacatagtattggaattcttagccagagcaattaggcaagaaaaaaattggaaaggaagaagttaaatggtctctgtttatagatgacataatcttatatgtagaaaaaccctgaagactgcagcaaaaaaagaaaaaaaaacctgttgaaacgatatatgaacccaatagtttcaggatacaatgtaacatacaaaaattagttgcagttccctacattaataaagaactctctaagaaattaagaaaaagatccatcttagtctgtgggcattgcttattacctaaggctgggtaatttataaagagaaaaagtttttttggctcatggcttttccggatgtacaagaagcatggcaccagctcctggtgagagctcaggctgcttccactcatggcagaaggtaaagtgaagccagtgtgtggagattacaaggcaagagagaaagaagagagagctgccaggctctttataacaatcggctctcatgggaaccaatagagaaagaaatcactcaatacatcaagacatcaagaaggacatcaaaccacttatgaggaaactacccccacgatcaaacacctctcattaggcctgatagctaacattgggatcaaatttcaacatgaggtttgtggggacagatatccaaattataaaacgattccacttacaatagtatcaaatacaataacatactaagaaataaatttaaccaagttgatgaagaattggtacactgaaaactcttagacactgatgaaagaaactgaagacaaaaacaagtgtaaaaatattgcacgttcgtgaattgaaagaattgctatttttaaaatgcccatgctacctaaagcattttcagattcaatgcaatctatcaatattataatgatattttttacagaaatagacaaaacaatcctgaaatttgtttggaaccacaaaagatcacagatagccatagcaatcttgaaaaggaacaaagctggaggcatcacactctgtgatttcaatttgtcttacgaagctacagtaatcaaaatagtttggtaccagcataaaaacagacacttaggtcaatggaatagaattgagagcccagaaataaatgcacacttgtatggttaactaatctttggcaagggcaccaactatacacaataaggaaaggaaattctcttcaataagtggttttggggaaactggatactcaaatgcaaaagaataagactggatccttgtcttgcactgtacacaaaaattaactcaaaatgaattaaagatttaaatttttaatttaaaaatgtaagatccaaaactgtaaaacaaagctccttgacattggtcttggcaaagagtttttggatattgacacgaaaagcacaggtaacaaaagcaaaaataaaaaaaagtagaactacaccaaactaaaaacctttttcacagcaaaggaaacaaaaactgagaaggcaacctactgaatgggagaaaacatttgcaactatatatctgatgaagggttgatattcagaatgtatgtagaactcacacaactcaatggcaaaaaaaaataataacaataactcaatttaaaaataggaaaaaggcctgaatagacatttttccaaagaaggcatacaaatgggcaagaagtatattaaaaagtgctcaacatcaataatcatcagggaaatgcacatcaaaactacagtgagatatcacctcatgcctgtcagaagggctaagagataaatatctgcaagaatgtggagaaacgaaaacacttgtccactgtaggtgggaatgtaaattggtatagccattatggaaaacagtatggagtttcctaaaaaaatttaaaatagaataattatatgatccagcaagcccacttctgggtttatatccaaaggaaatgaaatcagtatctttaagagatatctgtaccctcataattattgcagcattattcataatacccaaaagatggaaactacctaagtatccatcaatgggtaaagcggataaatgaataaagaaaatgtggtacatatacacaatgaaatattattttgccataaaaataatcaaacctgtcattttcaacaacatgaatgaatctgtaagacattatactaagtaaaataagcaagatatagaaagacaaatagtctgtgatctcacttacatgaaatcttataaaaaggtgaatctcattgcaacagaaagactgatgattgccaggggatggtggtggagaaaataaggagatgttgattaaagggtacaacatttcagttataagttgaacaagttccagggatctaatgtacagaatgggtggtgaagaatgtgtgaattaacttgattgtgataatcactgagaaatgtatgcataaaacaatcacaatgcacactttcactatatacaatctttgtcaattaaatatttttaaataaaaaataaataaaattgtacttccggtttttgagatactgcttattttttatccactcttttttctcactcctttttagattagataatttctattgatctatctttaagttcaatgacttttccttcaacccctcctccattatactgttaatcctactaatttatttatttaatataatacatttctctgttttaaaattcccatttggttcttctttttttttttttttttttttttagatgaagtcttgctctgtcgccaggatggagtgcagtggcgcaatctcggctcactgcaacctctgcctcctgggttcaagcaattctcctgcctcagcctccctagtagctggaattacaggcacatgccaccacacccagctaatttttgtatttttagtagagatggggtttcaccacgttagccaggatggtctcgatctcttgaccctgtgatccgccccctcagcctcccaaagtgctgagattacaggtgtgagccaccgcacctggccaatttggttcttttaataatttcttatttctctgctgagatttcctatctttttgttcatttcaaccatattccctttcatctcttaaagcgcagttttaatacctgctttaatttttttgcctagtaattccaacatgtgggtgattttaagattgtcatctgttgattttctttatccttaagaaagggtaacattttactgggttgaagtaattatggggtttttatttgtttggttgtttgtttttgttttgttttgtcttgagacggagtcttgctctgttgccaggctggagtgcagtggcacgatcttggttcactgcaacctctgcctcctgggttcacacaattctcctgcctcagcctcccgagcagctgggactacaggcgcccgccaccacacctggctaaatttttgtatttttagtagagacggggtttcaccatgttagccaggatgatctcaatctcccgacctcgtgatctgcccaccttggcctcccaaagtgctgggattacaggtgtgagccactgtgcctggccaattatgggttttaacttagacatcgtcaatgttaattgtggatactccagacttggagtccttaacttggacaatgtgttacattgagccaaagagtgctaatatctttgttctcatgggacattaatttggctaatctcatattgaaaaatttgtgctttttggatctcagtgtggactgatttcagtctgccctgtgcatgtgcagttcaggggtcagacaaagacttaagacagaatttatacacacaatatcccatctctgtctctttactttcctatgtttttcctcattctctgacatccccgttccttcccagagttcctacagcctacagagaaagcaagggctttctcttggagttaaattgtcccatgttgccactgcaattggagatgccctcagaaaaagcctcagaaatgtgaaactcacttcatctcatgacatttgcttaatacaaagtttgaacctcctctaatatttctctagtcttatccattctccaaaacctttacagagttgtattgtgttttgttatgctttgcttttatttttggtttttgtccagagtttatagctactatctgcaggctggttgtttttttggaagtttatttctccacacaagaagcaaaactcttgtattattactaatcctgagaacagaaggttacagagaaacagaaaacagaaggctttaaaaaagtaccaagagatacaaataaaaattgaataaaaaacaaacaaacaaaaaactagaaaaatgtctcctgcttctaggagagggctgaacaaaggcagatgaagaggcaataaagtaggtaataagtacatttacagaaatatatgccatcaaataggtaagaatgcaagtaaaatttatatataacaaatacccaaaagttttggaagcagaaaaaatgttagtcaatagttcatattgtctaacaatcaatctgtcacccaggctttgtcacccaggctggaatgcagtgacgtgatcatagctcactgaaatttcaaacactatcctcctgagtagctgggactacaggcatacaccaccacatctggctaattttctattttattttttgtagacatacggtctcactatgttgcccagactggtcttgaacttctgggggctcaatcaatcctccctgcttggcctcccaaagtgctgggattatagtgtgaaaggaaaataaatcttggggcccaaaatcactaagctaaagggaaaagtcaagctggggactgcttagggcaaacctgcttcccattctattcaaagtcatccctctgctcactaagataaatgcatatctcattgcctctttgtcaaggctaatcagaaactcaagaatgcaaccatttgtttctaatctaccaatggcctggaagccccctcccactttgagttgtcctgcttttgcttcaagttgtcctgcccttacgaaccgaaccaatgttcatcttacatatgttgattgatgtctcatgcctccctaaaatgtataaaaccaagttatgctccgactgtcttgggcacatgttatcaaaacctcctgagactgtgtcatgggcatgtgtccttaacgttgacaaaataaacttcctaaattgactgagacctgtctcagattttttagtttcacaacaggcatgagccaccatacctggcctcaaaagtttcaaaaccaacactcttcatcagatcccagaaccaaagaaggaaaaaacaattgaagaatttatgtccacagttatgccaagatttacactaatgcataccacatctcaaagattgaagaactctctcaagaactggcaataattaagtttccaaccaaattatattttctaaattaaaaataagcacacatccaagtgtaaaatttaaaaaaacctgaagctaaagcacattcaccttatagataaaaatatagtccatacctctctattttataaatgcattttcagacttgatgcattataggacatggtaacttcaaacagcaaggaaaaaactcttatttaaaactcagtaagaatataatctctgtaagaaaattatcattttaaataatttcattaaactgttttctcctttgatatacccctggatgtaacactattaggttatagtgaaaaacaccctcaattaactctcaaaaagtatggttccaccattaagctactatgagactttggacaggtcccttcacctatctaggcttcagtttactcatgtgaaatgtgaggctagaacatatggtttctgctttccaggtgtaaaattctataactacataactttatcccttcgtttcatgcagttttatctccgtcttccacttctgtgtcttcctggctggagtagctttatctgtcgtctgaggcatccggggcacaccccatcatttcaggcttagccgtttctaagtcgaaggctgcagtcactgagggcagcctcaaggttcttcaatgatggagaacctcaaggttcttcaatgatggagaacctcaaggttcttcaatgatggagaacctcaaggttcttcaatgatggagaacctcaaggttcttcaatgatggagaacctcaaggttcttcaatgatggagaacctcaaggttcttcaatgatggaaagattcttgtttaatttctaaaaaataaatttggcaaattcctcagatctcaggcccaaagaaaatatttcaggagagatacattatgcctttcacgcaagtgcaaaaaaattaaaaatgtagactcccacacacaatctcaagcaaatcatcaactgacatctgatgttgtcttacctacagagttaagaagcttgtttacatctgtacttcaggtgagtgagataattttgtgaatggtaggttaaaagtaatttcaaatttgagaattaagcaatgagaaatgtgctgtaaatttcaagaaaaagatgctgcaatactgtttaggattctgagaactttagatctatcttcttataaaaacttccacttagaaacaaagaaataaacaaaaaccaggataaacaatacaatgctctttccaacttgctggaattacattcactcagataaacatttattaagcacttagttggtacaaggtgtactgtcctctgtgagacacacactcatagaaaagaattttgtatctgctttagtgagtttataatatgccagaataaatacatactaaaaggcatatatacataaataatataatgcattgcaggaagaggtaagtactatgatagagggacacagaaagtcctgtgcctcaggccttgctccctgcagggcactaagctatttcgaatcacactgcaggaggtggccaactacacagtatgcagtgcatcagtgctatccagggaagaaaagactactacatggttaagagagcctgaaaaaacagaagcagagaggtggacctagaaaactagcagtcggttgaaggtcaatatgttcctacctggaaaatagggtccaactactgggcagaaggccaggacccaagggtgattctgtgcaactgggggaggtgagaaaggagagaaaggaagtgagtattctgctgtgggaagaagggaattccaagatgacaacacagcaagagcttaactatagatgaaggaattctgaatttcttctagtttcccatctcatgatcatgtcaatataaaaggaaattactataaaatgtaataatttctaccagtctacagattctggcaggctaaattaaacctgaagataaggacaaaattacattccagttcctacttacaacttctatcacataaagaggtacttacatagttcatatgtgcaaactgagttgcatgctttctaaatcgttttatttaattgtgaaatgtttggaattgggtgtcactggtcttcattttgttttgaaaaggcaatataagtgaattaatctatcatcaggctaataacaagaataagtattttaactccttcctttgaaatgaaaagacaaattctttagccaagagcttccaagtttaatttacgattcacaaaattctacaaacataaattatatagtagaagtttcccttattcttacttgaatataactctaatcatttgaatatcagttttaacaaaatgaataagagtacaacagagttcagatgaagctcgtttcttgccaaaatccatatgaatgccaaataccttccaagcacaaataaatcctgccttccatttaaacaaacaaacaaacaaacaacaaacaaaacaccacattgcctaagattgggcaatcactactaagtgactactaagtagtgagtaagagctaagggaaacggagcgaactttaggtcaccagggcacggtacactgaaaaacatgtgctgcgcttcttcagaaacaagctacaacagcagaaagacgaggtaccttatatcttgtttataaatcttactttataaaggagaaaaaaatgaaaaaagggaaataatattcccttatatcctattttgtgctaggcacttagacaatgttttattatttaattgaaacttgagttcaatcggtagcaggagcggcgagcggaacccagagagccctgagcagccccaccaccgcccccggcctagttacagtcaccccagaaggagccacaaccctgcagccagcaggtcaccatcacagcaaccacaaccctgagcaaagacgccaaggcagccaaccccaagccggcaccacctgcagcggcgcagggagcagtggcaagggcgacctcacaggcggcgcctgctgatggggataagatcaccgcaaggaagattttgggaacagtaaaatggttcaatgtaagaaataaatggtttcatctatgcgaatggcaccaaggaagatgcagttgtacagcagaataccatacagaagagtaaccccaggaagtaccttagcagtgtaggacacggagagactgtggagtttgatgatgttgcagcagaaaagggtggggaggcagtaaatgttacaggcccctgtagagtccagttgatagcagtaagtatgcagctgaccttaaccatcattgacgctatccatgtggtcctcaggcaattaccagtagaattaccagaatagtgagagtggagaaaagaacgaaggacgggagagtgctcccttaggctcggcccaacaatgccggccctgctgcaggcgaaggttcctgccttactacaggcagagaccctacggaaattgaccaccatattctaaccctccttgcagggagcagcgacggagggtgctaacaactggggtgcaggagcacaaggtaggccagtgaggcaggatatttgtatggtttatagaccacgattcctcagggaacctcatcgccaaagccagcctagagaggacggcagtgaagagagtaaagaaaatcaagatgagacccaatatcagcagcgacctcaacatcggtgctgctaaaaccccaattatctatgtagactcccagaaaaccctaaaccacaacatggcaaagagacaacagcagccagtccaccagtcaagaattctgcacccgaggcagaagaaggttgagtaaatgccggtttaccatctccaccatcatccagtttaatcatccaacaagaagaaatgaatatgaaattacagcaatgagaaatgcaggaaagaaatgctgaagaccttaagtgcttgctttttgcccattgatcagaaaccagaactacctgcattatctacgaagcatggggtttttaaaattatttttacctacagacatgtctttttggtaataacaaaggtttttattgttgttgtttttgtgtgttttttttttagtttggtttttctcaacatgcctttaaaagcttttaaattggttcatatgtcaagttgagatttttaagcacttcacttttaatttgtaataaaagtttacaacttgattttttcaaaaatgtcaaccaactgcaagcacccattgaaagtcttaaataatacaaaaactttaaattaaatcaaatgggtattaacaccatataatacaaaaaagaagtgaggttcgaaaatccttatgcttttgtgatgccacacgtcacctaactggtagcacaacttgattgcaatctgactctgaagcttttcttcattcctagacatcctatttttgttgaagtcctagattttaaaagtataatttttttaggaataaagatctggtaggcaggaaattctgctgaagctgtttctgggcaacttgactttgccagggcctttgcactgattgtgttaatggccacctcctcttcagatgtagggttatggatcacctgtaaccacctgtaacctgtacagcaagctgaaggagtgtttgcctaatatccaatccacagaatttatttcaaaaatggtgagcctcactaaggtgatagcagtagcctgtccacaggctgatcaacaaaatcttgtctttgatccatggtttctgcttcttggagtctcccaaggtacattctgccactgctggacctagaatcatagtctcctttcctaccagccttctcaccctgccaaacttatcatatacaattgtttgacatcacagatattatcaatccctaggcctctctagctttctgctcttgcaatttcttttacattgtctttgtcacccagcacagagcccatacataagtcatcactctattttcttagaaatactttcagttcacttcttggttttcctatctcacttaccaagctgtcttagtacagatctaagatgagaattttagtacaaataatttattttggaaacaaccccatgaaacactggtaagggagaaaggatggaaggcagaaaagggaaataagatagaatgtttgcaaagataaccatcaatagttcctcaaagccttgctctagcatgctgctcttcccatcaagaggcagagtttgtttcccccactcttgaatctgcactgaccttgcaccctttttttgaacaatagattgcagcagaagtgatgctatgctagttctaagccaaggctgcaagagtcctggcagcctcttcttttgctttccttagatgcagataccatgtaaagacgctcagactagattagtgaatgatgagaagcaatggggagagacaggcccagacagaccccagccattctatacattgcactgaggcctaaaacccataagtaaagccatcatagtcattcctgacccagacaggcttccagtcaagtgcaactacatgagtgacccaagctattactaatctaagcctgggcaccccaaagatttgtaaaaaataacaaatctttgttgttttaagtccctgtatttgggggtagtttgttacacagccataaatgaaacagggacaaagccaaaaaagggtacaattattaaacaagttactgctatgggaaatgagtttagtccttctgggatactctggaaaacagtaaagaacatgcctcacagttatcccatgtgaagggtaaggatgatagtgtaatccacccacttgctaacagttatttgcttaagtctttttctagtgacagtaactatttggtactttaagcctgcccaacactgtgagccaaatctgctcagcagccacacacaaaaaatgccttcaggcagacagtcacagtatcaggaataagcagtcttctgtgacaagaggtgagtggtggaaggaaacaggaagagcgtcaacataggtgaaaacccaggcctagagcagtccagctatctgctttctccactcctagaactgcaacagctaaagtgggtcacatacactcacagattataaccactacacatctacagctcccaaacttagctgggtcccaaatgttacttaataatccttccaagtttccctaatcatctgtttactttagtatattttacatctatttcaaaacttcccacttttattaaatcttctattccacctacccctcccccttcggtatcagcaaagcaatatgctctctatcccaatgagaaaataaaggtcatcagatcaattttttgctacctccattgcactgcattcagaatcatccttccttccttccctactaataccacaggaaagggtcaaggtaaatgcagcattaatccagcacctctccatctctggaataccccaccttagaatacaagaacccattatgtacttgcccttttctgtctctcttaggtccctaatgcatgaatctcatcgagttatagatctgttgaaaccctacacctatggatctttgcaccaagcattgttcctactgcctaaaatgtaccttccccaactttccccatttctagactctgccctggcagagtcctcttcatcttttagacctccacttacctgcgacctcttcaggaaagccttctttactttgctgcccacgattcctcaaatctatgcttacctctgccacagcactttgctcttttctgaaatcgctcattcctttttctgatatccttttcctcctcctttacctcccactgaaaataagctcctccaaatcaggtatttgccttatatatttttgaaccatagtatctgtgcctagaacatagctgtggattaacaaatagcaccaaatttaaataaattaattaatcatctcttttccttaagttactttccagagtaactttagtggaagctgcaggcaagatttatgtgtactgtggcccttcctctttctatctttttttttctttttaacattctaagaggtatcatacaggtcatgataaactgagtctcttctaaatttgcatatagtgaaaaataacacgtcaaaatgcatttgcttagaagctcaggaatccattgttcagttaaaacttgttgccttgttataatgttatgacaaaataggcttccatactggcttttaacatataattgttaattatcatcacaaaagtttcaaaatttcttcagttttaaaaagattttcataagtaaaaatgcatacagtacttgtatactcacagtgagcttatttaataatatgtttgtagaatgtaaaatagctttctgttttatggtcagatttgataggcctatcaaaattggtttttatagatatgattgctactttcatcaaaaaatgaaccatcaactttaagagaaatgaaaaaatcaatttgggtcatggtaacttctaagccctactacctagtcctagaatttgttcttaatagaccagactgtctgcaaaatactttgaaacaaagaatgtgtactttgcctcctccctaccatgttcttggcaactagggaatatgggacattttaagtctttaagataaaattaatcacactgatttagaacaactaaaatcttgtcagagtaattcctaccttctcccttccccaccatgttacctttaggaagaggagacacacttgaggaagctcttcaaggctggtcttcagggaaataaagacattgaaattccactccaattattttttattacctgccaccttgaatccagaatatatgttacattatgaagtgtcgtattcttgactcaaaacatccttccaattaagattttcttttttaaaaaaaattaggttaaagcaaaaatgcagaaaagaagggtaaataagattagtaaaccatctgaaaattactgcattttgtaaactttggtaaaatgtatgaagaagcatgttttccagtctgctttctcggcctgtggatacctgggacataattcagtttgccatcccctgttcccagatcagctcagtctttgttcagctccatcttcaatctggcatataattacttcttcagctcctgtgctatttggttttaagcacctcttacccccaaggcctcatggctctaagggcttgttgaatttaaacaagcacatttaaatctttgtctttaaatgagtaaaataaaagtcttaacacctaacacagagtactcttctacactctaaatgtgcatgttataattgcctaccagatcataatgagcatctatccatcctcaaaatcagagaaaggggggctcattctagaggtaaatttacaataaatggctttattcttgattagctatgtgtgtttggggacacagagactggcacctgcataatttaaatacctgataggaatcagatgatcaggacaccttggaaataaaggtggaaaaacaatagtggaggaaacacaataatggaggaaatacagaagaaaaaaaacaagattgttaaaagaaattaataaaatacaacttaaggaattttaagcttcacctctcattggaaaaacactgcaaactcatacacacactgatgcatgcacacatgcatgcacgcacacatgcatgcgcacacacacgtatgcaatataattacagaaatgttaaaactgtctgtctttcctgagagtcaggagatgtggattctgccactactgctgctggcaaatcataaataccatccagggttttagtttagcctgagtaaatgagtaatcattacatttgttccacatacatactttactccaaacactggtagataagtattgaatgagaccctcattcaaatacacggtcaaaaatgccacaaaaagaagtattataattataactattaattataagtaaagttttttaatgaatggataaattagtaaaacaaattttaatagatataaatggaaaacaaagcatgtgcaatctcactagtgatgaaggtaatagaaattttaaaagtgagatactagtctttcacctatcagatcagttaaagtcaataaaagaaaaattcagtgttggaagaggcactgcagtgggagtgtacattagtaccattaagcactatgtatcaagggcctgaatcatgattatgtactgtgccagtttgggtcctcttgtgccaaggtgaattgggtatgtgagataattatttggggtagaatctatacatgataaaggggaagaggtgtaggtaaggagagcactcagactatgatgcaattctgacatctctgaaaggagaaaggcaaggaagcatttggtaggaagagatctgcatgcaggaaagtcctgagaaagtctcagccagggttggttccaagtctttgttattgtgaatagcgctgcaataaacgtatgtgtgcatgtgtctttatagcagaaggatttataatcctttgggtatatagccagtaatgggattgctgggtcaaatggtagttctggttctagatccttgaggaatcgccacactgtcttctacaatggttgaactaatttacactcccactaacagtgtaaaagcgttcttatttctccacatcctctccagcatctgttgttttctgactttttaatggtcgccattctaactggcttgagatggtttctcactgtggttttggtttgcatttctctaataaccagtgatgacgagctttttttcatatgtttgttggtgacataaatgtcttcttcttcttcttcttttttttttttagatggagtctcgctctgttgcccatgctggagtgccggggcgcaatctcggctcactgcaacctccggctcccgcgttcaagtgattctcctccctcagcttcccaagtagctgggactacaggcgcatcctaccacatcctgttaattttttgtatttttattagagacagagtttcaccatgttagccaggatggtctggacctcctgacctcgtgatcagcctgcgttggcctcccaaagtgctggaattacaggagtgagccactgcggccagccgtaaatgtcttcctttgagcagtgtctgttcatatccttcagccacgttttgatagggttgtttgttttcttcttgtaaatttgtttaagttcctggccgggcacggtggctcacgcctgtaatcccagaactttgggaggctgaggcgggtggatcacaaggtcaggagatcaagaccagcctggctaacacggtgaagccccatgtctactaaaaacacaaaaaaattggccggccgtggtggtgggcgcctgtagtctgggactacttgggaggctgaggcaggagaatggcgtggaggcaggagaatggcgtgaacccaggaggcggagcttgcagtgagccgagaacgtgccactacactccagcctgggcaacagagtgagactccatctcaaaaaaaataaaaataaaataaaatatttaagttccttatagattctggatattagccctttgtcagatggatagatggcaaaaattttctcccattctgtaagtcgcctgttcactctgatgataatttcttttgctgtgcagaaactctttagtttaattagatcccatttgtcattttggcttttgttgccattgcttttggtgttttagtcatgaagtctttgcccatgcctatgtcctgaatggtatcacctaggttttcttctagggtttttatggttttaggtcttacgtctaagtctttaatgcccatcaatgatagactggataaagaaaatgtgccacatatacaccatggaatactatgcagccataaaaaggatgagttcatctcctttgcagggacatggatgaagctggaaaccatcattctcagtgaactaacacaggaacagaaaaccaaacaccgcatgttcgcactcataagtgggagctgaacaatgagaacacatggacacagggaggggaacatcacacattggggcctgtcgggtggtggggaagtaggggagggatagcattaggagaaatacctaatgtagatgacaggttgatgggtgcagcaaaccaccatggcacatgtatacctatgtaacaaacctgcaaattctgcacacatatcccagaacttaaaagtataataaaaaaaaaattctagaaaaagaagttgcatctgtactgaacatgtacagagttttttccttctcattattccttaaaccatacaaaaaagaaagtctcagccatgttggtagggagtccctgaaccagagttacccattagaagaatctagtattgggcagaaatgtccccgttctggtattcctgacatgttcagtcactcggtggaagcagccccaaagaaggatggtttcagggtgaatgttgtggtggatccacaggtatagcagctggaggctgtcaattatctatgctctctacaaaagctcctcttgaaaacagagctgagaaagacacttgtatacatatgattttattcccgttctaggaatctatctcaaggaagcaatctaaataccaaaataataatgataaagagctttatgaacaaagatgctcatcgcagtcttttaaaaaataattgaaaggatagaaacaatttaaatgtccaagcataaggattgattaagcagctatagtatgtctactttaccaaaaatgctgtggctattacaatggaaaacttatattttaagtaaaattgaaaatagagataaaatatggtataacttttaaaattaaaagctttgaaaagatacatattttaagactggcagaaaataaaccaatatggtagtaataggaagtttttttgcatttttgaattttccaaattttctttattaaaatttatgacctttagctgagggaaggaagcattcaaaataaaaaggcaaaaaagcaaaatagttaaaatgatttagagtcgaagtaagcaggggaaatatgaagctatagaagagaaaacaaagaagacaataaaaatatctgaagaatactgtcttaataattctgggactaggtgtggtggctcactcctacaataccagcactttgggaggcccagccaggaggattactcgatgagcccagagttcaaggctgtagtgagtgattattgtgccgctgcactccaggctgggtgacacaccaagacccagtctctaaaaacaaattctggaaaacagcttcatggctccaacataacattgaacaaagccaaagatgggaaaggaaaagggaatgtttttattttcattgtagcattgggtttttaaatgaaaactgatgtttcatatgctcttctatgactattcagtataggtgtttcaccatcattgtaaggagtatcttctgtgtatgtaagtatgtgttcactagtgcattcattttttcaacatgtgattaaacagtttgagagtcaccatatgccaggtactgtgcaagcaaatcaaaggtcacagtgtaaaatgagaaagggtatgttttggccctctattctagaattgtttatagaaagtgcataatttaagcccatatgtcccatgtcctaaagatacctgtccattaaatacagtgcatttcattgccttttcagactctcttcactatgcacataagtgacaatgtaattgcaatttgattaattcatataaactaagaaaggaggaattattcattcatttctgatttttttttttttggaaagtatcccattcctactatagtttgccaaaccctctcagggtagacctctatttacttaaaagaactagtttcatagattgctgtcatgcaccctaattagacaaacgtgttttccaggtctatttgaaggacattctgatataatgcatacctatcttcttaatcttcttattcagcttatgcatatttcttttcctttaaaatccatcaataaatgatctgtgatctgtaagtaattaatttaatgattacatgaattaaaataatgcacattgctttaaaggagttagtattttcggtttatgttacaatattggccttgggtaaatatcatccattgcctgaatttcataatggttcaaggataaaccatttcctctttataattcagtaagtttgttccaaaggagcctattgctcctctactcaacaatgaaagaaatgcattcagggaccttaggttgcctattcttaataagatggaatcctttcccggtttgttaaattcactgaatttataactcattgttactgatgaaggaattaatccaagcccgttaccagattgatctcctaaaatccacagagcgaatttggtgtcatttttaaaaagaaataaaataacaaaaataaaaatacaaaggatgtcagtaagttacagacaggagggcatacctcatatttatcacctggaaaactagagaaaagtttcatcaaaactgtttcatgcatctgtgcagggctaaagtcatctgctaatcagcactaataatgatggggataacaataataatctgctacctttacataacagtttttaccttgggaaaagattttcacatactactcttcatttagttcttataatgactttgagaaactaacataaatgttttacaagtcccattttgtgaaagagaaaattagagtacaaagaagagactgacccaacaataacatttaactggagctagactcctacttcaggtttttaaaatgctttcaaatcaatagaattcatgatttgcaatgttttcctaaattctgttaaaacacacttaggaccgtaaattttcaccaaccataacagacacctggtaagcgggcatgtaataaacaattgagatgttagaaaaaaagatatgtctctgatgagcagggcaaaagtgaatgtaagtcaaaagatatctaaagactctatagcttctggaataataaattggtagttttctttatttttcatttgttgtttcagaaagtgtttaacttttgatactaccaccaatgtaaaatataatagattgttagtaacaataaatcaatctctacgttgtccaaataggtgtgtttacccaggtccacactgttcaagttttattaaaactgtttcgttttatccaggtttccagtattgcatctcctaagacaaacactgatatttatctgctgatgcttgttttactaaccaaatattacattacacatggtttatcacattacccagggaggtgacaatatttcaggaaaaaaattaacaaatcaaaataactttgaaaactgtttataccccatgtacaaaagtactgtctatgcctagttattcactactatcacaagatatacataaatcagagtttttaaataatactgacttccccttataaattcctttaccccttgtgaaaggaacctagcaccattatgacacagttaagcattagtcacagtttaataaataatttcgttatagcctcctagtctatcagtattatttggattctcagaatgcatgtaatcatgtaaattacaaaatttcctttgtatcagggataaccaactgtcttttataaataatgttatttttggtgatttttcaatatcagaacagtatagttttggctagagaaattactataagcattcaaataaagattaatcaatttatacaaggcaaataaactttttgtactcttaaatacttaaagaataatatatacattcaaatatttgtaagaaattcatatagaggggagtataaaacacatatggaaaaggaggtatgtctgcagaagttactttgtaaagaaacatagtgctcaactaccaccctccctcaaatatcatgtcaatcaaattagcatcataagaagaactccagttctactgtgatagagtagcttatatcaaatcaccccctcgttgagaaaaactattaaagatgaataaaatgaaattattttaaaaactgtttgaaggcaccaggcaccaaccaaagtaatttcaatttaaaactcaatagtctataaaggaagtaaacacgttaaagtaagccctatgttgtttattacttttcaaattcaaggcatttgctgtttcctaagtagaacagaatgcgagactgagcacaaagctccagattagaacattaagaagtcttgtaaagagaggagggcacaaataacactttggagctgtcagcacagccaagacatgaagaatcaagatcctggataaactgtaaatgcaatgaggtgaggcctgtattctttttccacttttaacccctaaaacatttccagttcctctttcttggagtgagaaaatcaaaagagaaacaagcagaaaacagcaacctaaatactaggacattaaaaagaatattcagtagtcttataccaacgaagcaaaaactggagtttagtgactacttgaaaagcactccaaaattttatttgaacctctaaatgactatttataaaactaagggaaaaccataactagagtagccatcacaaagatggaaacccaacttcaaattgtcttaatccctgataagattaagtaaattacctttattctaataatctgtgaggagaaaattaaatccccatggaaaaatataataccatacaaaacactctaaatttttaatatgaaaaaatcatcaagcatgctaggaagtagaatcaaagaaccaaaacaaagagaaaaaataatagacaaaaacataaattcaaaaatgatacagattaaagaattatcagatatagtcttttaaaaacagtgataaatatggtttcagaggtaaaggaaaagagtgagaataatcagagaactgggatttatattaaaaacccaaagattattctagaactaaaaataaaacaaaattaataactcaatcgcagccagttagacacaacagaagatccaagttgtgaacttgaaaataggttaatagaaaatatccagaataaaacaaagagagaaataaggatgataataaaagaagaagcattagagatatatagaacatggttaaaaaatgttttaacatacaaatatctctagtcccagaaggaaagggtaaggagaataggcagaagcaaaattcaaagcaataatggccaagaattttccaaaattggcaaaagcatcaagccacaaattcaagaatgtctaagaaccccaagcaggataaacacaaagaaaccaactacaaaaaaaaaaaaaaagcctgtttgtaaaactatttaaaaataaacaataatcaaaaaggcaatctcaaaatagccagaaaaataaaaatgcattactttgtaaggattagtaagtctgataactgattgctcatgaaaaacaattgaagccagagaacaaagccatgatatctttaaaatgcttttaaaaagtaactaccaacctaagaaacccaaacaacagcaaaaaactaaataacctgattaaaaaatgagtaaaagatctgaacacacatttctcagaagaagacataaaaatggtcaacagatatatgaaaaaatgctcaacgttactaatcattaaggaaaagcaaattagaaccacaatgagatcacctcacacctgttagaaaggctaccttcaaaaagttaaaagacagtaagggttggcaagaatttggagaaaatgaaactctcatacactgttggtaggaatgcaaattgggtacagccattatgaaaaacaatatgaagattcttcaaaaactacaaatataactaccatatgatccagtaatttgacttcaggatatatatcctgaggaactgacgttagtatgttgaagagatatctgctctcccacattcatcgtagcattattcacgatagctaagatacggaagcaacctaagtggcatcagcataaaaacagataaagaaaatgtgttaaatacacacaacagaataatattcagccttagaaaataaagaaatcctgtcatttacaacaacatacgtggacctggaagatactatgttatgtgaaataaggcagacacagaaagacaaatactgcatgatctcacttaagtgtgaaatccaaaaaggccatagatacagggagtaaaatggtggttactagaggctgagtgttggatggtgatgaagaaaggggagatgttattcaaaaagcacaaagtttcagctagacaagaggaataagttttagagatatactgcacagcatgatcactataatttataagagtgtattatatattttgaaactgctgaaagtatactttaaatgttcttaccataaaaacacgataattatttgaggtgatggatgctaattagcttgatttattaattctacaatgtaaacatatactgaacatcacactgtatctcataaatatatataattgtcaatcaaaagtaaaataaaaataaagcaaaacatatatatacacaaaaaagtaaataccaacgtagaattctctaaccaatgaaagtattcttttaaaaagtcaaaataagaatattttcagaaaaacaaaactgcggaaatatttcaccgaaagattcatactataaagaatactaataggtatctttcaagtaaaaggaaaagcatctcagacaatgatagagaaatgcaaaaaataaagtacacagacaagattagtatgcgtataagtatagaaaaataataaaaataatgttttaggaattagagcacttgaagaattataattcaggacaatgataagacaaaaaatgagagagggacaaatataattattcattgaaaagagataaaaggtgtaagttacagtagagctcattagggtaaccactaagaaaaattaaaaatacgtaattagcaagttaaaagaggggcaaatgaaataacaaggttgattaataaaaaaagttaagacagaagaaatgggaaacataaaattggtagaaaaaatagaaaagtacagtaagatgatagaattaaatcaacaaatattagcaagtgcagttaatgtaaatttaaaaagttgcattgaaatacaatgtcagactttgaattaaaaatcaccattaataatatgctatttgcaggacacataccttaaaagtaagtatacagaaaatgtgaaaggaaaagtgctaaaaaaaatttaccaaacaccaacgaaaagaaggctaatatcactatacattataatatcagtctaagtagaatgaaaagaaatagtacaagaagagcattaaataatactagttaatctactaggaagatatcacagttccaaatttgtacaaaccaataacataagcttaaaatgtacaaattgaccaaactaaaaggtgaaataaacaaatacacaatcaagttagaaaattttgacatatttctctcagtaaatgatagaacttggtaaaaagttggtagataaataaaagttttgaacaccaagatttagcaaatttgatctaatttatatgtacagaatcctgcacccaatagcaacaaagtacacatatttgcaggtgcacatagagcatgcaccaaaagtatccttaaactgagtcatatagcaagcctcaataaattttcaaagtatttatatcatatagaatatcttctctgaccgtaattgaattaagctcaaaattaataacaaataagtattataaaatacatcaaatactttcaaataaagcaatagataaacttgataaaagtcaaaaattggggtcttttggtaaagaaagacaaatataagcagtagtcttctagaaacacaaatttcaaagatgaaaaaggacaaataaccttaacaggaatgaaaaaatggagtattgttacagatgctacagacatagtacaaagataataagatctggtgaacaagtttacatcaataaacttgaaaaaattgatgaaacatataaatcccctgaaaaacacatattaccaaaatggacacaagaagaaatggaaatccttcatagtactacgtcttttaaaagacatgaatatttgatttggaaaactcttctggacactggtctagagaaagaattcattaataagacaccaaaagcacaagaaaccaaaacaaaaacagacaaatggtacttaattaaactaaaaagcttctgcccagaaatagaaataatcaagagtgatcagatgacctgcagaatgggagaaaatatgtacaaactatcaatcagacagaggactaacatctagaacttacaaggaactcaaactaaataacaacgacaaaacaaataatcctatcaaaacgtgggcaaaagacatgaatagccatttttcaaaagaagacatacaaatggccaagaaacatataaaaaaaaaagctcaacatcactaatcaaagaaatgtaaattaaaatcacgatgagagatcatctcagactactcagaacagctattacttaaaaagaccaaaaacagcagatcttggcaagcaattgcagaaaaggaaacgcttatacactgttggtgggaatgtaaattactacaatcactatagaaaacaatatggagatttctcaaagaaccaaaaatagatctactatttaacccaacaatcccaccattgggtatatacccccaaaaagaaattattataccaaaaatatacttacactcatatgtttatcacagctctagtcacaatagcaaagatatggagccaacttaaatgtccatcaatggatgattggattaaaaatgtgaaatatatatgtaataggatactatccagctataaaaaagaatggaatcacatcttttgcagcaataagaatggaagtggaggccactattgtaagtgaaataactcagaaacagagacaaatgtcctatgttctcacttataagtgggagctacctaatgtgtacacattgacatagagggtggaatgataaacaatggagactgggaagggtgaggaggaagggggtggatatgagaaattatttaatgggtactatgtgtgttattcaggttatgaatacactgaaagctctgaattcaccactatgcaatatatctatgtaacaaaattacaattgtacaccataattttacacaaataaaagataaaataaaaaagtctttccacaaaactttctgactcaaatagtttcacaggtaaattatttcaaaaatttaatgaaaaaaaaatagcaccaatcatatacaactcttccaagggtagaaatagagggaatacatccgaactcattttatgagaataatataactatgcaaagaaaacctgacaagaacattaagagaaggtaaaattacaagctaatctctcttttgaatgcaaatagaaatatcttaaagaaaatattaagaaaatcaaattctctatgaaaaggataatataacatcaagtagggtttattctaagaatgcaagggtggattaacattcaaaaataaattaattaaataacaaaaatcctatgatctcaatagatccagaaatgtatgtgaatattccttatgatttaaaaaaaaaacaaaacagacaacacagaaacacacataaaacaacaacaccaactcagcaaactcacgaattgaagagaaattctctagtggatacaggaaatttacaattttcaaaaaagcaaaaaccaaacctagaacaaatgttatactagtggtcctagctagtgcacacaagtggtcctagctagtgcaacaagtcaaaaacacttataaattaaagttatatggaatgaaaaggtagaaataaaactgtagttattcacagaaaacatgactgtgttataaaaaattcaaaagaacccacaaagtctaatagaattaataagtaaatttagcaagattcctggccaaggtgaatctctctctctcctctctctttctgactctctctctctctctgtgtcatagatagatagatagatagatatgaattgttttcttatatagtaacaatacacatttagaaaataaaacttaaaatgataccaattacaagagcattaaaaaatctaattgtagaaatgaatctaacaaaaagtatgcaagtccactgtgcagaaaactataaaatattactgattaaagaagaataaaataagtatgaattataatgcatttatagattagatatcagtattcccaaaataccatctcaatcaaaatcccagcaaattacatattgtagagattaacaagcagattctaacatttttatggaaataaaaaggaacaagactaactaaaagaatctaaaagatgagcacagctaaaagatttacactaccagatattaagatttcttctaaatgttcactacttagtcatgcatcattgatgcaagggtaaataaatagattcctggaataagagtccagaaatatgtccatgaatatgtaggcagtacatttataataaagttattgctaacatactcagggaaagtatttttgacaaatggcacttgatcaattttttaaaaagaaaaaatgaatcctgtccatccttgcccccatctcacacctaacacaaaaaaatgaatttcaggtaaaatgcagacctacattttaatggcaaacaataaagattctagaagataacaaaggaaatgtctttatgacattaaggtaggcaaaagcttttccatttttttgtttttgttttaaacaggatagaaaatactaacactaaaagaagaaattgatcattgaagtgcattaaaataaaaaacttttgtaaccaaaagacaactataaggtcaggcgcggcggctcatgcctgtaatcccagcactttgggaggccaaggtggccagatcacctgaggtcgggagtttgagaccagcctggctaacatggtgaaaccccatctctactaaaaatacaaaaattaactgggcatggtggcataagcctgtaatcccagctacttgggaagctgaggcaggagaatcgcttgaactcaggaggcaaattttcagtgagccaagatcgcaccactgcactccagcctgggcgacagagtaagactctgtctcaaaaaagaaaaaaaagacaattataagagagtaaaaacataagcttcagaataaaagtagatatctgtaataagtatatctgacaaagaagtatatatcagaatataaaatgaaatcccagtaacttaataataaaaacagaaacaaacccaactggaaaatggacaatacctttcaacatgcacatcacaaaagaggatacccaagtggaaaataaacatatgaaaagacgcttaatttcactaatcattagagaaatgcaaaccaaagccatcatatcatgggctaccatgtcacacatgcctgaaaaactaaaatgaaaaaagaccaagtgttttcgacgagtagaacaataggatctctcttatacagtagtccccctttatccatggggaatacactccacctcccttagtgaatacctgaaactgcaaatagtacccaatcctacaaatactatgtttttttcctatacataaatacctatttaagatttaacgtatttatacctatttaagatttaatttatttaacattaatgtataaattaggaacagtatgagattaacaacatacttaatcataaaatagaacaattctagcactatactggttatatgaatgtggtctccctccctcctcttctctctctatttccctctcaaaacatctttttgtacttaagggtgagcccttcttgtgatgatatgagatgataaaatttgggctgcagctgactacggataactgaaactgtggaaaactgaaatcatgaatcaagtgggaggggcattactgtgctgctactgatcatgtaaattggtataataacattgaaaattatttggcactatctactaaagctgaacataagcacaccagcaatatcactcctcagcatatatccaataagaatgcttaaatatgtaaaacaagacatgtagtagaatatgcatgtggccaccacaattcataatggcttcaaactggaaataagccaaatgtccatctatagtagaagagctgaaaataataataatagaattgtgattatattaatacatggaaatattataaagcaataaaatagttttaaaatctgcaagcacatgtaaatgcaacataatataaatgaatctcagaaacataatgtgagcacaagaagccacatacagaagaatatataatcacatgattctatttctatatttttcaaaaataaactaatattagaagtcatgatagtggttatcctgaggaagtagagactggaaagatagataaagggatctttgtggtctgctaatgtttttttattggtctggtgctgcttacatgaatatgttcactttgtgaaaattcacttacctatatttttataatttctgaatttgtaactgttttcctgcactaaaatatttcatttaaaaattatctttaaaaacaattgcgaccataagaatttccattgcttttgtttttttttctctgttttcctgctacttagccttaaatatgggcatagtcacagaaatgtgcatatgaggtaaataaagccccagcttgctggctggaggacataaaggggagctccaggaaaactaaaaaatactaatgagagcacagagaaaaaggggctgcagaaagtgatcttatagggttacaaaattctgggctcatctttagctgtacatgcatggatctgatgttaatcagcatatgaatacaattaagaatgaaattaacagatagaccaatgtctacatccaagattgttcactggtatacacacaggacagacctgaaaagcaccgtaagcaaaactgatattgaaaccacagaaggaatcttgtatcttacaacctgaacctaaccaggtcaattgccttttaaaacaaaaatgtcaacattctccatagaatttcaatatgactcagaatctcataacatgatattaagaatatctaagaaataatcctaaatcaccaggcacaagaagaactaggaacatgtgaactcatatgagaaaacataatcaatggagataaaacctaaaatgacacagatgttggaattgtttgacaaaaactttaaatttactattctaaaaatgctgaaacaagcaatgagaaacaggcttaaaactcaaaaataaaattttaaaaaaatacaacaaaatatcactggatggtttccaacaaaataaagataatacagaaaacagtcaataaactttaagatagatcaactgaaattatgcaatatgagcaataaagaaaaaaagtggctcagaaacctgtgggacaataacaagaagtctagcattcatgtcattatattaacagaagcagagaagaaagagtgtgctatgtgttgaatgccccctccaaatctcatgtggaaatttaattgccattgtaacagtgttgagtatcaggacctttaagaggtaagtaagatagactaatgtcattaatgtgggagtttattagttatcacaggagtgagttgttgataaaaagaatagtttggcccagtgtcctctctgtcatgtgctttcttgccacatgatgccttccatcatgagatcacccttgttagatgctagcatcatgatcttagacttctcagcttttagaactgtgagccaaataaatatgtctgttctgtattaattatccaatttctggtattcttttatagcagcagaaaattgactaagattataattctgaaaaggtatttgacaaaatagtggctagaaaattctcaaattctgtgaaatacataaacccacagagtcaagaagtacagcaaaccccaaacagaaaaaaaaaaaatcaatctctggatacattaaaatagaactgctggaaattgaagacagggaaaactgtcttgaaagcatccagagaaaatcacacattatctgtagggaaacaccattcaaatgactgtggaattctcatcagaaaccatgaaaacctgaaggaaatggcaccccttttttaaaggtctgagagagcacagagaattctatatcctgtataaaagagacctgctctaaaacatttgctgaaaggaagctctccagacagaagacaaatgatacaacattgccactgatataaacactgaacattaggaatgaaggaagaggaaaaaaagtgataaacctatgagtaaatataagaaacgattattcttttgggttctttaaaacatgtttgacaatttaatgcaaaattacaacattatctgacggggcttccaatgtatgtagatataatatatgacaaaacaataatgcaaaactgggagagtaaaaggacttatatggttgtaagatttctacattctatttaaatgtctaaaatattgattctaagaagagtataaaaagatatgtatattgaacaactttagaacaacctctaaaaacaactatacaaagaaatatcgtcagaagaacaatagataaatttaaattgaatgctaaaaaatgttcaaataacccaaaacaaaacagaaaatgaaaaacaaaggaaaacagaagaaacaaacagaaaacaaaatataaaatgaaagacattaattcaaatgtaacaataattacattaaatgtaaatggcataaatataccaattaaagacagagattatcagaacggattttttttaatgacccaattatacactgttttcaacaaatttacttcaaatataatgaaaaaggtaggtttgaagaaaagtgtacgtgctgcaaactccaattataataaagctggaatggctatattaatattggacacagtagatctcaaagtgaagaaacctgccagtgatacaaaggacatcatataatgttgaagagttaattagccagtaatatataataagtctaaatctgtatgccctaacaacagagcttcaaaatacatgaagacataaaaactgacagaactgaaaggtgaaatggaaaaatctacaattatatttggagatatcaacacccttctctcagtaatagactaatatataattagtaaaaacagaactgaaaaaattagcttcataagagagagcatatgatcattcagaaacttaacagcatttaagagattatattccttaccaaatttttaggttaacatgagtaaggttttttgatatagccaactacagttttcgtaagagtaatggttacttcttcagagataagtcatatcagcagaggcagaaagctgagaatgggggaggtcaaatctttgtaagatgtaaactgaaaagaaagttttatagaaatgaatttctgctgatctcactgtgaaagtgcagttttcatacttttatgaaacaggcttgttactttgtttaaatatttgtgtaatccaaatagttttgacttcagttaagctgaatatttgctttaaatatttgtttttaaaccccatttatcaattctttagaatcttatataaaaggtacgtggtacttgcttaggaaaataatcaaaaatcagaaagtggcccttttaataatgtgaaatgattcaacaaacagaaaaccaatattttcttataaaatcagtaaggtggtaggtaggtagctataaaaatatttagatttttactacatattaatccttaaaagaaatcaggtaatgagtctgaaataagtttaatgtgtccttcttatttctattttagttacacacacacacatatacacacacactcttacagatagcaaaatatgctaaataggaagtaaacatggtactatggtatggattagtaagaaagtcctaccttagatagcattatctgagaaagtgttttttactttaagaaggattcgactaagcagtgtgagtttaagtgtcagggccagtgccagcatgcttcaatgagaacactgagaataagtgaaagttgaattgtcactggtttcttctaagctaagataaggtttggggcacctaaagtgcactcaactgcaaatactgttagaggccactcatcttccaagggaagtatcaggggaacataaaacttcattgagttctggctagaacaacatcttatgaagctaggtagattccatgtttctcttgctgataccaaggaacaaaggtaaacaaaggtgtcttcacttgcagctgccattgctgctgacaaagcttatctgcccacagagtggtgaatagtaattctaaaggaaacttcttgtctgccaagtagaactttgaagttctgtgtcatcccatgcaactaccccacaaagagcaggtgaatcctgaggtgaagggcactactgcccctatggtgccctgaaagttggagatcaagctttgagcccttcaccaactcaggataaaccagcacaattagacctcctataaatatgaaagaattctgataactccagctccagagattcttggacaagttactaaatggcagtagacagagacagcatagctgcaccttctgctgtatacctgaacactctagctaaaagtcagatatatctatccatgcactaagtggttgaggatcaatataaacaaaacacagttgcctgagttctgtttacagagcacatacgaaattgtctttttctctccacattgtttgcatcattcctaacccctgaattgaattcacttgttagctgcactgttgtgcaggtcttctgatcttgctttactgacttaatgacaaccactctctaaagactgacaaaaatcacactgtttcttttcacactgcccaactgaagtgggccaagttctcatcatcttagctctagtactcaaccttgaaatcatccacagagatgtcttccatgcaagatatttctcactgtaagggaagatgatggtaagtcatcatcttcaaatagaaatgatagctccaaagaggaaaaggaaaaacaactgccactccatcacctctctgactttggctttctagggaatcagttcttctgggtaaggttaaaccaacaaacaaacaaacaaaaaaatggaggtggggggtgtactttattctgttttgtttttaaagaaatggccacttttcatagatagagcaatataagtggaaaataaccaggaggttttagtgaaaatggaaaaggaaaaggcaaattttgtgacatactaggtctaacaattgtttaaatctaaagtttggtgccaaatagtgatggttttaattaatagatggatctgaaacacccatatatcatgctaaagatttagtattaaatatgttctactactgaaaataataccaaggtctctaacgacaagataaacacatgctatattgacaaaagtatgcaaaaaaatgctaatcaaactcagctcataggagcaggagctgaattgaatgatcttgttcccccaaaataaacttccaattcactactcaggttattttccaattgtcactgggacaacacaacaaaagcaggggacaaagttaaaacctggccttttcagtcaagcaagtggacaaatactcaagacaataacccacaaacaaggaagatgacagcggaaaatcccccacattcagttcacccctttgtgaccaaaccctgttctgcaggtcttctgatgacttagactttaagacagcaaggtagacatcctggaaataggccaataataatcttcaactaggaagacatactgaaatcactagggaagcttttttcaacataacctttccctccctcagctgggaatcatagattagatttaatttgtataatcacttcagtttgaagtaggtggatgacctgaagaaaattaaggtataatggcaggcttgccatcagcaagtacgcatttacaaacattttgacaagctatatctggaaatatcctgaggatccaagaatcttggttaactttatacaactacgataaattgggcactacaccaaaacatgcaggctatttgactctgcattttcctcaatcaacaacatgtaacggagaggcctaatataccaaatcattatcgaacagcttagggatgactcactttgacaggaagagcaaagtgtttcactctcatctcagtgaacctgttcatactgacataatgccacatggttcctaatacgcaacaatgtacactgttccagcaacatagaggcagctttgagcctttggatccaaattctgtgagtgagctgggctagagttttctgtttcccttccctcattatcatggcaacagagggcaaaggtggcagttaggctttatgcctggactgctggcatacaggtccacacctcttccaaaacaaaatttggacaatagttacacatgaaaatgttgtgttctgcttaggttataaggaaactaaatcatactgcaggcaactctttagttattttctcttttatcctatcttcaccagaaaatttaaagagctctaaaacagtgtttctcaaactgtaggtcacactgtcagtgctcttgaaattaagatagtgggctgtagactttaaaggaaagttaggataagataaaataggataagataaagtaggataggatgggatgggatgagatactagaggatagaatggaaaatgcaacacataggaagggtaaatactgtcttatgaaattttgttttaattatatgactgcatgtagactgtgtcatgatttaaatgcatttatctctgtggattattaggaaaatgtatgaaaaccactgccgtaaagaacatctatcttatggccctaacagcatttctctacagaaacactattggctttgtgactgggcaaatctcttttctaagtaatttcagctattcatggcaggatttaacatcatatctttcccctatccactgaattccagtagtgcttccttttcatcgtgacaaccacacattttaaatgctacctaggaggagttatcaccatctagagataaatatgaatccatagacaaaaggttgctagctcaactcatatctgatgagaagcaagtgtttctaagtatccttttgtatctagagtttgtcctccaggatgaatggaggtcagctttgatagctcttatctgggacgtgtacactgttccagctacttattctgcaaattaagtcttcctttcctagcacccatcaatctaatactaaattcattagcaaaatgaaatgaaaagaacacaacatacattgctattaatggaattccatgcatgtcactccccacacattgtactaaaaatgaactcatctccatttgagtgtctctacacaaatatctgtgtttattaatacacagcatttcagaagtgagattttccttaaagctgtaaagccatttgctttgtcaagctcccttttcagggaaaaacttcaggaattttcactatcaatttatgttgattatttactcttttgtggatctgctattctccaggcaaaatccaataaggagaaatcatgattactgtctaaagaatttattttgtaatattttttcttacttcctgtaacttactttgtgtgacagtaataaacagttcataatgctccatctactatcctcatccataaaatctagtaacagttcaacatttaaaaattttttaatgaagacaaaaatcagctggtgacttcctactggagcacaaaattaacacttgcactggagtgggtgagattttcttattcagagcagaatacagtctttttcttacggatttaaaaatcttagttacctttccctagcttgaaataataggcattttgggctgggcgcagtggctgatgtctgtaatcccagcactttgggaggccaaggcgagcagatcacttgaggtccggagtttgagaccagcctggccaacatggtgaaaccccatttctactaaaaatacaaaaaattagccagggtggtggcacacacctgtaatcctagttactcaggaggctgaggcaggagaatcacttgaaactaggaagcggaagaagttgccatgagccgagattgcaccactgcactccagcctggccaatagagtgagagtctgtctcagaaaaaaaaaaaaagaaagaaaaagaaagtaataataggcattttgaagacttcaggagaaatagctagaattcataaattacccagaagtgataacactgtacttagattttcacacataaattttcctattcctggatagtgtgggaccaaactatatataaccaagttttaaggtgaccaaaaattaaaattcacaaatactctgaatgtctcaactactttccttccagaaacccaagaaaaactgaagtgatttctcacttcccctaatgagcactaatgacaattagagatgaacagctaacctcaaacacactaaagagtgtttttaaaacagaataccacacaggttgtataaggcttatcttcaaacattttcctcaataaaatgttaataaacaaaaaaaattgacatgagggaaaagagaattggaatgaagaatatcctcctttacttttaaatgacaaaattaacaaacatgagagaaaacaccatttttaaaatgaaaagatcactcatatgagagaaggcagatcacatagtggaatgtctaaggggaaatccaggtggattgcccactggagtatacagttaaaaaatatccaaaggaagaaagaaaagacattagatatttggaaaggtaagtaactaagtaaataaataaataagaaaaatgatgacaaatttgcaagggacaccaacaccaaatgcggtttttgttttttgttgttttgtttgtatgccaaagagaatcagtcagctagtaacaagtaaggaaattcaaacagtagttgttctaggtcaaaaacaaaagatatatatgtacacacacaccacacacacacacatctatatttatatacatacacacacacacacacacacacacacacacacttggagactctcatgcctcaaatatattttgaagcatacaaatttagagagtctagatttaaaacagtggcaaatacaaaagtctttcttaattaaaaagctagctgcagataagtcactagcatcaaataggtaccaatcaaaagtaaaactgtgctcagaaaaactaacttgttcttaaaatggccattttcacaaagtactgaaagattggcaatgtggccaaattcccccaaaaaaggggtttagaagcagcctttgtaaccaaaggcaaacagtgggaatatgtataaaacaggaagatacacgaaaagcttttgcccacttggtgaattgagcctctctatctaggcttcttgtggcattaaagaagcatctgcaaatgcagtaactagaatatataatctattcagattttcaaaaggcttttgagaaagtttcatagcaataactgtgcaaataaattttgggtaaacatggaattagaaatacatattttcacaagcacaaaactatgttagatataggaagaaaatgtgaagtggaaatgatgagagaatgcttttataaattttgactgtggaattcaaagtgtcaactgcacatatttatatttcactatccttttcaaatagtaaaatatcaaaccacagcatcacggaatcctaaagagctgggatgactccctacgtactacagattaagaaactgagctacagaggattaataattgcccaaggttaaaacatatagacatcaggaagatttcataacgtttacaaacttgaacaaaaagtaccacatgagctcccctatggggatgtgttgagtattatatttcactagtgataaagaatacaaaactgttcacataaatgtggcctttaaaatatggtccctaaacaagaaccttaaaagaattataatacattccctgaaaacatttcaatgtgttctggttacaaagatattcaaaattctagacatcatcagaagtgctttggatccagtcttagggagatccaacatttaatagctatcagaaaaaaatgcctgcaaaggacatagtgaggatatcagaaaaaaatgcctgcaaaggacatagtgaggaaatgacaaggagcataggaagaaaatcaagaaagcatgacgccatgaaaaataagggaagaaagcattgcaataaggaaggagtggtcagcaagatcaaatgctcagtgaggtcccagtgagagttaatttggagaagtgatggaggtccctgcagcagacaaggtgaattgctgaatggattggtgaagaaatggaaatagagagtagaaacatttctttgaagaaatgtgagtgtccttctacaggtaaaaaaaaaaaaaatacatgataactggtcaatctctgaaagtgtgggtccagcggttttaagaggagattcagtattacccaccatactcgttttttttttttaaccataattcctagtcaaatatgtcataagcccaggaaaaggatctcaaaagaacttagaactatcctccttcaatacaaaaaataaaaggcatctggtttgcagtagggttgtagaccttgcaagacttctgcattttggtttaatcagagattttccagaagtctaaaaataattattcatctttgaaaaataagggtaccatacagctatctagctctgtaatccaaggaaaaatcaattatcttaaaagatgccttatgaggtcattgtttcacatgataaaacaagaacattaggaggacaagtctcggttggaagtctcagatcactctaattgttctaattgatgaatcttcttcaaggaaaaaagtgggctccatttctgtttttaaaaatccagagtatctgtagtagtgcaactaatgacaaccttcccgttgttcttgcctaagaggaaaccctataataagagcttcccaaaatgtcaaataatacttgtctcataacagggcttctttgttcattcaccatgtctcttttgatatgcacagataataaaagttcatataaaactaaaggtaatatagagcagaagccaacactaattctgtataaatatgtctgattaataagaatgctattgttatggttatttcataatgtcacgattgttacaagaacagaggatagaagtactcttactcttactgttttcgttcatcctctgtcatccaaccagtttgcaaatttctgttcaacgggaaaaatgaaggatagatttttgtccattaattactgctgttgcataagttagtctcataaattgtgaaatgagcattaaattcagggaaaaattaggggttttattttaaaattgaactccacttccactacaaaaatgaatacatgctccaggcttactttctaagctcccttttccacatgcacagttgctatattcttctggtgctcatgaacacatgaaagatagaatttagcatgatagcactaaaatctaggtaagagcctagtatattaaacctaaactgtggtttaatacaacaaccatacacaaaattgtatatgggatttggttccaaaaattagaaccccaccctggtgaagtaataagtaaccccacccagatgtgagtatctggtcccttactggaaaggaaataaaaacaagtaataagataacagtctacactcactgcagacagacagcccgatagattttgaaggaaattctaaggctggtagataagtttgtattgtcattattttgcttttctctttaaattcttatctcctagatcctggtattcccccttggggcagcagtataatataaaagcttaacagtcgatcttaaatttagctgacatttttatatccttcaaaacataccttttagattgcacccaagaaggagattattaaatagtagcaggagaccagttagtggaccattttgactgaacaaaaaacagcactgtgccttcttgttgacaaaccaaaaaacatttatatagtcattataatcaatttcataaataaaaggctattaatgactgagaaaaaaagggaaaaactgtatttctcccaagtcccttcatcctctcttaaactccatattagtttaagaaagtggaggaagctatgcatgaaaaatagtgtacttagttgagctggagtctcttgtgaaacaggttctgtcagtcagaaggcaagggtacatttctataattatttaagcctagtttttttgtagtaattagccagagctccattttgctgaagctggcatcactcacagctcacttttttttttcaatttagacttttcattcctttttataaaataaatttacatattttcagtctctcaatccctcctatgttttatttatgaatatagcccttcttgatggtaactctaatgtgaaagaggtagtaattaatgtcccaatctgctaggttaatccctttccacactctctatagagaagtttaaggtaagtaacagtttacagtcaatattaggtttaattatgcttaatgagagttggtgtctctgtttactaactgcatttaggtgtgtggatcctagatgaattttcccttggcctcattctgatttgttaatagtgccactgtgtactgtatactcagtgcttaaatctataaagctgcttctggagaacaaagcaagtaaggcacctgtttcagttgaaacattattaaacaaatgagtgaagttttaccgcaaccacatctttctttgggaaggtgctgttattttataatgctttccaaacaggtccatgtaaaaggctaattgctgcctaaattcaagatcctaggttaagtctatacatattaaaaaatgtttcaaactaagtacaataatcaatggtgagtattttaaaactatggagtattaaacacttctaagactttctgtattaatctttcaatgttttcattccaagtactataattgaaaactactttgacaagtagtttttttgccttgaaaatgtcttttgtcttaaaattatattcaactttgttgctgtgtataagacaaaacttttgtttccttactgaaactataaaaataagcatcaaaacaaacaccttggcctcaaggaaatcagatagtaagccgagggaaatttagtaaacaaatttttaaagaacccctttttcctatatttttgttatggataaattatgtatacaactgaccatgtagtttctttaagtccattcatagtctaatcaatttagtaaacatttattgagtaaatactttgagctaagcacaaaaatgaacatgacatactcccttctctcaagaagcttaccatctagaaaggagccaggcatgagttaaaaactttaataggctgggtgcagaggcttacacctgtaatctcagcactttgggaggccaaggtgggtggatcacctgaggtcgggagttcaaaaccagcctggtcaacatggtgaaaccccgtctctaccaaaaatacaaaaattagccaggtgtggtggagcacgcctgtaattccagctacttgggaacctgaggcatgagaaatgcttgaatccgggaggcagaagttgcaatgagccaagattgggccactgcactccagcctgggcaacagagtgcgagtctgtctcaaaaagcaaacaaacaaacaaaacccaaaaaacactatgctacaatatggtaaatcatactcatgcattaagaagacacagaaaagatcagttgatctgtagaggataaataaggcctctgctggtgaaatagcaagttttttctgggtcatgtgcagactatagcaggctaaatgaacagtaagagcaaaggcagaaagcatggcatccacagtgtatttaaaagacagcaaacagtgaagtgtgtgttgaaagaactatgtgcctgggtggaggaggcggggggtgatgggaagagatatgggagtttggaagttaggggctcaaagagtggactgagaccgaattaagaattttcaatgtcatcttgtgttagcttttatgtaatatgagggataggaaaaggtaaagagataacactactaaacaaggataaggtctgaataaattccttcaaattaaactgaattcttctaagcctactgatctttgaaaaacattttcaaatttcaaacctcccataatgttatttggaagcccttgcatttagatcaaagaatttgtgccatgtggaaaaaaattcctaaaatatgtctatctgaaagatgggatgataacatattaatggaagccagtagaaagagaagctgttaggtttataccccagggaatcctgagaaatctgcaaataattaaatgtactttgtgatataaaaatctgtttataattaatttcagaaattttctgccttttgaaaattctcccttagttaatatatcatgatgttgtttttgttttttaaattttaattggcaactaaaagttgtatatacttatgatatacaacatgctatttttaacgcatgccttactccacatatttttgtagtgagaagacttaaggtatactctcatagcaatttttaagtatagagtatatttttatttacacaatgtacaacatatctcttcaacttattcctcctgtctaagtgaaattttgtaccccttgaccagcagctccccagtctctcatcccagcctctggtaaccaacattatactctccgtttctatgagcttgacttttttagattccacatataagtgagatcatgcagcatttgtctttctgtacctggcttatttcacttaaaaatcctccaggtctatccatgttgtcacaaataacagcattttcttttttaaagatgacttacattgcatcatgtttatgtatattattatctattcctccattgatggtcacatgataacatccattctgacaggtgtgaggtggtactcactgtggttttaatttgcatttctccgatgattagtgatgttgagcattttttcatatacccattaaccatttgtatgtcttcttttgagatacgtctattcaggtcctttgcctatttttcagttgggttatttgttttcttactattgagttgtttgagttccttatatattttggatattaaccccttatcaggtgtacattttgaaaacatattcttccattccttaggttgtgtctttactgttaagtgtttgcttttagaaaaataaaaaaagaggcaaacatttccttaaaatccataaactaatgagttttaaaagaaaagaatgccatccaaactacctaatcagaaaaagactttctacagcttagatcctgtttttatagtattttagaaatgtctaaacacatggcctatgacaaatacttgcctctttttggaacatcaattacttctttgtaacggtatactgatttccttttaaggaataatctctttcccttccagtatagtattggtgagacggtaactccaggttcaaagataaacttggggaaattaggtagataaaaacagagaacatgcaaaaaaataaagaagcacacgaggtgaatgaagaaaaatgtagcaaatttatcagaaagatggaaattgtttaaaaaagttttaatattttctaaatatggtgaacatttctccaatttaaataatcatcagttatttaacactttctatgtgctaggtattcaattcatcaatttattaataatatctccaatcctaattataaccccaagagatagatgttattttttccattttattttatcggtgtgtaggcttaaacccagagaactaaagtaatttgcccaactgttagtgaatagttcagtcaagactgaatctcaaatccagtggaaaataaaatggtatgtccagtataggaagtacaaaacatacaggttaaataaacaaacgttcacatatacctatcaataaagaactccaaaattacatcagtctgttaaaaacaagccactcaaagctctagagttaactaaggtagtaacataattctgaaattaaaatgaaaatatttacataaagttaaatatttttttaaaaaatctttaaaaagtacactcaaacatactgggaaaacatttttcatgggaaacattttaggataatactatctattctataagaaaagagtcaccttcctgaagagttctttgctttcagtgctgttgcctaaattaactttctgttatgaaacacatcacgctagttttaacctagagaataatttgaacaaaaccaagttaaccatttctaaaatacttaaaatacaaagaggtggttgtgtaaccttgaagataattattcagatgtttttaagtattcatctctccatagtattttagatttaattttgtgaatttagcaacaaagaacacagtttagcacaaaatgagaaaacctgttcagaagtgaagaaatcatctaaatattaatagattttattaaatagcagcagaaaacgttatacttggtgttattttcagctatataaatatcttatttttatccaataaaaaacatactaaattcctccatttcaaatactgatgatatcagcaaagtgttcacacatctggatatctttctgtgtttacctaaactgacctttctggtatgtactgtactttctatctcagtatcttcagtgtacatttgcaaaaactacttgaacagtttacattctcccacaccatgctacttcaaatggtcttcaagactttcaaattactgtcagacactgggcattttgtaggcatatacttttgcattcctcctcaagggaaaaaaaaggggggaaagcctagattcaaatggtaataaagtctctttcaccctgataaatacatttaaaaagttgatctcggctggtcgcagtggctcacgcctgtaatctcaacactttgggaggccgaagcgggtggatcacccgaggtcaggagttcaagaccagcctggccaatgtggtgaaaccccatctctactaaaaatacaaaaattagccaggcgtggtggcgggcacctataatcccagctactcaggaggctgaggcacgagaattgcttgaacccaggaggcggaggttgcagtgagccaagatcaccccattgcactccaacctaggtgacacagcgagactctgtctcaaaaaaaaaaaaaagagttgatctcatcctgatgctagagttgtataaaagaagatcttagtgttaactcacaagctattatataaaaatatttgtatatatgtataccaatgtactatgcataaacacatttgaatatagcatgcgtatatatgcaatctatttagtatatttgaatgtatatattatatatagatacatatgcatttacatttccacatttattccaaaaacttagagagaaaatacttaaactgttttcaaaatacaaattctaaatgaaataaaatgttctttaaaaactgtaattaatggctgttatgtcaaactgtgaaccaaaaaggtcaaaccttataatttacagtttgagaggtcatacctcaaattataaccttaaaaaactgattatttgtgagtaatttgacaaatgcatctaatataaactgaatgcatatgaaatatttttgcgagtaaaaagaatgtatgtccaagtggacagctgatggaggaaatagccttttactgaacaaggctgaagtccaacataatgacttggaatgcctttgaataagcatgcaggttggaaggccaaacagtacacacatccaaaagggagcataatgaactatctgatcagaagacaaaaatactccacatatacacccaatgagaaaaaagaaaacacacttcggtcacctcctcttttttcatcattactataccccaattcacgaatgaactctgggctattgataaataatcatcaaaagaaatgatttttataatttaaaaatactagaaattcctataatattccaatctgagattttcaaatgtctatggagatcttctatatcatataaagtaagccaggtttacaaaactgtttacgactcatcttggatgcaaatattaccacacctagcttcatctcaaagccacctgctccttaaaacataatctgaaatactttggcctctccacaatttttaatctacaagtcatccaccattaagaaggcagatcattgaagataattttctccaccgtagactcaattccctaacccaagctagaattgagaaggttagcaaaatagtcatttattaatatatctatgtctctaatatttatttatgtgcttattatatctccctgttagactataagctcaacaaggataaagactaagtctcttttgttcaacagttatctataacatctacaaagtttctggcacagagctagcattccataaatattcgctagaaaatggaaagaaggggttgacagaagaaaggagggaggattgagttagctagtctcctctagtattatttgtgcaattgtggagagaaaaatccctaaaaatgtacactgtatttaatcaatttacccatccaacaattcactgatacatcgatccttgaaaccaaaaagatttaaaatggcttccaaaagtacacaattatacaataaaataaattaaaacagatgaaaaatgaaagggatacaaaatatagttgggaacaggatatttctatacgtatactggtaaagtcagttaaatcacaggaaagagaaggaatttgctttttaatttctccaatttaaccttattgtaactactattataatagtgttataaacactaagcaaatatttactcgttccttatctaaccattactatggcaaatactctataaccaggtaccttatattatgagccaggcaatctattggatgagacaaatattcagttataagaaagtataatatgtatgttataacagtaaaattatagatttttgtaggagagaaaagtaggattctctgaaccaacaaaaatgcttacatggtaactgctgaactatgaacccaatacttcatgtaccaagagatttttctgatacatgtaaatatgcatagttcttgatacacagggaaatatgtggtctcaaatgttaccagtacaaatgagacttgcacatgtaaatcacaatatgataagaaaacacatttgaaaagcattatctttcttgtaagtgaaagcttaaatctgattccacttagcctggtaagtgtttttgtcattccgttgggccagcccacacatactgggctcttgataggtcctgggctcaaccagctggccctttgtgtacttaattctttttttaatactgacgagtgtattagtaacacttccttgatcactggtaaatatacagctaccacacaactaagattttccttaattctgaaattcactaattagttgtgggtacgggttagtattacaaaggtatgttgagtggtactacaatgagtaatgtaattcccaaaaagaactgtgttaatttacttcccacttcattagaggaataaaaaacatcttattatcactaaaggatacagaaagagacctgggtattttagggaatggtagacagggagaaagcatgaatgcagcattgaggcaagaaacacaaatcacctatacatcttggacaatgttcgtgcttcttcttaatactttctgcttgcttcatttattagtgtgtttcatgaaaacattttattcaattaataaacaggtttccaaagaaagcaaataaggtaaatgattcctattttcaaaaacttatcattctactggtacgtaagttatgcattagtcaactctggaagctgcattaatcttttcaagccaataaggtcacaatcaattacttgagatagcagaataaaatacaggcttaaaagaaataatgcagccgggggcggtggctcacgcctgtaatcccagcactttgggaggccgaggcgggcagatcacgaggtcagcagatcgagaccatcctggctaacgcggtgaaacctcgtgtctactaaaaatacaaaaaattagccaggcatggtagtgggcgcctgtagtcccagctacttgggaggctaaggcaggagaatagcaagaacccgggaggtggagcttgcagtgagcccagatcatgccactgcactccagcctgggcaacagagcgagactccgtcaaaaaaaaaaaaaagataatgcaatttccaaaggtgctaccaagtcatttagagagaacatatggtacaattatgagtatcaaaactgggaatttatatattttaagcctaccataaaacatatttactttttttcttttgttggatgagagatattctaacgctgtttattttttcggaagattcagattattcaaagtgtatcagctgattgttatgtgtgttaattcaagcactgagtttaaataatcataactcaactccctaaaactgaagattctgtgtaaggttgggccagtgccctcattcctaggatcaaaccatgtaagaccagacaaaggtctcagagattttggggggttccagtctttctcctttgtccatagacgtgttagggaaaggatgacattttcttatagtacttaccccaaataactaaaatctcaacaaaaaatagataaaagtgcggattgtaaaataggtgttaataattccttaatcaaatcttgtaactaatgaaaaaacactagtttatatgcagaagtaaactgacgaaaggatgaacagaataaacaaggaggaaaagacacatttttaaatatgtaatttagaaactgtcaaaaaaagtgggacatgtcttatttaactggtgtatgagaagaatggatggttttacaggcacataaatgcaggtacagaaaggtaataggagctttgtattacaatggaacttaaactcctctgggcagtgatcagctaagatggaacagagacagttacaatgcaatgattaactagtggacaaagctattatttatggcaggtatgtaagcaattggggcagcaatgttggaggcccctcctcatcaagcagctttgccagtacagactggatgcctggaaccaggaaagacacaaaaacaataaaacctagagccagctaagggagattcaatgcaatccatctccaaattttaaatattactggaaatctacactgaagaatgttttcccttgggattggcatacactgtggttatagaatgttgaccaacacttacctttatttatctcactatgcagagcaatatgcctaaaatacctacttagaaattctcattatattacagaaaaaggagattctaacattagttggcaaaaatttttgttgataggcatgaacatcatgtcattacatgaacagatcattaaagtgagtccatttcattgacagtatatattgtgggtctttttattctgaacaaccaaacaaaacaaacacacaagaggtcattgtgccttccctcatttggttggcagctttatctgtaaaatatgaaaataaaaaactaacatggactacaatcctgcatgtaccattggtacctgcatagtaccatttctgcataagatttaatcaaatattttattcatgttctgaaatcctgatatttgtgaagatggaaaaatacacgggatatttttaactttcaacttcatgatctccagtaaaagtagaaaaataatcatatttcatattatttggttttttgagctagccaaaaaattattagtatacaagaaaaaaggaagttaccactcttcacttgtcttcaggtcttttaatgtaatctcaggaaaaaaacatatttaacaaaaatggaaattatcatgttaaaatctattccactttgaaaagcgatattctttctccctctcagataattttaaatataaacctgaaatgttcataaccaaataaatcgtctagcagataaccaatcaccaaacattaattttacacaatgaggtttctttaatttctctctgtctctctcacagacacacacacacacacacattcacacagacaggttgctaacttgattcttagtatggtaacttaaactcataaccactccaaaatatactttaccttgattttgtgaataaaaataaataatcttatggggcaaggcagggataaaaattagaagtatatttctaactttaatagctaataataaaaagaacagcagaaattactgaaaattatattgctaaaatgtatctgtacatgtggctgtgaaaacttacgtgcaaagagaattctcgttaactaccttcagaaagaggtaatgaaatatgaggtttaagagtacatctttagtacttctgtaccttaaaatattgccgagtattaatttttcatcaagttgtcattttctctgacatttggttttattaatcaaggcatttatcattaatttgtagaaaatatcgtaattaagccaaataaaataaaatccttaaaaggttaaaattagaaagcaggtgaattagaactttgacattaccctgttgacatacaggagctttctggaagtatgagaatgaagtttttttcagtgagtttggtgcctcgatcttggggctggctggtttttaaaaaatgttataaagatttgatttaaacctctctgacagttttgacattcaggtgaaagtactgctgctgcatttggaacaatttgcatatcccactgctaaacggaatgtttgaggtgtgcactggtgtaaagaaattaaaaacaagctatcacacatgcttaagtgtatgtattcacaaaactgatggttggatcgcaccaccccatccccctccaatgtaatctgtgatttactcttctataataaattaccctaccatgttagtctcactggaaaatctaaccatgcatgtaagaagaaaagtaattacagccccctcttgtctaagaagcctccttcaatccctgtgagctctttatacacaatgcagccacacgagtctattgtaaacttcttgcctgaaattctggacttctgactatcagtagccactaaatctcatctgaagagtttcaatgtccccaacaaatacaattttatttcttatagttaattgtaaagctcttcctcaggagaaattgttactgacattctgactttaagccaatatgtctgtttaacaaaagaacacagtttaaaatcatgagttccaaaccagttaaaaaaaaaaaaaaaaaggaggacagagggacataatacataatgaaatagaaggaacaagagttagagcaacacctaattaagctgaaatattcagaaagagtataaaatttctactttttaacttacaatttcatattatttttaggtatacatagaaaaagatatttaatgtgtttaaggacaataaaagaaaaataataaaataaaagaaaagttgaggtagcaaatccaagaccttaaatattataagacaattcaagaagataaagcccattcaggaaaataccactggacattaccttcagccttcagagtcccaaaggcaattcttaacacttctttttatttgtctgtaaaaaaaggaatacttaaaattagaaatctgccaaggaaaacatttgcatttctataatatctttatgacccaggtagctgagtttgtgtatgccaactaatatctatagttttaaaaagaaaactgaaagctaacacattcatatgtgtacaagtactcagtaaaacgtggcccaaatatacaatctaaaccactgcatatacatttttgaggaggcatagcacggtgtttgctatagtatcataagaagttatcttaactcataaggatatttgcatttttatttcatgttttcttttaagaaaagcaaatcccaaattgcttttaacctatttacttgctcattcttattaacagagagttcgcaaagttctatgatgtataatgtactggtcatcactggtgagtttaaaagtatgcaaagataaaacacaagccctattctcaaaatagtaggtaaggttagagatatttgcataaactcagataaaccaaagaaaataaaaagaaaatgggtggaaagaaataaagatgcaaagggtaacatgttcagtacagcttagtacctaaggcattgacattaaaacatggcttaatatttcctgttttagcagaaaggctaatagtagggtcctacccatatttagatgcaaggatgccaaacaaatggatgggttgcttttaaatttctttagtaaagaattgaagctggatgggaacaggcaggatgttgagtttactttaaagccaatttggtgattttgactatagaaagatttaactaaaaacagctctcctattaaaaattgaatttgatgttgtgttcccattagaaaatgatctctctaaatttgctatgaaatctcaatgatgaccttgatgccacatttactaataatctccacagagatttaggcattcaaagtttcaaaagcagttttaataatggaaatgcaatacctaaacatatgcttgattatataatctagtacatctacagtaaaatgcccattaaaattttaaaaatctgaggattttaattgactatatcattaatatgcatgcacagtatttttgcaaacaacaaaccacactagtaaaccaaaacaaacctaaggattggttgcactaatagacaaatagggtccagaaaaggaatctgacactcctgttatatttggggtgcatcagcattattacagttattctgcatcagcaaactaggagggatgctaaaagttagtaactgctaggaggagtgagaccagaacaattaatgatgaagaaataggatgattaggaacagaaaagaaaaaatgttctgatcatagagataaagtggaggacacctttgagaaaattaatttggtaactacatgatatattacaaaagttacttttattaatttattacctgtctcttcctctagaatggaagtaacataagggcaggcactttctctttttcactgtaaccccattttcttgaatagtgcctgccatatactaggatatcaatgaatatgtactcagtgaatgaatgaacagcctaaccaataaaacaggcactaaatctgtatctatttacagatgagaaatttaggcttaaagaaattaaatcatgtacaccaaattaaattgtcattctgcaactacaaacttctacaatgcattctttattcttccattcaatattcattctagcaacaggagaaacagacaataaacaaataaactgttagacttataatgtcatataattagtactatgaagtcagataaaacaagataatgacactgagagttacctggcctgatattttagatagatttggacagggaaacttctcaaaggacgtaagaataataagaaacctgaatcaagtaaagaagacagtcaaaacaaaaaaatctgaaggactggctgggtgaggtggctcacacctgtaatcccagcagttcgggaggccgaggcaggcggatcacctgaggtcagaagttcaagaccagcctgctcaacatggcgaaaccccatctctactaaaatacaaaaaattagccgggcgtggtggcgggcacctgtaatcccagctactcaggaggctgaagcaggagaattgcttgatcctaagaggtggaggttgcagtgagccaagatcgcgccactgcccttcagcctgggtgataagagcaaaactccgcctcaaaaaaaaaaaaaaatctgaaggaccgtttgaattgttttaggattaaataatacatatttccttgcctagtataatggccagcatataccaaacagtgtactcaatactttttattatattgctaatatttttataaattatgtttccccactagattacattgtcaaaggcatttactgttattttccttaaggttccttaaatagtgcctagcaagagctcaataaacacttagagaacaaaaatagaaagacacaattttcagttcattaattagaaaataaacagactacatgaatatgaaaaagtcaccatctttcgtatacctgaatcaatcaaactctgttaaatcaatttcacataatatttcacctttcctaaattaaaaaaaaaagaaaaaggggaaaatatattaaatggctagggccaagaagtcatagataacaaaagaataagaaagaatcagaagaaaattaagttattaacatgaggccactctctttactatttacatgctgtctgactccatcagattaacacatttttccagtgaagggacattgctacacagatatctgattcatttatgtattcctaatgcaagcacaagccttgctatgtaacaaataatcaaaaaaatctttgttgtcctgaaatgaactaaaatgatgtttagtagttttgatgctttaaagctagctcaaaacaataacaacaaaccaggggactgacaaacttaaaaaacaaatttaaatgagaaaacatcaagcattaggtttgagtcctatagcaaagaagcagagaacaaggtaggttctttccaaagagttaaatataagtgacagtgtgatattggcattggaagagatagatcagtagaagaggccaggggaacttaggtatggggtaaatgttacaagtaacatttccatgaacaatgttgagatagctgactgattacctgtggcaaaataaattctgttctctaattcttatcagtactaaaatataaatcaggtcaataaaactcaatataatatataaaacaatcaaggacctctaagaaaatacatatgtataattttctgaactccaatgtgggaaggacttttaaagtacatacacagtggtatataatataagcataaagatttatgatgtttactacttaaaattaaaaattttagcctgggcaacatggtgaaaccctgtctccacaaaaaatacaaaaattagttggacatggtggtgcacaactgtagtcccagctactcaggaggctgaggtgggaggatcacctgagcctggagaggtcaaggctacagtgaaccatgatcctgccactgtactccagtatgggcaagagaacaagacccagtctcaaaaaaaaaaaaaaaaaaagtgtaaggcagaaaacatctttaacaaaattcaaacttaagaggccaataaaaaataaatatttttaaagtgtataatgttcattgggttaagagtctttataaataaataaacatattattctactttttaaaatgagcaaaatacatgaataggcaattcacaatagaattgtgagttctcttctaaaatatggaatgcatttataaatatatttaaacatatataaaatatattttaaactatatataaaatagtaatacttattactatttattattaaataatattattaattctaatacctataagtaataaggtgaaataagaagctaaaatacatatgaaataatattaatctgcaatagcaatgaaagaaatgcaaattaaataaactaaaatattttagaatagtgaactggttagataaattatatgtaataggatattaagtgttcattagacatggcaagtgaaaatatataatacatcattaagcttagaaaacaggttataaaatggtaataatgataacataccataccaatatttaataatttttctctatataatataaatacagactatgcacaacttttggttatgtgcatatgtaagtatagatctgtatgtaccaggtgtgtgtgtgtgtgtgtgcttgtgtgtgcattagaaaaagtatgtatgtgactgtaaaaaacttaaactacattattctttgaatttatcttaagattatgacagtttttttcttcttagaatttgtttccaaattttctgtaataaaaacaaattactttttataaacataaaaagcactaaagaaggcacctagtttatgtttcaggaaagaaaaatttaatttatattattagaattcctgaatgttaagaaagacatttgaaaatgtctatctgtcatttttggtgaaacctttttaactgcatagatttttttagagaaaaaaaaatgtaaggaaggaaaggagaaagggcaggtatcgtgaggaagggaagagaacaacaaagaaagaaaaataggatttataaagataacagcaactactcagaatggtatctattaggttcctagcaaccaaattttaactggtaacatctccaattaaactttcaaagaaaagcacagcctggaatgtagaaaacttaagttggaggttacatttatactgtgaacatacttttacaagagaaaatagatgaaatgttcatcgatttcaatgataggactactgtataaagagagacaaaatacaccatgagaacataagatgctccaaatcagttttggaaataggagtagtataaatttcaattaagtaaaagtttaaagtaagcaaattttaagtagctataaaatcatgctgttcattcccatataagaaattttcaatccatagtccttaacatgtcattcaaaacatatgaccctacaacatatgaactatgacttctggttaattgtttcaatggacattattttgtataaggccttcccaatgagtacaaaatgaatagaaactgttaaagaccattatctattaataattatagcaaacaagtcttcattaaataaaaatttaaacataaggtttaattgtattttattttaaaaggcaaatgaaagccaattgatcatcctgaaagatcataaagaacctgtacagttccatcgtcaagaagacaaggatacattccttcaaagactggaaaagctttaatttcagttcatccataatcatgcatcctaaggtggaggtattcattttggatttggatatattattagagtttttaaaacaccagggaaatctggtaagttctatggtatattctcaaagaacatttcataagattggtctggctaaaccccatactaaagccatctgaaataaagtcaaattccatggagctggagctcgagagcaacaacaaaagaccattcactgactcagttatacttgctcttaggtatttcaggttcgcttctaaatagggggaaaaagtacagaaagattaggtactaaatactgtttttaactctaaaatacaatcaatttttttctttacttgtctgtttaaaagtaacccgagcccttccttttattatgtgaagcttcattctgtttatttttatttcccaagagcagaatgccttaaataaattcttaaaaaccaacacatcaacaaataaataaattaaaactcagtgactataaaaagtacacaatctaacctgcttaattattaacaggtaaacacaatgaacttctaaattatttacttaatccccttcaactaaaaactttaaagtttttgggcttgaaatgtatatcctttctaagggtccataaaacaattatttaaaaatctatttagccattttagtaaaagcaattttaaaataccaaggtaaatatgcacttaaacatttacataagttcataaaaaatagaagactttttttaaatttcacaggtcagtaaaattatttttcttccagctttccctagtcttctgtcagatatttcactccaccatgagcagaaatattcagtactaaattatattagattgatataatagttttgaagtaagcatttatagaatactcttattcctgagtataccataagaaatgtataattatgaaactataaaaatattaataattttgaaacttcaagaaaaaaagaatgaataaattaaaaaatcaccattttctccagataagactggactattttcaccagcgtagctaatcactgaagaaagattgctgcttgatgcaagtaaccattgattacctgaaatgttggttagttaaatgttctggttagctaagggttctagggggaaaggtgtttttgtttttagatcattttaactaaaaatataagatgttctactagatttctctgctttagtaaatagggaattataattttatctttcacttaaaatgaaaaaattatgttgccttagaggatggctcttgaacttttgggaagtcagaagggcctctgggacgatgaaaaaaaaccaagaatcttttttctctagaaaagtgcatatgatcacgaaattttgtatgaaatttccagggatccagagacccaataaaaaccccttgctttctaattttacagaattctaaataactagacataggagattgcactcatacagtaacccccaggacaaaaggagaatgtttgaagttccttcagaagacaggcctaataatgagctattttgttatgatttgtaacctttcttctaaaaggggtgtgtaaaaacaattcttgttaatttagtcttggttaaaggttaaatatgtttcctttaaggacaattgcattacaaggtatttgagctttgaaacaaaatagtgctgctttaaaatcattccacattttagaagtgacagcaattttcttcctatatttttgtaacaatagaaggcagagtcaaagagaaatctatttaattttcatctttacttctaaagattaacagataatagcaaatacatgagcagtccccatattcaggttctgttcaaagcgcttttatttgtatttacttatttaaacctaacaaaaactctaggaggtaggtaatatcatcatacccactttatcaatgtgtaaactaaggaacagagggagtaagtaatttgccaaaggacacccttttactgagcggcagaaccaggatttatgcccccgtcaatctggttgcagagttcggattcctacagaccatgttccatttccagctttaatctttcatgagttcttcaatctttcatgagttgatggtttttcttgtgtgttattatatttaacacaagtctacttcttcactaccatgcaaggaactttcatactggttttcccagaaaaattcatttggtgaattgttcataagatgctgacaaaactggccccacctttgtgcagctggcagttttataccatagtaaatttcccagagtcaatgccaaaaattaaaaaactaaggtaccaccagctagtaagtgtggaattatacaatcaaagctgacctctcatttcctttttggaaatagttttcatgggataaatatgtgaatgattatattccaaaggcaaccaagacaacagtataaatgggcaatattatcataataacttctcaaaggcaggattgtctgctattcctaattcatctgatgagaggtacaccagtcgatacaacttttaatttctagtcctaaatcatttctatgaaataacatgtcaaagtaaaatgcatacttaatgagggccagcaaggggccaaatttgcagtatgactattttcttgaaatatcctcttggcagattgctaccaaagacagcaaccaatttgtaatgcaggatttgcttttagtgtaccaatctttacacattgagtaattccatgaagagaaaaggctgacttaaaaaataaataaaataaataaatcccatccttatggtttgcacagaacaggttttagttataaattcattccatttaatttttattgaattactccctaaaataaatgcaaacaggcaggtaccagtgagacacaagtataaaagggcacaataaagcagaatgttcaaagtcctgtgggtacatgtgcacaacacgcagtttagttacatatgtatacatgtgccttgttagtgtgctgcacccagtaactcgtcattttttaaaaatctttgtccttttctcaaatcctccctccaaagtccaaagtttttttttacattagacctatagacttttatgaagaaattcatttcaatgcagccaagctaggctgggaatgagaacctggtttaatataaaagtatgcctggaataaaatatcatcctttgcctctatctatctctatatcatcctacacaccataataaaacaaatatttggaaataatctagttatttcctataataattcctaatgatttacagtatcaagtcctatatacttggttttcaaattcctccataatctagttccattatatatcctaattccaaataatgcagaaattatactgtctcacccaatgaaataagattttaaataaatatacattgtttcagcaaacaattattgggtttacaatgtgtcatgcaatgttcatgtagctgaaatattttcacatatatatcaggcttttcctatgccctcaacatgtccttcacgatgtccttcctatatagttcagcatgaggtattcgtctctactctgtcaatttctgttaaattcatagtgaactcaaattaattttaactcgagaaatgccagttagagaaattaaagcatgatatataattacaccgaggaaccagatttagaaccggagaagcattgtttctcaaggccgttcttgtcttcatatttcatggtcaaaggtcaatgttgaaaaagctgatgaaagctaatagtaaaactctcaagtctgtacccaagcaaagcacctgatcagtatctgatccaagcaagtcaaaaaaggaaagaagtttgtgtgtaacttttggcttcagactgatatgaaaggcttcatcctttcaattaaggcatagacttttgcctatctgtgatataaaatatattaacagctatagactaggaatttttacatttaagccaaaatacagccaacagagtttaaattttaagtaatttgttaaactaaattaactgaattttcaattataggttttaaatgcttagaaattttccatacgtttgttatagacctcttgttattttctagtttcaaaaatgtgtctttgcataaactcacggttttcaggtttttcacaactgcttcaataagcattacagtaatgctttttaaaacgaaacgatttcctttgctatattattgcccagttgacgttcttatccaaagccagttttgctctctgaatttacttttttctttcttctccccaaaggtgtattgatatgatacacactccttccatttcctggtttaatttgaacatgtcatcctcccacatcataatccagtccatctaccaacaacttatttttcttctgtgagactggcattgatgatggagatcacagggtttaggatgtctcttttcagttattgagcctggcccattcccagtcctaatctttttcttgttaaaaatcaattatacatatatatatttttattatactttaagttttagggtacatgtgcacaatgcgcagtttagttacatatgtatacatgtgccttgttggtgtgctggacccagtaactagtcattttttaaaaatctttgtccttttctcaaatcctccctccaacaacaggagacagctttctttaaatgtccctgctccgtcaccattttctgtgaacaagtctctgctccatcaggatgcacaacaactacccagacccatgtagtgacattccaaataagcttctctttggtcttggagccaaagaaccaagtcctaattcccaatttctcccaaactttcactatctcagtgtattctctcttctcactcttatttctatcaagacacctatgaatggccttctctttcattgaacaacagttgattcagatacaatcaattcaataactctcattttagatcagaaacatacatttatgtttagaaaagactaatcaattgagtacctaagaaaacaaacaaggagctaatttaatgtcctgttcccaagagcactctcacacagacacagaaacaaacatacactcacacatccctacacaccaactgttttactaaaatccagccacactaccttttttgtcttccttcatcaggccatgcttgtttggggcttttgaacacgcttttctacaaggctcttctcccagatcatttcatgatggcttccccttctcatcattcagtcctcaactcaaatggcacgtggttactctttatcccactatccaccctatctgacccaagtcacttttgatcccactgcccagatttcttttcttcacaggatatcactatctgcaactattttacttatttataaactgactcattgtcgattttcctacattaaggaggctatctgtcttattctctgccaaatcacttgcccctaggtgtcatgcctggcacatagtaagcactgatagatctgagtaacgaataaatgaatttacagaaatcgttagccataaatagttttcaagtgcttacaatgtgcaaggtagttcttttttcagttgaatcctaggatgaaaaatgctctgtctctcagcattaatggggcacagtaagtccatttaagagataggtccaagatcaagtggatgaagcttattttgaaaaagttctaaacaaaatatattcctaccacattagacctaaaatgtattaatacataagattaacaacattgttcttctcagctattgtttccttcacacttccccattaaacttttgatatgtcattatgtccttttatgatgtcaaaaacaattgaatggaactgaatgaaagtagttacaacgacacatacccaatttgggacctttactgccaaaatagatgggtcaaaatgatgaaacatggtaagattcggggtgagaccaaaccctgaatctttacatgttcactccctcccacattcatacaatgtacaaatatcctgactatacctagccttgacaagcgttctaatgcctctacaggtgaaaacatccattcatttaaaccaggacctttatctataaagtgccaaataataaatattttagcctttgcaggtcataaagtttctgtttcaactactcaattctgctactatagtctgaaagcagccataagcaataaacatataaacaaatgaccatggctgtactccaataaaactttgtttacagaagggggtgggatgcatttggcaaaccctgatctaacccatcagtgaagcctccaaagtttatatatggggagatttagaaagaaaatttgatcagaaagtgtgttaggaggacttgtgttagaatctgcttttctgtgatacacattttgcttttatatgaaatatatgtgtatgggggggttggaaaagattacgggaaaactgaacccctcaggtcactcttatcactgccgcctaatcctgcaatccatttgagggtgttcttggcattacattttggccttctatagattcatcagctttctctgcatattttatccatcagattatttatatcgtaattctacaattatttttgaaaagctacaacaaacactcggttgaagttcaaaatatacattccccttaaccatgctaattctgcattctatttcaaacattattaattttgtcaggcaagatttgtttataataaactcatttttttcatcgctcatgattcctttgtcttcaagatgtttactgatttctcttacaatgttttatgagaatgttgtcagataccctgtaagccattcaacattacatttacatctattataacaattctttctccctcaaaatcttttaggtcttccaaatttcccaattggaatatacctttatccaaagtataataaatacacctttacctgtttctggttgatagctactttcaaaaggtattttaaacgcattatatgtttttcaaaattgtgttttaacaccaaaacagccacacaattaaactaaaatttagtaaagattctaaatgataacacactgtcataagatacattacatattaattagcaatgttatcattttctattctccatcttatagtttctgtaataaatcctactgccaatcagctttcattatcagcccgtctaatcatgataaccaataaattgtactctatgcttctgacatccaattctgctttatctattctagctatagtgtcaaaatatttttgtagcttcaactagggtttgacaaaaatgctaaaactataaaatctaaatgtaaagtttaccattaaattatatcagcatgtcatacaaccatgatttttaaaataaaatgagaaaatacataaagtaagattttagataacatgataaagtctgcttcagtttgattcagtattcaataaataaaaccacttgagaatcccagtaaaagtaaaccttgagatggttgaaatatccattttaaataacgggaacttttaggtaattgtctctatgaaacaagaatcaggcttttgaggtcataaaatgcttgaccttcccaggtacaatgaatgcagaaagcttactactaagttacacaataggggtaagactgttgaatctatctgaaaaattacattttcaaaagctccacaaagtaactgattcattaaagaaataattggaaagattctttctctttcctcatatgaaggagaaatcacaaaacgttgcaatattttcaaaagaggatgaagtgctcacatttcacttgtgaggtttcaatagctttattacctatgctcttgctgtttgttcagcatgctgaagaaaagtatttccaaaataacataggtttgctaatccttggttcctgataatatcacatgataggataggagctttcaaacacagtcaagctgacagtcacttgctctgtactcagagggaccaatttctccctgtagacatgaatacagcacaaataataaagtgccaaaagttgagtgtaagtgcaaacccttcaacatcactcaggtatcagcaaaaagtacctgtttagctacatgtagaagtcaggtacaacatgttgaaagggagggaagattagaattgaaataatttatctgcctctgctagtttatctgcatcactgaaaagaattaaaccaaccttgccaaaggtaagtcttgtctaggtacaaactgtcttatcaatgccatctcatctattccctatcgtcttctttttttttctttttttgaaagaaactttttatttattgtttttttcacattgcaagtgatggtatccagtttctttttttttttttttttaattatgctttaagttctagggtacatgtgcacaatgtgcaggtttgctacatatgtatacatgtaccatgttggtgtgctgcacccattaactcgtcatttacattaggtatatctcctaatgctacccctccctcccccctcccccaaccccatgacaggccccggggtgtgatgttccccttccggtgtccacgtgttctcattgttcaattccccacctaagagtgagaacatgcggtgtttggttttttgtccttgtgatagtttgctgagaatgatggtttccagcttcatccatgtccctacaaaggacatgaactcatcttttttatggctgcatagtattccatggtgtatatgtgccacattttcttaatccagtctatcattgatggacatttgggttgattccaagtctttgctattgtgaatagtgccgcaataagcatacgtgtgcatgtgtctttacagcagcatgatttataatcctttgggtatatactcagtaatgagatggctgggtcaaatggtatttctagttctagatccttgaggaattgccagactgtcttccacaatggttgaactagtttacagtcccaccaacagtgtaaaagtgttcctatttctccacatcctctccagcacctgttgtttcctgactttttaatgatcgccattctaactggtgtgagatggtgtctcattgtggttttgatttgcatttctctgatggccagtgatgatgagcattttttcatgtctctgttggctgcataaatgtcttcttttgagaagtgtctgttcacatccttcgcccagtttttgatggagttgtttgttttcttcttgtaaatttgtttgagttctttgtagattctggatattagccctttgtcagaagagtagattgtaaaaattttctcccattctgtaggttgcctgttcactctgatggtagtttcttttgctgtgcagaagctctttagtttaattagatcccatttgttaattttggcttttgttgccattgcttttggtgttttagacatgaagtccttgcccatgcctatgtcctgaatggtattgcctaggttttcttctaggatttttatggttttaggtctaacatttaagtctttaatccatcttgaattaatttttgtataaggcgtaaggaagggatccagtttcagctttctacagatggctagccagttttcccagcaccatttattaaatagggaatcctttccctatttcttgtttttgtcaggtttgtcaaatatcagatggttgtagatgtgtggtattatttctgagggctctgttctgttccattgctctatctctctgttttggtagcagcaccatgctgtttggttactgtagccttgtagtatagtttgaagtcagttagtgtgatgcctccagctttgttcttttggcttaagattgtcttggcaatgtgggctcttttttggttccatatgaattttaaactagttttttcccaattctgtgaagaaagtcattggtaacttgagggggatggcattgaatatataaattacgcaggacagtatggccattttcatgatattgattcttcctatccatgagcatggaatgttcttccatttgtttgtgtcctcttttatttcgttgagcagtggtttgtagttgtccttgaagaggtccttcacatcccttgtaagttggattcctaggtattttactctctttgaagcaattgtgaatgggagttcactcatgatctggctttctgtttgtctgttattggtgtataagaatgttcgtgatttttgcacattgattttgtatcctgagactttgctgaagttgcttatcagcttaaggagattttgggctgagatgatggggttttctaaatatacaatcatgtcatctgcaaacagggacaatttgacttcctcttttcctaattgaataccctgtatttatttctcctgcctgattgccctggccagaacttccaacactatgttgaataggagtggtgagagagggcatccctgtcttgtgcccgttttcaaagggaatgcttccagtttttgcccattcagtatgatattggctgtgggtttatcataaatagctctcattattttgagatacatcccatcaatacctaatttattgagagtttttagcatgaagggttgttgaattttgtcaaaggccttttctgcatctattgagataatcatgtggtttttgtctttggttctgtttatatgctggattacgtttattgatttgtgtatgttgaaccagccttgcatctcagggatgaagcccacttgatcatggtggataagctttttgatgtgctgctggattcggtttgccagtattttattgaggatttttgcatcgatgttttcatcagggatattggtctaaaattctctttttttgtggtgtctctgccaggctttggtatcaggatgatgctggcctcataaaatgagttagggaggattccctctttttctattgattggaatagtttcaggaggaatggtaccagctcctccttgtacctctggtagaattcggctgtggatccgtctggtcctggactttttttggttggtaggctattaattattgcctcaatttcagagcgtgttattggtctattcacggatttaacttcttcctagtttagtcttgggagagtgtgtgtgttcaggaatttatccatttctgctagattttctagtttatttgcatagaggtgtttatagtattctctgatggtagtttgtatttctgtggaatcgatggtgatatcccctttatcattttttattgcgtctatttgattcttttctcttttcttctttattactcttgctagcagtctaccaattttgttgatcttttcaaaaaaccagctcctggattcattgattttttgaagggttttttgtgtctctatctccttcagttctgctctgatcttagtgatttcttgccttctgctagcttttgaacgcttttgctcttgcttctctagttcttttaattgtgatgttcgggtgtcaattttggatctttcctgctttctcttgtgggcatttggtgctataaatttccctctacacacttctttgaatgtgtcccagagattctagtatgctgtgtctttgttctcattggtttcaaagaacatctttatttctgccttcatttcgttaggtacccagtagtcactcaggagcaggttattcagtttccgtagttgagtggttttgagtgagtttcttaatcccgagttctagtttgattgcactgtggtctgagagaaagtttgttataatttctgttcttttacatttgctgaggagtgctttacttccaactatgtggtcaattttggaataagtgcgatgtggtgctgagaagaatgtatattctgttgatttggggtggagagttctgtagatgtctattaggtctgcttggtgcagagctgagttcaaatcctggatatcctttttaactttctgtctcgttgatctgtctaatgttaacagtggggtgttaaagtctcccattattattatgtgggagtctaagtctctttgtaggtctctaaggacttgctttatgaatctgggtgctcctgtattgggtgcatatatatttaggatagttagctcttctttttgaattgatccctttaccatcatgtaatggccttctttgtctcttttgatctttgttggtttaaagtctgttttatcagagactaggattgcaaccactgcctttttttgttttccatttgctccgtagatcttcctccatccctttattttgagcctatgtgtctatgcacgttcttatctctctttctctcctaaactttttttttgtaataatctctctctccacctaaacttttcaacttctctctctttctgtcttttttactccctccactagacatacccactctctctcacaaataaatactcactgtatgatgctaactgctaacttaaaggagatgtaattttatcactcacatatgattattgatgtgaaagtgcaagagtaaatatgtcagcaactgaaaaattagggcaacatgatccaaatcaagtgctaaatatattaatcatatacatactatgcacttctatagaaaaattattaggctataagcaatcataaagattagcataaataacctaaaaaaactattaaaagtcaagacagggagattcagctgacagagttgtatctctctttcttttcatataaagagatattcagtatgatgttgctaattaagaagtgaaacaagttagaatgaaagctataaagggaaatctctgggtgtcagacaaaaagaaagaactcaaagccagagcagaaggtggggctgaactcttggtgtccccctagagcaccatagccacatatatccatatatttgtccgcagtgtggggaaacagacaaagcctgaagccaatgagaggagtggaacagaagctgagactcccacttattaatggatgtcccctcacgcatctgtaagatttagactagaaaagtctataggtctatagactagcccagagacagagtaataaaactagaaatcttcttagggttctgggggaaaaaaaaacatagaaaatgaaacccagatacgtgccatgagtgccttaggaatcagcattgcattatttgggacagaaaactcaaagctaaaaattaacacaaaaccaattaggttttctgtagaccagtacaggcacagatcatgggtcacagaatagaaggaaatactaaattactttggaaggacccaaggcactcacagagaaaacaactttcttcacctgagaatgagctaaccataggatcaaaaactgatactcttttgttcaattcaacatctacctattaaatgcttttttaggcagataatattttagaccctgaagatatattagtgaataaaacataattcctgtttatactctcatgaggaagacaatgaatacagaaatataaaatataatgttcagtactaacaaatgccacaagagaaaagcagtacaaaagaaaatagaagaagagatggagaaacagatatgtagaaaaaatatttatagaaagactctaagaaggtgatatttgagcagaaccctgaacaaagtaaaggagtgagtcatgaggcagaagatacatcaacaggaaagaatacaattagtaaagatatagaagatttaaattacatcattttgaactaactgatgtgtaaaaacttcaccttttgaaaattgcacattctttccaactaatgtgtaatatttataaaattcaaccattatgatctaaaaagaggtgttaacaaataccaaagaattggtattacaaaataaggtatctgaccacaatggaataaaataagaaattaagatgaaaagatagattaaaaagccctatatatttagaaactaaaaaaacattcataaatattccatgagtcaaagaagaaatcataattgaaatattaattatttaaaatgaacacaataaaggcactacatatcaaaacctgtgggatgcagctaaagtggttcttagtggaaaatttatggctttaaatgcatatattagattttttaaatacgtaaaattaattagtttaggatctcacttagcaagttaaaaaataatagcagaataatccatgtaaaagagaaggaaagaataatgattagaacaaaaattaataacatgaaacaaatgtacaatagagagtatcagcaaaaccaaaatttgttctttaagaagaggtgtaatatattaggctaaaccatattattttttcagtattcaacccatagtaaaacttatgctgatcaaaaaatattaatcattaaatatttaagaaagaaaatagaggcactgattagaaactttaggaataaagagaatgtatctcaaacaatataggaaagatttaaaataacctgagaatatactaaacaactaaatggcaatcaatttacaaactcaaatgaaataagcagtttcctagaaacatgaaatgtaagaaaaatatgtaattagaaatagaaaacctgaataaatttatgatcaataattgagagaaaaaataatctcctgacaagttacatctcacatggtttaacagttgaatcctgccaagcctttaaggaatggataatcgtagcctgatataaactattacagaaagaaaaataaatatccaaacttcactgtcttcttacttttttctcagagcacttagtgtcttagtaatattttcacaacaaacttagcttaaaagtatgtaacagatccattaatttagtacttaggtctaaacaattaaataagtatttttgtcccagcaatacagccatatagaaataataaacacaaatttttaaaaattatttttacttcattcttatatagccatctttaagtttattattattgggatgtgtgtgcctgtcaggcactgcacaacttttcaaaccttgaaatctgattggacactgccacacttatttcctgttctatattgattttcatgcagtacctgctttctatgacagcaaccacaaaaaccaagcttcacgaagacatgacaccatcaggatgaatttactgaaatcccacgctaaaactgaactattcagggtagtgtctgacctggtgtctgacagatgttgaatattgctacgtttctcttaaaaattttaaatagctcatggcccacctgtgagttcactgtggccctacaggagtgccttggaacatagattgcaaaccatggcattatggtgagaaatgacttatgtaaatttttaagtaaacaaaactgcaccgaatgttcatggataagtgtgtgcgcatgtgctgcatgaaatgaaatgaaaatataaaaatagtaaaaatatgaactgaaagcatatgcattaacttcagaagagtggttacctctagggacaaaaggtggaactgtaaacacaagggaacttcaactatttctgcaatgactaatttctgtaaaaacaaaattcaagcaaatatggcaaatgctaatgtttttaaaatatgggtgatgggtatttggtatttattacattaatttcgtgccttattatacttttgaaatagttcataaaagaaaataagaaatgacaagcattgtgagttttcaaaagcttcatataggttgctacttttagcatgccattctaaatcccaggacatctggttactgttagacctgcttttctagtttccatttagaatcattaaactatccattcagagtagtcttaacatttaaagacaaaaaatcatataaagacccctatttcataagcttcaccctaagtcacaaatgctgcttttatttagtaactttgaaaaaatctcagcagaaatcagatataagtgctttctattcacttcttcaaaatatacttattttctcatttcagttattgaaaataataccatagtatgatagaacataacatgtattcatttagtgctatcccaaaccccacaaatctctggtctattgcaagaaatatactcattttcaaacttagtattaatatatttattttgtaggatactaaccaagtcaaaaatgaaactacattgaattaactgatgattatgccagatgtacattaagtttgtgttagtcacgtatgccagttcctcacatccatctcccctttaccttctcccaaccccaacttttcaaaataaaattaatattattcattagaagcaggaaactatagagggaatgtcagcaaatgtcagaagttccatgtatcagtcaaggatcaaagaagttccacaataataacatgagctacaataataaagtaaataagatagcaattatcccaccttactctgaactggccagatcatggcacatgtcttttattatgaggacactgccttatcaaaaagcctaaagagaaaaacatgtagaatggtgagaaatcttatttttttcttttcttttttttattattatgctttaagctccggggtacatgtgtagaacatgcaggtttgttacataggtatacatatgccatggtggcttgctgcacccatcaacctgtcatctacatgaggtatttctcctaatgctatccctcccctagcctcccaccccccaaaaggccctggtgtgtgatgttcccctccctgtgtccatgtgttctcattgttcaaatcccacttatgagtgagaacacgtggtgtctggttttctgttcttgtgttagtttgctgagaatgatggtttccagcttcatccatgtccctgcaaagaacatgaactcatccatttttatggctgcatagtattccatggtgtatatgtgccacattttctttatccagtctatcattgatgggcatttgggttggttccaagtctttgttattgtgaacagtgccacaataaacatacgtgtattttttataacatacacatatgtctttatagtagaatgatttataatcctttgggtatatacccagtaatgggattcctagatcatgtggtatttctagttctagatacaagataaaaacaaacaaccccatcagagagtgggtgaaggatatgaacagacatttctcaaaagaagacatttatgcagccaataaacatggaaaaaaaagctcatcatcactggtcattagagaaatgcaaatcaaaaccacagtaagataccatctcatgccagttagaatggtgatcattaaaaagtcaggaaacaacagatgctgaagaggatgtggagaaataggaacgcttttaccctgttggtgggagtgtaaattagttcaaccattgtggaagacagtgtggcaattcctcaagaatggtgagaaatcttaaacagtaggggcagttgaggcaactagagaggtttaacttggaaaacagaagacaaagagagaaatctccagtatcaccatgtttttggtagagtattatgtggagagataatcaggtagttacaaatcactggaagacaagagcatggatctccaggaatgactgctagatccacagtgtagaacctttggggtgattaaaacgttctggaattagatagtggtgatgtttgtacaaccttgcgaatatgctaaactctattcttgaaatgtgtgaaattttatggtatgtgtaaaacaaatttttaagtgtccattagattcagtaacatgattagtataatccaaataatacatgaaaagtcaaaaagcaaacaataaaaacaatggtttccaaagaaataaagtaatttttcaagacagattgaaatgttaggaaagagttttctttttcttttctttaaaaaaaaaatagtgaagggcttgaacaagttcgaatgttgataacaaaggagtttacaaagagacaaagcatgaagacatagaaaagataaaattaatcaatactgcaaaatttctaaaaaagtagaattagtgttcaaaacataggtaaacagattagtctttttaagtggtaggttaatttctttttacaaaacttcatgaaaagaggataccactagctagtcccacccagctgacccaggatatttacagattttatcttgggatgttaagcatgtacttagatggatgtgtctacttttttttgactagatgataatgtagtctgctggggagaagaaggagcaaaggtagaaagggtaaataatttgttcaacattagccagctagaaatggatagatttcatttttgaaatcatttatttttttaggatatatttaaggtgctcagcatgttttgatataactataaatagtgaaatgattactacagtcaagcaaattaacttctttttattttgaagtgattatatacacacatgaagttgcaaattagtatagataggtcaaatttacccgttacccagctttccacattggtaccatcttacataaccatgtacattatgaaaatgaggaagttgacctagtacaataaaataaacaacaaattttatttggatttcatcaatttgtgcatgcactcattttttgtacgtctttgtatcacatgtattgatataaccaccaaaaaaatcaagatacaaagctgttgtgccatcacaaaagaatttgtgacctctttatatgcctgaccttctgaaacctctgaaaataactagacttaatcataagagtaatgggaaactactgaagagtattaagtgataaagtcacatggcagactgtttcatgtttccctttatctcaaataaaaacaggggtgcataactgaagaaagaagaggcattagaatattatttcaataactaaggtaaagcatgatgatgtagaatagaatagtgactctagatatgcagcagagtggataatttcaaagatgtagattcaaaagaatatggtagttaactgaatgtggtagtcaggaagggatcaagctgagcttacctgacttggatatctgggttggtggtaatatcattcacagagatgtgaatcatgagagaagtggcttggatgtgctaagtttatttctttatatgtcaagttacttatgggttattcaaatgaagatgtctagaaggtaatttggtattggagtctgaggttcaggaagaggatcttgtttaagataaagatgtggctgtaattgatccatatatagtaactgaagccagaaaattgggtaagatcaatcagaatatggtatcatcgaagtcaagagaaaagaatgaggatagtggagggaaaaggaggggaaaggaggggaggttggggaggggaggggagggaaaaggaggggaaaggagaggagaggagagcagaggagaggagaggagcagggaaatgaaaggaggaaggaaagggaagggaaggggaagaggaagggggaaagggagagggagagagaaagggaaagggagagggaaaggaaaggaggaaggaaaggaaaggaggagggaaatgaaaggaaaggaaagggggagggaaatgaaagcaggaaggaaaggaaaggaggagggaaatgaaaggaaaggaaagggggagggaaatgaaagggggagggaaattttcagggcaaaacagaaagaatggaaggacagaaagatggaagagaggaaggaaggaacttgcacaaattgagggcacatgtaaaaacttcaaatatcatgtactcattacatataatttgtgctatataaaacttaatgcaaacttatcagcttttctttctttaaacctactttttttttacttactgtttttccctcgaaaagttctttattcttagaaggaatttcctcaaatatttatattcgataccaatattttttctaaaatgaaacatctctattttcttggcccaagaactgtggtaactagcttgaaaacagtgctatatatttgttatgtcaggaaaaatatagttgaatgaagtgttctctttcccataaagaaaaaagagtttcaagctacatttaagttttctttatactaccacctctccaagcgtttcagctatcattgttttttaactgcctctataatatacaatatgcagccaaatatttggagatattttggtcaaaaggtatgttagcaacaacaatagaaataataaaacaattctcaatgataactgaagctattgcataatttaaataaaatggaaaaagtcagcatcaactttgaattcattggcctttgtcaatttatgttgcaatgttatatttgtttaaggcataactctgaattcatttaatgacctagactatttagtgttggactttcatttaaaaaaaaaatagcaaaataaaatgccatctcgtagagtgctatttaccatatgagatccatctggcaataccatctaatatttaactttgaaggcactgttatcaaatagttgctctaaagtgcttataagaggcaaattcttctggtttttcttctaaggcatattatattactgataattttaggataacagatctgaatgtagatgattttaaatgttgattacagcacattatttaatattttaaatattgactaattcatttttaaattatttgtaaattagcagactatttcttttataaaattaaatattttgtattctcccaccccaccgctagaagtctttaaggggaatattataattttaaaataaaggatttaaagtaacagtttcctgttagttttgtggactgttttcttttccagtaatattttgagtccagttcaccataacttaccaataccctttcacattgcccaacccctagaaacacttaacagatttttctctccataggttggctatattcaaaagaaacattggcctatcaggacctctcagtatccatgttgtggacaagaccaaagagaacttaacactttgaaaacagctactttaccttatgtgcgactcataaacatttaactcagtgttactcagtgatgtgctgccaaaagtaatttaccaggttccaaatgctatatatctggataaactggtctccaaaagcaaacaaacaaaaaacctcattatatatttttaaagaaaaatgtggcccccactactaggtcagcagagaattctgagaatatataacaagtcctatgacttcagtcccaaaagctctggcacaggaaaacactataaacttcttgcaacaagagaataccatcaatactagcagggacatgcttatgtctacatttaggtgaactagcaaaatctttcatctgatatgtactaaattcttgaccattacgaggaaaaaaattatatctgaagtggcatattctaaacctgatgaatttcccacaaatcaaaaaaaaaaaaaaacaaatttctcacaagttaaaaaaaggagcctatatttcaaactattacttgtattgtaggcttctgaacaattttattatactcttcagtgttttccaggtttgttaaaataagcactttaaaaacaggaaaaaataagtttgaaaagataaattctagcactctattcctacaagataaagaagtcagattactcttttatatccaatggaatacatgaattagacttataagatggttggaaacacaccacaccacatttaatacacattccagaataaacttcaaataaaaatatgagctgttgaccaatagcagtattataaatttaaaatggggagctttttttaaatcacatattaaaaaagaagaattgggaaccatgtggaagcaaagagcaatttaatatacatacacaagtttagggattttttttttaaagagaaattgagagtcaggcattaaaggtatacaaaatttgtgtctcaatatattaccaattaaatattgaaatgtaaaattgaaagcacaacacctacactaaaaccaaaaaattaaataaattcttcatataaaatctaacaaaatatgtataagatctattatgaagaaaactacaaaactctgatcaaaggtatcaaaaaagaactaaataaactgagagatattccatgttcatggatagtaagactcaatactatcaaaatattacttcttcccaatttaatttttagattcaacataatcccaatcaaaatcccacaaagttattttgtggatattcacaaactgattctaaagtttatatggagaggcaaaagatctagaataggaaacacaatattgaagaaagagtcagaatgctgacactacccaaccccaaggcttactatatagctacatgagtcaaggtactgtggtatttgcaaacatacaacttagatcaatggaacagaagagagaggccagaaattgacccacataagtacagtcaactgttctttgacaaagaagtaaaggcaatacaatagagcaaaagtcttttcaacaaatagtccaataactgaacatccacatgaaaaaaaatctagacactgacattaaattcacaaaatttaactcaaaataaatcatagacctaaatgtacaatgcaaaactgtaaaacttttagaagataaataggagaacatctagttgatcttgggtttggcaataaggtcttagatataacaccacaagccagatttatgaaagaaataattgacgttagagtttattaaaattaaaacttccatatttgtgaaagacaaatcacagactagaagaaaatatttgctaaacacatttctgatattcgaccgtcatccaaaatacaccaaaaactattaaaactcaagaagaaaaacaacttgattaaaatgtgagcaaaagatctgaacagacatctcaccaaagaaatgcagatgaaaaacctgcatagaaaatgatcaacataatatgccattagagaattgcaaattaaaacaatgagatatcactaaacatctattggaacggctaaaactcaaaatactggcaacaacaattgccgtcaaggatgtggagaaatacaaactctcactcattgctggtgggaatgcaaaatgctatttggcactttcttaaaaaattaaacatacacttaccatatgatctagcaatcatactcattggtatttcattgaaaattatgttccacaaaatcctacacataaatgtttatagcagcccaatttataattgcaaaaaaattggaggcaacgacgatgtctttaagtaggtgaatgcatgaacaaatttctacatccatacaatggaagattattcagcactaaagagaagtgagctattaatcatgaaactatacagggaaaccttaagtgcatactgctaaatgaaataaaccagtctaaacagctatatcccgtatgattccaactatatgacattctggaaatggcaaaactatagataccgtaaaaaagatgccagggtttggaaatggggagggataaacaggtagagtacagaggatttctatggcagtgaaagtaatttgtatgatattatgatggtgggcacataacatcatgcatttgtcaaaatccattaaatgtacacccagtgaaccctaatgtactatagttataataatgcatcaatattggttcattagttgtaacaaatgtaccaccatagttaataatggggaaaagtggggaggagaagggtgaatgggcatacaggaactctactttctccccaggttttttttttgtttgttttttgtttgtttgttttttgtaaacttaaaactgctacaataattaaaggctattgttttagttaaatccatttatttctaaaatttaaaacaggaaacataaaacaactaagtttaagaagctgagtgtggtgatatgagcctataatcccagcaacttgggaggctgaggtgggaaaattgcttgagctcagaagtttaaggttagcctgggaaacatagtgagcacgcccctactaaaaaacaaaacaaaacaaaacaacaacaaaaacactaagtttaacaaatattatgtttgcaagtgtcaggtgacaggcatgtttcatttttttcaatattacctgtctagtgaaatcaaagataaatatgtagctgaattttacttactgtgaacaatcaggtggtttgaatttctcttttcagcagtagaaacaaacgttttggaaatcaatatggatttttaaaaactccaaaaaacattaatttgtatttattaatattatgtcttcattattatattgtcagaacaaaaggattcaggttatttataaaatttttaaaatgtgtgtttttatctaggaatatagtcattttaaaattaatgctactgtcaggatgaaggcagggagctctgatacttttcaaaccacctattctagcacttgagatctctgcagaatttgggcctatactgtcatgagaacttgggatttcaatagatctgctcgtggtttcaatctctagttggtctgcaaagaaattaactctgtgctactgcccaaaactatcccccaactttcaaggtttcctgccttgaaaacatgcacattttgtcctcaaaagagtacagaaaggtacctataaaacctgcactgctatggtctaaaatgaccaaaaagatgccttgcctataatctccgtatatgcaagactgaacattacattacatggaagtattctgtaaccaagagtctttgcctttaaaacaaaatatttttttttccttagaggatagctatttggggacttagcaaaactggacaactctcagaaacaagtttttcttcagtagaacacacactagggtttgtgcctcttttctttgttcagttttatacatgtataaaggaaagacaaaaaacaagagggtctttcatttttccacagttccctttcttgggtgccattcctctcattgttcatagatgaatattcagcgtattcttctcacacagaacacttggccagttttttcttttgctctatattaaagggcataatatttctttaactgaggaagacatatttataatataattttggattaagatttttatttacaaatcatttcatagaaagtttctctaaatttttagcaagagatatttggctataattggtcagatttatctgtcttcatttcaaggatctctatggtactgaaatttctgtttaaagaattttaagtaagttcatttatatacagttcatgcaacttatttacttatcccccttcaacatgccagccatttctttccaaatgttaaacagagttactaaaagttatgtgtgtgtatgagtgtgtgtatgtgtgtgtgtgggcctgtttatgaaggagaagcagagacagagggaaagtgggtagtcattgtattcaagccaacaaccccatttcaaaggagagggattcttaccctgaaaatttgttttcaattcttcacttttaaattaatacatttagaaaaggtttaatagaatgtggctgaacctcaattaaataaaaatttccacctcttgattttatttttttgttgtaattaattggtcattgggtttatctgtatacattttatctgtatttgtatttattgtatgtgtatttgtatttatttgtataaatttatctgtataaatttttaatgaccccaaatatatcatgaaaacatttaaatgttttcctttatctaggaaattatacacatgtttgaaaaccaaacagtttatatctgactagatgtttagttgctattactattttgaacttggaatggacattattttaaaataagttatttgtaaagaactgagatttactgcatcctaccttatgtcaggtactcatgtcttgtctcaaatcatgttctgaacatctctttgcattaatataattaatcccagtttacagaagacaaaattaagaaccaaagagagagagtaggtaacaatcaaggtgattcaggacttaactgacaaatctatcaacttctctctacctctactgctgccttcttagttgaggtcactgtgatttccatcctggaccactgaaccactgtattcaccttctaactggattcctcactaactgccttgataattccaatccattctgcaccagaagcaggtttattatgggactgtgtcatacttccctggcttcccatttcatttagggcaaaattctatgaggtctgtctctccatttctctttaacttcatttcaatctactctctttttagctcacagcattctacccacgttaatgtcctttttgttcctagacattgccaaatgttttttttttcttttttcttttttgttattgctttctgatctactataaaatgcttttcttctatggaggcttcaaacatcctattccttgccctggatttctgcatcactggatccttcttatcatttgagtctcaacagaaacaccacctcttaaaatggtcaccctctgattcttgcccagacctttgttagttactgtcagaaaaaaataacttctttatgtacaatgaactagtttgcttgtttgtttgtttgtttatcatctattcctccactccctctccattccccctccatagtaggacaggaatattctattttatttactaccctcatatagtttctagcacttcgggtactgaataaatatttgctggatgaatgaagtctttgttttctccactctaaaatgtgctcatattaattaaatatagtcataaaatttatccagttggatatatatatatatatatataaccatttgtccttagtaaagcttgaaatatgtgaaatcatggcacttcttttttttcccctgaatattatttcttggtcagaacattatcttcctccttggcaaaaatatattgtgcctttatgttttagcaaagtatctcaaagaatcatataaccgtagcaaaatggagctgaagggcaccttagagcccacctacccctatcatgcacctggcacctgagcctcttctacagcatcaagtggccactgagacataccaggctggaggaactaagtaccttttaaggcaacacatctaattcttagtgttttaatagcctaatatttgtttagcgttttggtactaatacattccaagtttctgctgtctactgacttttcactatttgttcccttagatattcatttgaaatctttttagtttaacctgatttagctgtttctttttattaaaaaaaactcgaggtaacttcttttctgatttaatgtagcaataccagaaaatcccttttgagtttagtctttcagattgttagtaaacttaatgatgagaataggagtatttgttatttttctgcaaaatagttctatctatatttctttctacttctcattgtgcaaagtctgttctttcattaagacactgtaattacattatagtcagtatgttttaagtaaaattctgagattcctttactttttcttgagtcgtctaaaaaaatatgttttgataaaatcaagtgaaatatcctttatgacttcaacttcttctggaaatacttgtcctctatatattttatcacttaatttgccaattatgtctactccttttgaataaggaggaaataccattttctgaaataaaaaaaagagaaagagaaaaaacagaaattagagaatattttaaacaatgtgttttatgtgttttttaaatgtcatcaaactcattcttcaggactttactcataataagctgttcaatgaatacttatttaacaatcgctctgtgttctattacttatccctttttctcacttatatgctcaactttttattctttataagttctttcttcttagcatataaacatgcatgattatctcccatcaaatatacataaaaataagcatacaatagaaaagaaagaaaatccttttttgaagatttgctctgttaccactttcttctctattatttctagtcaaatctttgaagagagtttttacttctttacccctcatcctgtttacagtccactgaaaactgacttctgcccttataacataatttaattattcccaccaagatcgcaaatcacaagacggtcaaatccaattgaatatattttgacttgaccttactttatatctcagatgttttgacattcttgacaactcctttctttcaaaaacactgtcctctcactggcttcatactttttggctcttctcctgcccttttctcttcctttgcaggctcttctgcttcttcttgaccctatatatgggttcttcttctgctttccaacagtctcttgctctcacatcatccttttccttgagtgattatattcacatcttcaacttcaaacatcacctttattttgatgactctcaagtctgtagctcctgcccttatcacagctcttctatatctctccagttgtatacatactgctgactatggaatatctttagctgaatgccccatagatacttcaacttatgacatatcaaactgcagtttttaaatcttcactccaaaatgatatttttctgttattcccgtctcttttaatggcactgtcatccaccaaggggatttggaagaaccttgagttcaagccctttcctttgtttccctacagttgccctgtaatctgtatgctgagggttaaaggcagggctaggagaaaatatgtttctattagatgagatgtatcatcaatattcaactggtattagaaaaataaccataaaaatgctcctgataataagcagctaaaacataaagaacatctttttgtaagtaatcgtgaacaatgtttgagagatagaaggatcattcaataatctaaaaattctaaacataattttacatatgaaaaaacagtcctagagaggaaagataaatgtctaatataaaagtaacttaatgaaaaagtgtggactaaaatctagatccacttctgtaagttttgtatttccttggtattagaagtaacttactcctccctgtccctgatctatgtaatggcaaacattttttcttggtaggagataaatcaggtcattacaagcatagaaagcaagatttaaacaaagtatatctgtaatacaaatttctgctagtagaatgtacctacattttaaaaagtgagagttctttctcagctgctttctaagtaatttacactatttatgctcccaccaatcctgtatatttcctatatgctcacaaaccatgaatattatctaatttgtaaaaccttgtcaatctgataaggaaacttagtatgtgtgtatgtaagattgaatatttttatacgttattggacacatatttttatgaattatgtttttagatcctttgaacattatctactgggttatttatatttcttgttcttgaattttcttctgtttcttggataatgttttcttctggaatgtattcttcaaatttttttaatgctatatatttttgttctgtattatttttacagttatgtcatctcatttgaatgtacaatcactatatagcccttaatctatatggttaaaaattgtgtgagtaaaaactctttgccactctccccaccccatctgaattcagattgacttatcctgtaagcttttattccaggactaaaattttgctttaacaaagccaataagcccaggtgcttagtttctcctacatacctattctcccaacaatgctttctcatcccctttcaggcagtgagaataaatccagtaaaataattacgttctatcacattattagtccagagctggcaagtagaggttacatatgtgcatgttcatgtgcctctacaccagcttcctcttcctgagatgactaggtatttactgtgatttgaatgtatccctcaaagttcatgtgttggaaactcaatctccaatgcaacagtgttgaaaggtgggacttttgagagatgattaggtcatgagggctccacactcttgaatggattaatgttatcacagcagtagctttgttataaaagcaagtttggctctttcttgctccccatttgatgagctctttcaccatgtgatgccttctaccacgttgggatacagaaaaaaggccctcactagatgcccaacacccttttatagggcttcacagcctcgagaacagtgagcaataaatttttctttatacattacccagtctgtggtattctgttatggcaacacaaaataaactaagacagtattatgtattttttcttttgttttacattttactaagtgccgacttattcgaaaaggtaattagctttggttaattatcaaagttttgtctttcctttcctacttttgtcccactaagcaaaaaacaaaacaatgagcattgacctttacctttctctggtaagggagtatggaaggttttctactactttgtaaaaatactgctacagatggtacttctggacccatgtggaacctgggggtccttgctgtcctgaagagaagtacacaggcctggctggcttttccacttactgattgtagaatctcaggcattgagcaaatataggcagtagccagggagcagttacatcaggccttaggtgaaacccactgctgtgctggcttcaggtctgacccaacacagtcatagtggtgatggccacaagggagcttgggttactccaccctgcaaaggagcttgggtcactctgagctttgcatagcttagagcagagaaagaaggactctgtattcttgggagaaaacaaggaaagagaacaagagtctctgcctggtaatcaagagaattctcccagatcttagccaagaccataaagcttatacctctataaatcagcaagaaccacagtgttattaggcttgggatgcccctaaagtagatatttcttagatcacaacattcaggtcttttcaaatatctggaacatctttccaagaagggcggctacaaataaacccagaaggtgaagactacaataaacacataactcttcaatgcctggacaaacatctataagcatcaacaccatccagggaaatgacatgacatccccgtatgaactaaataaggcaccagggaccaatgctggagaagcagagatatgtgtgacctttcagacagagaattcaaaatacctgtgttgaggaaactcaattaatttcaagataacacagagaaggaattcagaattttatcagataaatttaacaaagagaataaagtaattaaaaagaggcaggcagaaattctggagctttaacatacaattggcctactaaagaatgtctcagagtcctttaacagcagaatggatcaagcggaagaaagaatcagtgagcttgaagacaggctatttgaaaatatacaatcagatgagacaaaagaaaaaagaataaaaaacaatgaagcacacctacaggatctaaaaaatagcttcaaacaggaaacctgattattggccttaaagaggaggaagagaaagagacaggggtagaaagtttatccgaaggaataataacagagaacttcccaaccctagagaaatatatcaatattccaagtacgagaaggttatagaatgccaagcagatttaacccaaagaagactacctcagggcatttaataatcaaactcccaaagatcaaggataaaaaaggatcctaaaagcaccaaaagaaatgtaacaaataacatacaatggatctccaacacatctggcagcagacttttcactggaaactttataggccagcagagagtggcaggtaatatttaaagtactgaaggaaaaaatcttttaccctagaatagcatatctggtgaaaatatccttcaaacatgaaggagaaatgaagactttcccagacaaacaaaagctgagggatttcatcaacaccagacctgttctacaagaaatgctaaagggagtacttcaatcaaataaaaaaggatgttaatgagcaataaaaaaatcatctaacagtacaaaactcactggtaatagtaaatacacagaacaacacagaacattttaatactgtaactgcagtgtataaactgctatctcttaagtacaaagagtaaatgatgaaccgataaaaaaaataaatacaactttttgagacatagtacagtaagatacaagtacaaataataaaaagtttaaaagctagtggacaaggttaatgtgtagagtttttcttagttttctatttgcctgtttgtttgttcatgcaaacagtgttaagttgttgtcaccttaaaataattgcttataagatagtagatgcaagctttgtggtaacttaaactttaaaaaaatacaatggatacacaaaaagtaaaaagcaagaaattaatcatatcaccagagaaaatcatcttcacgaaaagaaaagaggaagaaaggaaagaaggaagagaagaccacaaaacaaccaggaaacaaaaaacaaaatggcgggagtaagttcttacttatcaagaatacattgaatgtaaatgaactaaactctccaatcaaaagacacaaagtggatgaatgaacaaacaaacaaaaaagatccaatgatctgttgcctataagaacacacaatacctataaagacacatacagactgaaaataaaaggatgggaaaagatattccatgccaatggaaactaaaaaagagcaggagttgctacacttagaccaggcaaaatagattccaaggatgaaaactataagaagagacaaagaaggtcaccacataatgataaaggggttgattgagcacaaggatataacaattgtaatataggtacccaacactagagtatccagatttacaaagcaaacatttttatagctaaagatagagatagaccccaatactataatagttggagactttaacaccccactttcagcattggacagatcttccagacagaaaatccataaagaaacttcagatttaatctgtgctatagaccaaatggatctaatagatatttacagaacatttcatccaacagctgcagaataaacattcttttcctcagcacatagttcatactcaaggatagaccatacgtcgggtcacaaaacaagtcttaagacattcaaaaaattgaaatattatcaagcaccttttctgaccacaatggaataaagccagaaatgaataccaagaggaattctggaaactatacaaacacatggaaattaaacaatatgttccagaatgacaagtggtaaatgagtaaattaagaaggaaacttaaagatttattggaacaaatgatagtaaaaacacaacatgccaaaatctatgggatacagcaaaagcagtactaagagggaagtttatagctttaagtacttacatgaaaaaatagaaaaacttcaaataaacaacccagtgatgcatattaaagaacttcaaaagcaagagcaaatcaaacacaaaattagtggaagaaaataaataataaagattagagataaatgagtagaaaatgaagaaaataatacaaaagatcgctaaacaaaaagttgttttttaaaaaaaggtaaacaaaattgacaaacttttagacccaaataagtaaaatcagagatgtaaaaggagacatcacaactgataccgcagaatttaaaggatcgttagtggctgctataaatagctatatagaaagaaatagaaaaatttggaagaaatggataaattgctagacacatgcaagctactaaaattgaaccaggaacatatccaaaacctgagcagaccaataacaagtaatgagatcaaaaccataataggaagtctcttagcaaataaaagcccactacctgatggcttccctgctgaattttaccaaacctttaaagaacacccaatcctactcaaatactctgaaaaacagaggaggaggaaatacattctaactcattctatatttgacagtattaccctaatgttcaaatcagaaaaaggcacaacaaagacacatttcggatcaaatggctttgatccaaaagacagtaacaaatgctggcaaggacatggagaaaagggaacccttgtacactattggtggaaatgtatattagtacaaccactatggagaacagtttggaagttcctcaaaaaactaaaaacatctaccataagatccagcaatccctatatgtgtgtgtgtgtgtgtgtgtgtgtacactaaaaagaaaggaaatgagtatattgaagatatatctgcactcctatgtttattgcagtgatatttataatagcaacctaagtatccatcaacagatggataaagaaaatgcagtatttaaacagaatgcagtactattcagccataaacagaatgagatcctgtcatttaaaacaacattgataaactggaaattattaggttaagtgaaataagctaggcacagaaagacaaacttgatatgtttgaacttatttgtggaagctaaaattaaaataattgaaccatagagataaagagaaggatggctatcagaggttgggaaagatagttgtttggggtagggggagaagtggggatggttaatgggttaaaaatagttagaaagattaaataatacctagtatttgctagcacaatggaatggctatagtcaaaaataatttaattgtacattttaaaaaaactaaaagtgtacaattggattgtttgtactacaaaggataaatgcttgaagtggtggatactcgatactccatttactcttatgtgattattactcattgcatgcctctatcaaaatacctcatgtaccccataaatatatatacctactaagtatccacaaaaattaaaaataaaaataataaataaatatttttattgagtttttttctgtgaattatacaatctcctaggctcttagtctgctaggagatgtagcgatgaaccaaaaagtgctcttatggatcttagggtatactagttaacgtagaagggttgctctaaatttcaaagtgtctgtttatcaaagcatctatgattatcggtgtcttttttgttttttgtttccttattgtttgtttttcatttgagtacttttctcattaaaacactagcttaagcaacatgtcaaggagaaagacaagacaatacaaaagacaacaaaacaagctcttcactgcattgcctcacccataaacttataaagtggctgtcactttataaaaggctaagaaaagctatttcgctgaaaaccttattgactgttttaatgacatcacatttgtagttctgttatgaggaaataaatcatggaaggagtgaggagaagtttagcaatagttgtggtcttacttgctgtgtggtgggtctcagatgccctatatgctatgcaagtagaaatcattgcttatcattttaatgtaagtttgattggaatgtgactaattacataatagttatacaaaaaaacatattctagatcagctaattaagcaatataaaatatgttttgtgcacaaataaagaaacatattgtttcattcctataagatacataaataaagttattttggactgataaatatttttttcaactttcaaaagttccagggtacatgtgcaggatgtgcaagtttgttacgtgggtaaatgtgtgccatggtggtttgctgcacagatcaacccatcacctaggtattaaacccagcatccattaactattcttcctgatgctctcacttcccccaacccaaacccctgagaggccccagtatgtgttgtccccctccccatgtgtccatgtgttctcattgttcagctcccacttataagtgagaatatgtgttgtttggttctctgttcctctatcagtttgctgaggataatggcttccagctccatccatgtccctgaaaaggacatgatctcatttctttttatggctgcatagtattccatgatatatatttactacattttctttatccagtttatcactgatgggcttttgggttgattccatgtctctgttattgtgaatactgctgcaattggcataaacgtgcatgtatctttataataaaatgatttatattcctttgggtatatacccagtaatgggattgctgggtcaaatggtatttctgcctctagatctctgaagaatctccacactgtcttccacaatggttgaactaatttacactccccccaacagtgcaaaagcattcctttttctccgcaacctcaccagcatctgttgtttctggactgtttaataattgccattctgactggcatgagatggtatctcactgtggttctgatttgcatttctctaatgatcattgatgttgagcttttttcacgtttgttggctgcataaatgtcttccttgagaagtgtctgttcatgtgctctgcccactttttaatgggattgtttgttttttcttgtaaatttgtttaagttccttgtagactctggatattagacctttgtcagatgggtagaatgcaaaaattttctctcattctgtaggttgtctgttcactctgatgatagtttcttttgctgagcagaagctctttagtttaattagatcccatttgtcattttgcttttgttgcaattgcttttagcgtttttgtcatgaaatccttccccatggctacatcctgactggtattgtcagattttcttctagggtttttatagtttggggttttacatttaagtccttaatccatcttgggttaatttttgtataaggtgtaaagaaggggttcagtttcaattttctgcatatggctagccagttctcccagtaccatttattagagggaatcctttccccattgcttgtttttgtcaggtttgtcgaagatcagatggttgtaggcatgtggtctcatttctgagttctctattctgttccatgggtctatgtgtctgtttttgtaccagtgccatgctgttttggttactgtagccttgtagtgtagtttgaagtccagtagtatgatgcctgcagctttgttatttttgcttaggattgtctttgctttttgggtgctttttgggttccatatgaattttaaaattcaacatcccttcacgttaaaaactctcaataaactaggtattgaaagaacatacctcaaaatagtaagagccatatatgacaaacccacagccaatatcatacagaatggacaaaagctgggagcattcccctttaaaaccagcacaagacaaggatgccctctctcaccactcctactcaacatagtattggaagttctggccagggcaatcaagcaagagaaagaaataaacatattcaaatagggagagaggaagttaaattatctttgtttgcagataacaggatcctatgtctagaaaagcacatcatctcagcccaaaaccttcttaagctgataagcaacttcagcagtctcaggatacataatcaatgtgcaaaagtcgctagcgttcctatacaccaacaacaggcaagcagaaagccaaatcatgaatgaactcccattcacaactgctacaaaaacaatgagatacctaggaatacagctgacaagggaagtgaaggacctcttcaaggacagctacaaaccactcctcatggaaaactagaaaggacacaaacaaaaggaaaaacattccatgttcatggatagaaagaattcatatcacaaaaatgaccatagtgcccaaagtaatttatagattcaatgctatttccattaaactatcattggtaaatctttttaagaaaaatttatagtataaattaatagtttaaagatggcaatttttatttagatagatcaaaaaaaatgctgtcacagagagatgtgaattgaactacctattgaggaagtatgttatcattaatgctttctcacaatttctttcatattaaggattttaaaaagttaaattatatacaatttcatttgtatcatcactatagtttctttatcaaatatgtgttgagtaaatgctgtgtttcagacattgtgctggaattggagatataatggtaatgaaatgaaggatgcctcatggatcttacagtctaattgaggtagaaatacaaatacacatacatatatacaacacatatgcacatactaaataatcacacaaatatatgaatatttactttcagataatgttactaaattgtggttatttctgtgctggcaagaaacacccagtttcttgaaatttacttttcaatgacttcttccaaatttaatcctgtttatgcctaaggatttttgttgttgtttttttaatctcttaaagttgcacattgaatcactgctgatttgtatgcatgaagttaccaggacttctaattttgtaccaagtttatatgtgctaatattttccattagtaaagaagactgaaagatgcctcagttgcctggaatttatgccaccaaggaaaaacagtgattagtgtgtttaaagagttagatcattgggttaatcatgctttgccatagtatcattgctatcctttaaataaaaaaaaaaggtttagttagaaaattttttaacaagataaaattaaccacagactataacgaaaagtaatttcagcaggattatttattctcccaaagttgaaaaaacaacaaaccaaaaaaggtgtatatgtgacatctacttaattttttaaatatgattatttccatcttttgttctttgatctccacatgagcagagacacataaagtggcaatggggccaagggtgctagatggcttggcattcattaactatggcaattagcaccatttagattgatatgttcccaagatgaaagtaagaattggactagacaaaaaaaatgatgatcgcatttgtgaaagtggaacaacactgaccaacaagaaacaaagaaacagagctcaccttaaaagacttggaatatttgaaaaattgattatgagataagataatttcaacataactacaattccttgaagagttattaatgcttcggtagcattaaagtaaaatgaaaagacaccagggcagtctgctttaatagcttgctggcttgaaccctaatacataatgttcttgtaatagtttatgggtgactgcagtaaattggtagtgaatgtttttcatttttttggctcttcatatcagatctgctcttggagaacattttgttctgagaatattatgaaggcagttcatctactttagaagttgcttgacaattttaatacagtgttaacttttctcccctccagattgtgtgatttttttgtcctttgtacccgacatcaatttatggtttgaaattcagcaatttgctcagttatactttacctaccctgactaaatattttaagtgctgccacaagaaaagaaaaaatctaatttttcccaatgttgttgttacccctctctgtttatatagcagtttaaatctgcccttcatcttgacagagaaaaaattttagatggattaattttgaacctaaataatttgttgacaaataatttatgatcatattcaggggttgttttgaggtaaaaagaaaactgcattgaatgaattataccaagtgaaatcatggtattttaaacaaaatgaggtttataattacctgggatttagtgaacaaaagtatgtgatgcagggctccctgaagaatttagtgcatgtcctatgttttagtgcttcaagcagcaaatattatgtatatacaataaaaaaggaagttgcagacttaatacatactgaaatggtctcaatgttaacattagactcatgaaaaattagcggacatctaagtactttattcgttcttttagtctttgctgtacctaggaacatttgtttcatataaaagttatattacaaaattaatggactgagggtggaaagagaatttgaaagaatgtgaaataaagtctggatatatactgaatgcaggtggaagatgtctgaggaacattaatgacaataaagagaagtctcttcctaagttacagacatccaaaaccaaaataagagccaatgtggttacataaaactgcaaagaaaatcttggttggacagagaactccgaagaggtagtaaaaggaaaaactgagcaaactagggaagacaaatgcagagaaaagttagaaataattagagaagaaataaaatgcttccacaaaaataagaacaacaaaaattcaggagataaatgcagaacagtccagctaacagaaaaggatttttgaactgtgtatgcaagaagcagacagcatgattggaaatgaagtatttgctctttcctctaagagtggaagaacaagacattcctgggcagcacaactctgcgtaggattagttgcacttcctcaaatgtattttcaagcaaaaagctgaaacccaaatgtcttgagccaccagaagtacccaggctcttatgtaatacaggctttagtgttttattgcttattcaaaaagacaaattatattttaaaattgatatatgtgtgagcatggttatgctacacctataaattaccaaacgtaataccaatagcagccaaccaacagtttagcctcagtattttcacaacagttcaaaatgttttgttaaatcccatgaaagtagcttcagtgacaaaggtttcagatctttgcaaatgataattaattcagaggcatataatgggaaacactacagtcaggtctagacaggtttagataaactaatggcccaactagttatggcagctacagtttttaacttcaagtaaaggaatcttaaagcagttcaaggaagaaacattttctttcttttcctttttaaaacatttaattgtcttttttgaggatgataaaagataaaatctagagactttattgtactgtactcattatagtctctcccctgcctcatatgtaaatctagtttgcttcttcatgtttattcatctctactttaaataaacatattgtacatatactctatacacacacacatataatacctattctcttccatttatgcttacattgtaagtcttttaaacatttattgaaacatttttgttggattgactctacattgaatagctttattataaatgaaagacttcccttctattaaacagaaatttcttttaataccactatgaggcagaacattattgctatggtataactttgtacgatcgaatgtcctactggttagatctgtgagttaatttaaatttttacaggctgttagatggagtaaaaggcaggatacagccatggactgtaggttttttatcctttagttacttctttaacttttaatttacattaatggacaagtttcatctagtctaattttatgtattacttgagtctttcctcatatttttggaatgccatttttaatttagagtgttttctaagttaaagtcttaattgttcttttcctgaataatagcttgcatgaatacaaagaactttatgtttgaattttggatttagtcagcttgatttttcactgaaatcaggcctaaacatatgaagttcagcagcaaaaacaaaagcaagcttacttactgaaaacgcattgtctttctataacaagcttactgtaaagactggggtagtatgtatatttccatagatacatatatatagtatctgtgtgtacacatatacacgtaaagttaagaaagtttgtaaaaaaactacacatacgcaacattagaaatactgttaaatatttatgtgtaatgaagctgttcttttcaatgatgtcctacattgtaaaggttttatttaaaaatttttatataatgaatgcaaacttgagtcactgttcaaacatgaatattttctcaaatgaacatatttgcatgtgttatgctatataaactgagttctgtaaaaaggatcctttttcttctgctaccaagaaattctacttttataattcaaacaatctactctctcccacactcaaaataagtcatcattacttaaaatatgtgtagtgtaacaatggaaatgtttgtatatttgtcaaactaaatattatgttaaaatattttatacatttccactgagaatgctcttcttagttaaaaataaataaaatttaaaaaaatttgaatggagacattttgaaagtggctattccaggtaggataaatatttaatttactccatagcataataattttaggaatcacttcattttgaaaaattattctgaatactagcaacattttggcctttaagacactttattaacagttttgaagaaaaagttgagacatttgttcaaaagatttgaatctattcacataatagttcagacaatctccatttttaaattcctaaattttgaaaatttaggatacgtaaaaaagataaattaaggaatgatggtttaccacatggaaaaagtattatttataaaaattttaaaagtataatttatttacaaaatttagttatttaataacatatataaaaagactcaagttgatattctaaaacatacttttaaacaaaaggaactgtctattacataatgaaaatttatgcaaccaaaatgagtattattctttgcaaagtagttgccttgggagacagttctttaaacagtatagctattgctctaaatattgcacaatgtgcgaacaatgttgaccttcagtgccaacaacatatcattttgaatattttcactgacaactgctctttaattttcgttgctttttagaaatagtcaagagtaacttagagccatgtttacctgacagagccaagtttattgccatagcaaaacctggcctgtatagttatagaaatcccttatcttcatttcttcacctccaactctacaatctactccaatttgttgtcctttgcctcctctactcccttcaaactaatctttctaaggctgtaactatctgttttcagtcaccaaatgggcaatcatttaaaaaatattatggaaatgataaaagccatttatcttgggtggttttgtgcagtttctaaaggcagtttcaaaagaggtaagtaactttgatagtgatagaatcattggaataaatatattaccttcactatgacaaggatatttggatgtttaacttttggatatctgatatgtattttccattcagtgcagtatttattgagcacctatattatgcaaaacactgtgcgagatgctgagacaaaatatgaagatgaagaaacaatgagaccagccctgactcatgaacaaatagtgaggtaaggagataaccttcaatgactctactgtgagacagatttaagtgttctcttggagttagaatgcactatataaatagagagggaagaattcattttaactgaagcatgacagttaaattgtgcctagaaggacagagattgaaaccttaacaggtagaaatggaagaaagaactaggaagaggaagtaagttgttcaatgtagaatagggtttctatctttttttaaaaaatggacagtttactttctattcatagcttacacagtaaaactgtgcttgtttcaactttgctggcactacacaatatgcctagattcaattctgttgaatcccataaactctctttttttgttttgtttttcattccatctttctatgcctgtgccccatgtgttctttctcagctctcatgtctgtgtctttttcagttctgcatcaccttcttttcttctacatctgtttctcacctttccctgtctctgctatcccctctcgtagtcatctttccgtcttgattgccataaggaattgaaatatgctatacttctctttgacaaatccaaacttgaataaactcttacactatggagttttcaacaaatccttactctttgtacttttttccttttttaaattgttccttcccttcacttaattccttgtaatctgtccaaattttatattctcctcccccacttttctcccttttctttctctcctttttgattcttacactacactactggtgtactcagaggaaaaaatgatgctaaaataaagaaaatgttctttacaatcagaatattattaaccagtacttccaagcataactagttcaatcataaaagttcatttaagatttcaatgattccaacttatatctctttatctctttttgagtcaagtattaaatgactagtacttcaaagttaaatgtattttactgtataatttttgagactgatcatttatatttgatatctatatctcatttcataactatactacatggtctaatgtatagcatatggaaagtttttgtagcttacctcttcttgcaagactaaatgagaggactactgttggcagaaagcaaagttggtcaaggccaaaaataggactgactgttttctttagaccctccctttttcttccttgtaataatcttgaactcctagattccagtttttcctttatttagccaataaatatttactgaatcctaactattttccaggaactatggtaagtgctattgatagatgtattaggccttctttgacacggaagagcttacaacctaggtggagagggagaaacataactgcaatataaattgataaggcccataatgggacgaagaacaggctactatcctcattatacatctggtactcagagacctctacgttattccttggattttccccatacttgcaacccacctttttatcctcctcattaaaacttacctgttattgaatcccattttcccttaaggcaccccttttggataggtgctttgggaaaacaatcccacaaattaactcacactggatattaaaagagtaaagcatatacctcacatccctcttgcattttaacaagtcagtccatttgaaaagaactggttgctagtgatgggaatttcaagaactgtacagtaggccattagaaaagtaaaactttcctcatacacttcaatcacaacagagaggggttgaccgtacaacataaaacttccttttagatgccctaacactattattatttaaacaacatagcagctacatattcactaagaaaatacaattgaatttaattgttgttagtagtagtagttaccgctagtaactactgttactaaaatagaaattatatatcgatttaaaattataaaatttgccttattctttctttaacttttattttaagttcaggggtacaagtacatgtttgttacataggtaaatttgtgtcatgggggtctgttgtacagattatttcatcaaccaggtattaagccaagtatccattagttatttttcctgatcctttccctcctcccaccttccatcctctgatgggcccagtgtgtgttgttcccctctatgtgttcatgtgttctcatcatttagctcccacttataaatgagaacatatggtatttggttttttgttcctttgttagttcgctaaggctaacggcttacagccctatccatccatgtccctgagaagaacacgatcgcattctttttatggctgcctagtattccatggtgtatatgtactacattttctttaaccagtctatcattgatgggcatttaggttgaatccatgactttgctattgtgaatagtgctgcaatgaacatacacatgcatgtgtctttataatagaatgatttatattcctttaggtatattctttgatattattatgaagattcacatgaaatagcaaggaatggttttctagttggaaaagtatgattcccacaataaaagtaataaaatataataagaaatatttacatatatcaagaaaaaatgattcatgggatcacaaaataaaaattatacaaattgaggaaagccttatttaatataatgtctttaggaaaaaaattagtatctgtggacctgggattcctcccctgtaaaatgaagggtttaaataagaaaaactccactttcttgcttccaggcttaacacatatgtgaatcatttgcataaatatttctcaattttcctactacatgaaattttagttgctacaatatcacaattaggcagtctgcataaataaaggagtttctcttatatttctaaatataagagaaatatataaaatatactaaaatactaaatatataaaatatttaaaaatactaaatatactaaaatacagtactaaaataatgcctaacacaaagtaactgccttagcataatttaggtggctgattggatggattaaagcttggattaatagaaaaacacaatgatgcaaatgtgaagtcaggtatatgtctacacatctaacaacatttaatgagagacactgaagacccagaaatgagtatttttacaggcttacaaataaccgatgttcaatttgggggtcaaaacaagaaatagagaaaactgaagtaagttaggtaaggtccattttgactaggattatttctggcaatttcccctcatctactttctgcaaattcatgcatgttcactgtactgtgcttactgacaatctgtaccaaataactcctggcagtttgaaatcatttcatctataacatataaataccttatttgcttcaactgtacaaatgctggaccccatctcaccaaagttttctagaatttaattgttcttcacctaacatctttaaaactcaatttattggtctgtaaaacagtaagacctacattatagagttattgtgacaatcagacggactcaaagcatgtcatagtttcacttacgtatctaccaacccactatcattagccttctacttgagaccaacccctttacctaagtactaaatgtggtaatccttgaagtctctgggacttttctatacaattatcatttttctctgcttgacttcaatgtcttctctgctggctctttatttttcaaaacatgtaaatcatttgtattctaacattaccttgactctgtgcctctttttaccaacaattctccctcctttcatcacctgtgtatattgattaaataaacaaaaaacaattcaaagtaattttatatgaaaaacattgcgggaggaaaatagaataaaaagcaacagtaacaatataaaaaaaaaatcacctgttgtcaaccacaggcatttcttcccaggtgtaatatagttatataaaataaacttgtcatcagaagttttgaatctcagtatttttgcttaatattaaattttatatagcattaccttttctaaaaaaagtgttaaaatagtattttaatgactgcataatatcctatagtaagaatgaaatataattcatttattcattcctacatttagacatttaggtactgtcaaaaatttttgctactataaatggttctgataaacatgcttgcagataaatctttgcatacgtctctgaatatttctacaaaataatcttcaagattggaaattattgactaaagtaaaataaacaatgtgaatagcttttacctttctgacacaagcttaaagtctttgttctttcattaagggaaatttttccatttaaatttatactaaaaatattgtgttattgacaaggcaagtaaagaaaagaaatcaatgctactgaatcaggcactctgatggatattctgtctcttcctattcaacacattttcctttggcaatctcttttcatgagcttatcaactaccaatgtattgatggcttccaaatttctcttcaggtatgaattctcctttgagcttgaaactcccatgtccaaaggcttcttgactatatcctatggtgtgtcatgcagtcctttggattctgcattaataaaagtaaagtattcttacttcacaaaatattctgtaaataattacccaattttgttaatcaagtcatatggaagacaatgcataaatatacaaaataaagaataagaaatgtactacaaatattcagaaagcattaaaatatgtcaaaatactgttacagatatatactaataaaattgaaaatctcaggacataatcttctaagaaaatatacattttcaaaattgactctataaatggaaaattttaacaggccaataaatttaaaaattaattaagaaaggttccagaaacaggtggttcaagagcaaattctatttaatttcctttttcaaaaattgatagataaaattctatgtattttccatgtataacatgtttttaagtatacataccttgtagaacaactaaatttagctaattaacacatgtattacctcacagttatttctgagtaaacatccattcattatttttcaagaatacatgtattattaactatagtcatcatgttgtacaacagatctcttaaacttattccacctaattgaaatgtcatatcatttgaccaatatctccttaaaccccagttttaatagaaaattgaatttcattaagttttcaaggatcaaaataaacccataacatagtaacaaaaacaaaatatttccaaattcattttctgaagctagcaaaagcctaaaacagtacagcaaaggaggctactgagcactgttacttcactccattgaattaggactggatgcaagtgtaaagcatcagatttatagaacttactataaaaaactctaaaatatctcattaacattttcatattacatattaaaatggtaatatcttggctatattgttttaaataaaatacattattaaaattaacttcatctgtttctttttactttttaaaaatgtagtcacaagaaaattttaaattgcatatatggctcacattgtattcctattagtattaatatagataattttgcttataaggatacaaaacttctcagcgagttaaatataacaatatattaaaaataatttgtgatgaccaagaaagttgaaagttttccattagaatatctactaatatatatgataaatttatataagtatgattttaaaaacaataattttgatagtgctgaaaatgcatgcaataaaaatcaaccacaattcttaattttaaaactcttaataaactatgatgaaactctttaatgtaatgaagaatatctacctataaaatggttgacactacacctaatggtgaaaacattagtggtattcccagtgaagccaagagaaaaacaaactcttgctagcacttattattataatttggaagctccagcaataccacctaacatgaactataaacatgagaaaggagtagaataaaaaaattaagaaataattagaacttataaatcagtaacctgcttgtttactatacacacacacatacacacacacacacaccaaaaacagccatttaaaaatgcaaaggaaagaacaatctcttattaccaatgataaaaaataaaaactacatagaaactaacactacaagaaaaatgtcagacttatatggaaaaaatgtttttctaagtaatgttaaaaaattttgaataaattaagacatcttccagatgagaaacctctatgtcaattctccctaaaacagttcataaatttaatgcaaccactctcagaagtccaataaaattgaagggggggggcagtggtagagagaccttgattaaataattctaaatctcttataaaaaattggttaagaatagccagtaaccttttaaaatgaaaaatactaaaaagaaacttttattagcaggtttaaactgtattgtaaaagccacaataaatagtgtagtcctagtaaaccatatagaaactgatagaactgaagagaaaaaataggctggaaatcaaatagaaagacaagaaacaagcctatttgtaaattaagtatttagcatatgataaataatgcattttaaatcagtgggaaaaacatagattttttttcaattgatggtgctgagacaactggttaaatatttagaacagagtaaatttagagcctatctcacactgtatatcaaaataaaattccagatggtttgaagagttatatgtaaacaataaaaccataaaagaaatagaagcaaatacagaagaatttttaatcttatcttgggttggagaaggtcttcctaagcataaaagcaaaggcagaagccataaaaaatgtaatatggtttttaaaaatagaatatttgaacacataaaaatgaaaggtcagtatagcaaaaacaaatgaaactaaaaggcaaacaataaatttagaaaaaactatttgcaacatatgacagagtatcatatagcagctgaaaacaatgtcctatgaaaaataattaaggacctgggaaaaacaactagcacatagtgttaaacggagaaattgttataaaacagtacatacattattataggaactttgtaaaatacacttacatttgggtataatggtttcccacatataccatgtttataatttccatgcttttatacatatagtcccctttgactgaagagatcctccttccttccctgtctatacatctcctattcatctttcaagcatcatttctgacatccctttagacaacaagaagtcttctttgaattatcaggctggaatatgtgcccttcctttgtttgcccatagtacattgttgtacaccatcaaattaatgctatttaatattatctgtttacatgtattactccacccctatgattaaagttccttaagagaaagggtaatattttacctctttctgcatgctcatttcctagtattatatctgtcaattagtacacattcgaaaatattggtttgaattattgctaaaatgtcttctaattaagattattccaaaatgaagctaacatcaatagggagacaaacaacacaagaggcatcaaactgtataagaagtctgaaagaaaaaaaagacttaacgtcatgagagatgattctgtcctcattttcacgttaaaccagaagcttccttcagggtacagctcaatgagtcaccctagagtattctaggtatatattgatattcctaaaaatctaaacatatgtaccatatacaaaccgtgtcccacaatttatcacttaaagtttattgtttttaaatgatttctcatttatgagtcttttctctcattagacgttaatctctgttatgtgaagaggtcatgccttatctaggcagatatcctacaaagtgtttggctaagtaccctagtactttaataaaaattcaatatgcacaaattttctatacagctttaagtaattttctgtttttatttacatacatcccttcataattttctaagaaaatcaggatctactccaatttcctcattacccatcatcatccagaatgatgaagagatgtatagattattaagaaaatatttgcgtttgctgagtaaacccgatattatctaatcaaaagaacagcttcggctgtgctgctcctagctgtgctagtccacacagctttcccagttttcatgaattagtggaggtaatgttaaaccacttttctagtaagagtgcataaggatatttaagtgagctcatccctctaacaaaggaaagaataattttcattaatcattattcaacagtacatcttcttgaactaaatcatgagaggaggaacttatgatgttttttattagtcaaaacattttctatatatagcttagtatatgcaacgtgccaaattacagaattctatttactgctaatgtcaatttaccaccacattgcttgatataattcaaagttttccaaggagctatttgacctcctatagactgaaaataaaatcatgagatttaaattacttaatgccaaaaaggaaagtcatctttttctccttcttatgtctttgtttcataaaactattatcagacagtccatgcaaacaactaaaaacaaaaaattatatggtgtagttaattgaaaaaatgcttttgctacacacagaaattgacactaagtgctgtattagaaggaaatcagtgattttcaattgacattgcacaggaaatcatttagtgtcaattgatattaaatgggtaaaattgtactgaattagtacaaaatgatttggtggaaaaaaatgtgcttccattaggtgacttgatattaagtgggcttaaatgtaataagttttagaggtcactagtcaacaaaaattggggcatgctattcaaccctgagtacatcagactgcttgctcttaataccctcatcaaaagataagttagtgtcatactatcatgacaaaattgtcttcctttgggctttcaagggaagtgggaaaattcaaattgtttaaatgagctaaattagccagtggtaaggaccatgacttcttagatttatctggtggtcctaatcctttaaaaatatttttttttctagaatttttggcatgaaatgaaaggcaacataacagcacgtattttatgtaatatggtccagattgcgctttctttataaaatggctttgacagtaagcacacaataaattatattgtgttagggagtgatatgattatatataatgaagtaaccactttattgatcttttaagaaacctatgtttttaaacctgagtaatgaggaaagagaagtgtgtggctgcaggagacacaaggaaggagaagaaacaggaaaagttacattacacagtcactacaagaacaaattgaataaaatattatagatattttctgggaagagaaatgggggtttgtgaggtacagaaaattgtaaaactcatttgttacttagtaatacaagaaacaataacaataaaacagacatactgggaacactccacccaacaaaaacagaatacgcaatcttctcaagtgtatgtaaggcaattaccagtgtccaggatagaccacatattaggccacaaattaagtctccatagatttaaatagacaaatatcatacaaagtatcctttctgaccacaaagggataaagttagaaatcagtaacaaaatgaaaacagttaggcaacatactcttaaacaaaggatcaaaaaagaaatcacaagagaaattagaaaacacccagagatgaatgaaaaagtattatcccaaatcaaaacttaagaaacacagcaaaaggagtgctaaggggaaagtttataattataaatgcttacattaaacaacaaaaaagacctcaaatcagaacctaactttacaacctaaggaactaaaaaaaaaaaaaaaaaaacaaactaaacccacagctagcagaaggaaagaaatacgtattagagcagatgtaaaatacagaatagaaaaataagataaaaccaataaaaccaaaagttggttcttcaaaaatattaataagattgacaaacctttggatatatatactaagaaaaaaagagaagactcaaattacaaaaatcagaagtgagagaggaaacactactactattctacagaaataaaaatgattataaaagagtacgatgagcaattgctaggccaacgaattggataacctagttgaaatgtagaaattcctagaaaaacaaaacctaccataactaaaccacaaaggaatagaaaatctgaatagacctatataacttgtaaggagattgaatcaatattcaaaaatctcccaataaagaaaagtcctggacctgatgacttcactggtgagttctaccaattatttttaaaaagaataatatcaactaaagtttcctcaaaaaacaaaaaattgagctaccacatgatccagcaatcccactgctgggtatgtatatacccaaaagaaaggaaatcagtatatcaaagaggtatctgcactcttatatttgttgcagcactgtttacaatagctaagatttggaagtgtccatcaacagatgaatagataaagaagatgtggcatatatacataatgaagtactattcagcaataaaaaagaatccctctcaaacttttccaaaaaaatcagagaaggaaacactccctgattgattacatgaggcctgtattaccctgatgccaaaaccagacaaaaacacaataaataaaaacaacagaccaatatctcttatgagcattgacaaggattgaaaatccttaacaaattatagcaaaccaaattcagtagcatattaaaaggattttaccctatgaccaagtaggatttgtcgttgaaatgcaaggatttttaacagatgtaaacccatcaacataatacaccacattaacaaaataaagggaaaaaacaataatcttgattaatgcagaaaaactacttgacaaaatctgacatccttttataataaaaatcctcaaaaactaagaataaaagtaaaaaaccctaacataataaaatccatgtattaaaaactcacagctaaaataatactcaagggtaaaatactgaaagctcttcctctgagatcagcaacaaggcaagtactattccacataatactgaaagtcctagtcagagcagttaattaggaaaaaaagaaatgaaaggcacccaaatcagaaagaaataagtaaaattatctctgttcacatatcatatgatctcatatgtaaaaaacatattccacaatttccaccaaaaaaaaaccctgttagaactaataaataaatacaacaaagcagcaggataaaaaaaatcatcacgcaaaaatcagtcacattgctacacactaacactgaacaatctaaaaagaaaactaagaaaacaattccatatacagtagtatcacaaagaataatactatttagaaattaaccaaagaaataaaatttttaccaataaaatctataaaacttttctgaaagaaattaaagaagacataaatgaaaagaattgtgttcacgaattggaaggcttaacattgtcaagatatcagttctgcccaaagtaagatataatgtattccctataaaaatccaaattatgttttcacagaaatagaaaaactcatcccaaaattcacacgaagtatcagagaacccccaaacagccaaaacaaaactaaaaatgaagaataaaaccaaagcactcaaacttcctggtttcaaaacgtactacaaagctacagtaatcaaaacagcacggtactggcgtaaagacaaactaagaaataaaatagagtccagaaataaaccctcaccagtgtggttaaatgatccttgaaaagggtgctaaaattattcaatggggaacagacagtcttttcaataaatagtgattgggaaaagtgggtatccacatgcaaaagaataaacttcaatccttacctaacaccatatataaaattaattcaaaatagattctaaatataagctttaaatataagatctaaaactataaaactcttggaagaaagcatgaggcaaaagcttcatcatactggatttggcaattatttgagtatgacaacaggccataggcaatgacaacaaaaaagacaaattgagcttcataaaaattaaaaattaaatgcacctcaaaagtcaccatcaacagagtaaaaagccaaaccactgaataagggaacatgtttgcaagtctcatattggataaggggttaacatccaaaatatacagagaactcctaaaaacacaacaacaaaaatctgaatcaaaactgtgcaaagaacttgaatagacatatttccaagaaagatatacagatggcaaacaagcacatgaaaagatgttcaacatgactaatcatttgggaaatgtaaatcaaagctacaatgaaatggaatctcacaccaattagaattgctactatcaaacacacacacacacacacacacacacaaaacaagttttagtgaggatatggagaagttggaaccattttacacctttgatagaaatgtgaaaaacagcatggcagtttctcaaaaagttaaaaaatagaactaccatatgacagagcaattccacctctgggtatatattcaaaagaactgacagcagggtcttgaagagatatttgttaatatgttcatagcagccatattcacaacacccatattcacaattactaaaatatggaagcaattcaagtgtctattggatggataaatggatacacaaattgtgatatatatacacaatggaatattattcagtcttaaaaagtaaggaaattgtgacatatgctacaacatcagtgaactttgaggacactatgctaaatgaaataaagccaaacacaaaaagacaaatattgtatgatccaatttatatgaagtacttagggaaattaaatcataaagacagaaagtacaacggtggttgccaggttgctggtgggaaggaaaaatgaggagttgttcttttatgtgtataggctttaagtttgcaagatgaaaataattctggagatacttggtggtaatgggttcacaataatatgaatgtacttaatgccaccaaactgtacagttaaaattgaataaggtggtgtattttatgttatgtgtattttactacaataaaaaagttgaaaaaaaaatgaaagaaaagctttgtgatttttttttctttcttttttttttccgagacggagtctcgctctgtcgccaggctgaagtgtagtgtcgcgatctcggctcactgtaacctccgcttcccgggttcaagtgattctcctgcatcagcctcccgactagctgggactacagtcttgctctgtcaccaggctggagtgcagtggtgcgatctcggctcactgcaacctccgcctcccaggttcgagcgattctcctgcctcagcctcccgagtagctgggactacaggtgcgtgccatcacgcccagctaacttttgtatttttagtagagacggcgtttcaccatgttggccaggatggtctcgatctcttgacctcatgatctgcctgcctcggcctcccaaagtgctgggattacaggtgtgcaccgcagcgcccggccactttgtgattttttaaatgtgacctgccccaccccaaaaatacatagatagggaactcttcatggtaatcactgggcttgaagagatagcattaaccttttttctaatttggccctgagactgaaaaatatatatatccataggaacccatacagaacttacgatgaatgtccacgaagtaaaccaagaacattccccctagcattagcagagagcattctaaaatataatttagtttcatcacagaggaagcttacaatgaaactggagctacattcaggacagtctttaaggttcaggagaatgatttgctgattcaaatggacaacagagaaatctgattaaataataatatatttatgatcattactgtttattaagcttttactaatagtgaggataatcttcagcattcttcattaactatcaatcgttttgcttaacaatctgataaggtccacctatttcagaaacaaagatcatgagattaagaaaactgaccaaagtaacaagcacagtaaggtgttaaacccacatctatctgaatccaaagtaaagaaatttttggggggggcggagtgaggaggtggaaacagagtctcactccgtcacccaagctagagtgcagtggtgcaatctcagctcactgcaacctccgtctcccaggttcaagcaattctcctgcctcagcctcctgagcagctgggattacaggcttgcacaccatgcccagctcaatttttggatttttagtagaggcagggtttcaaaacgttggccaggctggtctcaaactcctgacctcaaatgatccgccagcctcgacctcccaaagtgctgggattacaggcgtggccaccatggtgggccccaagtaaagaatttttaactaggtaatttggactttcaaaactgggacatagttggtgatttaaaataaaaatcctcttgcaagaatctgaagctaaaatgttccaaagcacaacaggagctgtgaacaagttagtagtctataaggagaagtataaatacattggaagaattaatctagggggaggaatgtggtttaagcagtaattgataggtgaagatgagcacaaaaatcagaaaacacataactgtacctgtaagttgctattcctttaaatcttgccttatttttaaataaataaatatgctagaaaacatttattctttgtggttttagtacatagaataatattttaatttccaaataccacaaatgaggtctaaaacatgattaaataattaactccattatccttacaatagaaaacttagctattcaaacaatgaagtttcacatgggtgatgccacctcctacattgtcacacattaaaaagttatagtcacaggtttttaaagaaataacagcttttccgggttaaacttccaatctcaagcctattcatgatgataaatgtcacagggtcaaagacctacagggaaaatctacgttagctctaaggtgggttaaccagtacacactgattaatccaaaatccatttgttaggaacaaggcaagtactacacacccttcattttgaagatactcataaacccaattaacaattttcaatgacaaagcttgtccctttgtatgtatgtataataacatcatagaactctatacaagcacatacaaaacaaggtgaaaactgacttggccatacaggtttgcaatctaactagaaagcataaatatcacaaataaatagatgtaaatacaattagtacattgataaacatacttcatactcttatgcagtaaatactcaaaaaaataagcaatgaaaataacatagaatacttgttgaactgactaaactcatcccagtgaagtttcctgaatacattttccttgaatttttattataaaactgcagctaaattttgcctaaacaagtttatccctaaatgtaaacaatgcatccaacattatagaaatcatcaatttttaaaaatctgttgttggtaaactattaacgtcattatattcaaaggaaatgttaaaattattaaaattttaatattttaattctaaaaactatatactactatcaacatttgcttcacacatctgcaatatgaaagtggtaacgtctaaaggtttaacattttaaaataatattttcaccttttagccattgcattatatcaaagttatgcaattttttacctttttattattattttttgcattctctccctttactggagattattgccttcttctctgacatcataactagataatatctcaatgacctgttactgtatccttggataagaggagatagcatctccagtaaggtcaaatatgagtcaaccatgtgatatgggtactgaaaaattccaattaaatcttaaactgacctgacagaataacagtatctagaatgagggagatgacattcccactctcatcagcaatggtcagatggcatgatcaatactgtgatacatgacccagaagcacaataatatcctaagaagggggaagaggaagggtgaaagactagaatcataacatatttggaatggtagaaagaatcaagggtattacatgttgactatgcgattaggaaaacaatcgggatagaaaacgtttcaaatgtttgaaaacttcaaatgagattactctgtatgttcccaaggcatatactattaataaaatgatgggttgagaatactagatacaggtttcaactcaaagtaaataagaacctcttaacatcagaattgctcacagatgacgtgttgcttgaaatattagtgaacatatttcaagcagagactggaggtgtttaaagcagttttacaatatgattctattagtcttctcaaagctcagaattaaaatatttaataatgctgagtggtggatgtttttacagtgtggcctggaatctgcagttatcaacctacaagtgtctgatttttattagcaaagtattaaaaagttgttcattttcccaatttaagaagaagtttatgcactggacattgcttttcaaaagttattttttgaatagtggtaaccaaaggttggggcttgcgtagtggggagaatggggacatgttggtcaaagggtacaaaatttcagttaggagatataaattatggccatctattttacagcatgaaaacacatagttggtaacaaataatgcactacacacctgaaaattgctgaggatagattttaaatgttatcaccatacacacacatatacatacacacaaatgataagtatgtgagatgatagatatgttaagtagcttgatttattatttcacactgagtatatatatgttaaaacatcctttgctcaccataaatatatacaatttcatttgtcaattaaaaataataacaaagttacatatataattttttttatttcaagtggtatggctttatataatgctgaatgactcactgactgattgaatcactgtcattcattcaacagacatttattcagagcctggtatgtgccaaagactgcaaagtggcatacaaaaagaaagaataagacaaagcctatgcttataatatgtcagggtaagtagacacccaaaaataatcattttcaaagtttaagatcttattctagaagcctgtgctctgggagcacactggaatggcatttaactttccagaagaatcaaggaagacttcactgaggaggtgatatttgagctgggctttaaaagattaataggatttaactagatagcaagggaatggaatgatatttcaggcagaagaagcattatgtactcagaggcatgaaagtacatggtgtggttagtgaaaaaggcaagaaatttggtaaagctgaaatgtgaggtataaagtatggaaagagtgaaaataagactgacaaagtagatcatgactaaatatttggggtcaatataagccatgctaaggtgtttgggtttaatcttgggcacaaagaaatgttttcaagtagaaaggtaacatggttacatttgcattttagacaatatatgtgcatcatgtgtgagaaactcatttctataaatactagtttttgccttgaaacatttcagggggagtggaatcctcgagttactggcaccagcaagggtaaattaatgggcactagatggcggcatagagtgcccaattcttcataatatcagttactatttctgagcctgtatttttgacttaaataattcctttattcaaaaatcccattaaatgaatatgcactatttagactgattggcatgaagtaatagactactgtaaggggaacacgcattttttaaaagaggtaaagcccatgttggtgcatgatggaaaaggcagttgaggattataaaaatatttggataaaattaaaaatacaactttgagttcaatggaatcttaaatttctcttgcagaagttgccattcgtctttaaataataatacatatatgtgtaaaacacctaaacttcataaagtcatgttatattcaccatctgtcctcttcttcaattaccaccattaccacatggacaaacattacaattcacattttacaaggaacgaaactgaggctcatgtaaatgtttttcccagtttatatggtacagttaataaataatagtaccaaaaccaaaactctagtttttttattacaaatccagtctttggttcactttgtcatgtttcacaactgaaaaacaattgggaactaggacaagattaagacaaggaaatgatagaaccaaatgattctaatgccattctgtgataaacagagagcaaatactgtaaattggattgtatattcattaagcccatggtttctgacaattattttggaagaatttacatgtcaaagaaaattatgaccaatatttagttataccaaggaatttacattggagaagctctatatatttttaatgtttggttgataatatgttaacaagatgattagtaagaaacacaaaaatagtttgtaacttaagatgtaaaagattccaaataactataaattccctatggagaagccatctctgccccatgtcatcatgcctttaaaattagacgcaaaagtttgaatactcaacagtagaattgtttatttagtagtgtggaaggtctacctctgtctatttcctgagggaaagcggctataatgagcctgcctgaattatgagaataaagttttccttttttaaagagtttattctaacagataggaggtaacttttatttctgccttcctctcttgccactccatccccagctaagaatccaatccctcaagagctgtcatcgtttttgttgttgttgatactctccaccaagacaaactaaaccagactgagaccatgccattttagcattatgaaacaagaaagaaagcaaaagtcaccaacagagcaatacaggaatttgagatgtacagaggaactgaaaaaagaggagctgataggagcattctctttcaaagctcaatttagtgttccaactacttaaaaccctatcacaatatactctatgccatcagggaagaaaaatgccaattttaaaacattattttcacttttttataaaaggtaaaacatgttaaggtccatacgtaaaatctttccaacacatcagttcatctgcaaattagtagctgaagtctgctcaaacgcagaggaaacttccatttaggtcttgaaaaagaatagagctcattttaaaacatctttatttatttgtgcaacagtgagtttagaaacaaagtatccagtgtattttcctagagttaaaaaaagaaatatttttattgagtacattccaaaacaattaaatattctcttaccccacccttttcaccaactgaatagttttcgtttgactttgaattaccacccacttactgatttacaaactggtcaaattcagcatatatacccacactcatacaaaatgcatttcaggtttccctttttggattaaaaactaaaattttattttacagtgagagctaatttgttaggtaagacacaattaaaccaagaaagataaatctaaacttacttacttcttccaaatttgaaaattgtccatgagatcttcaccaataagctacatcttttccatgctttatgatcataccccattttttgtatgcaaagaagaaaggggactaatatctttgatcataagtgttgagatcctaaattaaatctaagatttggggccttattaatacaaagggagaaaatagttaactgaagatgtcattagtaaaaattttcattaacttctatctctataatttctggcctttccagttttcggttgcatctttctagaaatgcatgtccttttcctagccttagctctgaaaatattgcttctacccataaaatgtcatgttgataatgctttaaatattgaactataaaatttctatatcagaattaatgagcctatttcatgttttaacactgaaaatacattctaagagtttagaacttctttaataatttgtttaaaaagtagttgaaggccaggcatggtggctcacacctgtaatcccagcactctgggaggccaaggtgggcggatcacttgaggtcaggagtttgaaaccagcctggccaacatggtgaaaccccatctctactaaaaactaaaaaaaaaaaaaaaattagccaggtgtggtggcagccgcctgtaatcccagctactcgggaggctgaggcaagagactcgcttgaaaccaggaggcagaggttgcactgagccgagattgtaccactacactccagcctgggcaacactcagcaagactctggtctcaaaaagaaataaaataaaataaaataaaataaaataaaataaaataaaataaaataaaataataaaataaataaaagtagttgaaaccagaaaaaaagagatcatctaacatataggagtagaattttgagatataaagttttactccacattttctttgtcactaatatttccccactattccttgcactcataagcccttattttcagaatttattgtctattatggttttaatatgtgtcccctccaaatctcatgatgaaatgtggtctccggtgttggaggagggcctggtgggaggtgtttggatcatgggggttgatacctaatgaatggcttggcaccatctccttggtaataagtgagctctcactctaagttcacatgagatctggttgcttaaatgcatgtggcacctcctcacctccttgctcctgcttttgccatgtgaagtacctgctcctcctttgccttctgccattactgtaagattccttaggcctccccagaaaccaagcagattccagcaccatgcttcctgtacagcctgcagaactatgagccaattaaacctcttttctttataaattaacttgcttcaggtatttctttatagcaatacaagaatggcctactacactctccaggaagtttcaaatcacgtaagactaaatgttagtattcttactgcaagccaaccagcgtaggttcaccctcttttattttgcagcgagaaaaacaaaacaaaacaaaactaaatccatagagctgattttgatttacagatacattcattttatttataggtatcaggcatacttttttccaagcttcagacctccaatgagaaggcaaagcctaatgtggttcagtcttattacctggctaatttgaaaggcaaaataaatgacagtgaagaaataaaagacagctaaaccagatgatgttggtttgtaaactttaatgactacttattaaaattttgcaaaaaatgaaattggttattatctatatcagtgatttccaatggtggctaccagaagaattgcttgggaaccttttaaaacataccaatgccagagccctgccttacaccaattaaatcatatttggcagtgccaagtttaaaacatacctgaggtagcattttgttaagactgtttaacaaagttatcgagaacacaagctactttcaatctgaacttcatttgcctcatccccaaaatgggcagaataactacactatgtggatattgtgagaattaaatgaaataatgcttaagaagaatccagaacaatgactggctcacagtatgtactcatttgtaggtggtattgctattagagctcctgttgatctgcactggtaaaacctgtaggtgttacagaaaggaaatggtatgcctatgaataaggaaaaggaagaacactctttaaacatcaatcgcagccagcaatgtgctatacccatgagacataggaaatacagcagcaaatcatacttagcattcctgtgatagatgttagccttaatgaagtatcttcatgccatacacaggaccacaaaagcctctgtgggacccaacatacaatttcctataataactcgtgaatcccattcattaaattagtcatattgaacattcttattcaatttctctatatctaatgccaataaactaaaaaacatgtagtatatgttcctatttatatctgcatataaacataaatacatatttttacatatatatgaaacattaaaaaacagaggtaatttttttgtctatataattttcccgtagtggccgaatttcctaaaataagcatacatcatttttataagtaagatgctgatttcattttaattaaacaaataaaaagtcatatatatttaaaaatacaaagaaactacacctttctacaattaatttattagaagtttgtttactggtattgttattgtctgcactgaccttaagcctccttaaagaaaaaaaaaaggcaaacaactaaaatgcaatcaatccagtcaaattcatggtgttataaagttcttcagaacagcactaacatggaagacttttataataggaaaggaaaaaccaaataagagagaaagagaatataaataaattattcagccctccctttcaaaaagtaaagaaaatattttcagaatagattatttctttcattatactactgacatattctttccctaaattctaattctgatcctaatctttttctctacttcttttttctcctcatattttaagattctaagattgttctcaaactgttggcaactgctagatcacttgatgagggttcaacaagcatgtggaccaccagttttagttggaagaatgccattgtttacaatctttcatcaaggtatctcttactggctcaatgataaattgtgtgagccatagatcaggtgaaatttttatccagaaaaataattttaaaacatcttcatttgtactgaatcagaaaatcatgacatacttagaggtcactgggattaatactgaattcgagatggctctgtcaggtagttctagataatttgcaataagcatcaacccagaggttacgaaaaggtttctcactgaagactaccttcaatatgtaacagatgctaagtcaaaaattatattacacacaaacctaaaacgttgaaggttttaactcggaagatggagaaaaaaggattcttaatccatcttttgacagcactcagtcctataaagttgttagaaaaaaaaagtcttcatgttttgcacctggaaattatttttaaatgggcttaataatgtggcatcaattcctttcccccaaaatgagtaaacacatcaaatgttgggtaaaagtcatgttctcagtgatcgttgagccatatgtaccaaaattaatattctaaagaaattctgctatcttgtcctcaactaaaaatcttgttgaccttaaattaataggtcaaggctacttaagaattgatatgtatgacttaataagactacttgaaattataggaatagtttttataggatttacaagtattatgaagaaatagtttttcattttttcattcatagttgcaaaatgtaggttatgaaataactttaaaaaacaacatttccattcatgtaaaaacctccctctccttgctatgggcaagtctggttctccataccgtcacaatgacactttcgcagtcaacatcacagctcaggaaataattattaaaaacaaacaaacaaacacaaatatctattatagagtatgggtttttagtgataagaaaaacaaaagtcatcaagcatttcttcacatattcacagaacaaatgccaagagctgatttagaccttccaacttaaaatttaattatctgctaccacatacgttagatggtatctgtttttccacagtacagtaatatgttgatataatgcagaatccaacaatttggtatgataaaggaattttatcaatactttcttctgctttctctctgaacatatttgtcatcatctttgaggctgatttaccagttttgaagcaatcctgcgcattacttgtaactgtttttgctatgaggagtacaattctgaatgaagtctttgtagttttgatcttttcacctttagtaataaaagtcatctattttgtaccagaaaacagtaaaatggcaaaaacaaaaagtttcaatagcttcctttgattatttgacaaagtttgagaaaagacaacatacttggaaccagaggaatcaggaagaaaaaggactgctggtatttgtcagtgggctttctatttgtgcttcttaagctgattgtacgaaatcctcacacctccatgttcactttacccagcacttattaaatgtacattttattgctccagaaaactattcactatttatacttataatcattattgtacattattgttagaattttcatatttttatattttaatgaatctcctttaaactactgatgtatttttgtgaattggaaatacaacagaaaagtaacaatgaataatgcaaaatttaataaatgtaaacaatctgcaagttatgtaaaacatattaacccggacatattatatactgtatcctgttaaatgcctgttggttgagataaacacaagcaaatcagtttcaggatctaattggtggtgaacagctttcactatagtaaagttaactttatgtataacgaaattgtttacaaggcctgcattccacacaatgacctggaattgtgacagttcctcagtcccagagatgctatattcatgattttgcaataaacaaaactaatacttattaagagctaagaaaattttctggccgggcgcggtggctcacgtctgtaatcccagcactttgggaggctgaggcaggcagaacacgaggtcaggagatcgagaccatcctggctaacacggtgaaaccccagtctctactaaaaatacaaaaaaaaaattggccgggcgtggtggcgggcgcctgtggtcccagctacttgggaggctgaggcaggagaatggcgtgaacccgggaggcggagcttgcagtgagctgagttcgcgccactgcactccagcctgggcgacagagcgagactctgtctcaaaaaataaaaataaaaaaagagctagcaaaattttctaaattaaatcctaaatcttttcttaattgtatcacatcttcacatacacacaaatctactatttctatctcaattcagttagctttatattcctgaattggtttgactcagatagaaaagttcccacaacaactcattttgagaccatttcaaggtctgcctatttaatgtagtttaaatcctatgtcaaagtcagggccttgggtttatataatttatactgataaatcataatgataatcataataatatctcaacagaaatgtctgtcatttcaggtaagataaataatcttgactaaattaaaacaaatgttgaggtaattattactatgtacatttgaaagcaaccataagcttcacaaaatgaatcaaattcacaatcgctactctcacaaagtttatgtattaaggactattgcaaaagtcatccattagtcttttcttacacaaataggaagtgaaaccaatgatttaccctttgtttacaaagatgtgactatttttaaattgttatttacatttaaattgagcatttatttagcacttgtcttaaaacagtaatttttggatgatatataaaagagtatttattaaagacttctatctaaaaaaaaggatttataccaatccatgcacatattagcttacttctacaacctcacctttcacaggtacacatacttgaacctccaaacttactccattcatactgaactatgtgaactatatgcaaacccatgaacgggtcatatactttttttttaatgctaaactttttaataagctgtttctcttcttataaaacccttaatacttgtaactggctaattcctactcaccttttcagtgctctcttagccatcatgtcctgtaggaagtcttccctgacttgggttaagtgccccttcttgtgactctatacctctctggtatatagagagaggaattatcactcaacagcaattattataagatattgaaaatgtccagtgcccagcctgtctctcccactataccatacattctcaaagaaaaggagtatctggtggttacttttttatttctagcatctagacaaataacaagtattgactaaataaagtatatttcagaatacaagttgggtattccttgtccaaagtgtttcgtatttcagattttttcagattttagaatatttgcatacacataatgaaatattcttacaatagaacccaagtctaaacacaaaatttatgtttcacatataccttatatacgtagccttaaggtaattttgtacaatattttataataattttgtgcacctctcaagtgaagttaggtgtgaaattttccacttctggcatcatggcagtgctcaaaaagttttggactttggaatattttacttcagattttcagattatggatgttcaactggtataaggcaaactgtttagtcaatgttatttctcagaagaaagactctcatattatgggccacacttccaattactttcttataaacaacaaagtagtatttaggaaagatttattagcaaggaattacctcagttggtactggtttgtcatggctttagaggtcaatctgctagaatagttaaaaatagaggcaaaataaaatgtaatacaagtttagtttttatttctggaatttttttcacaattgcaaatgttagctgctgatttaaatatgcctttcaaacatcatataaaacagccaaaagattatatcattacatagtacagatcgtaaatatatgcttaaggaacaagtgttgaaaaaaattcccctagtgttatggaaatggtatttgtgtcttctgatgaaattttaagtgacagtatcaaagatgaatttaaaacatgttataactaaaataacttaggtaaaaccaaaaatgatgtggttcggaaaacattgaaaaggtacgaattttataaatgtatgtgacgaatatgaataaaacgttcataaagttaggattgaaaattaacattagtaaattaaaatattattttatatgactttagttataattatgtatatgctatgaaattataagtaaatatttgtctctcatatctaaagctcccttcaaaagagtttttttatgataaaatataaaattcattagcttagagttatttgggggcatgtatgacatttgataaatacatgattaagtgaatgaattaagctctcttcatcttagaaatcaaaactagaattatattatcaaacacctttatgtttgtttatataaaaataattttaatacattttataaattatgatactttaaagaatgtatgcattcctaggggtcctctgaatctctcaatgatttattaacttttatttcactttctataatccctaccataaatattcagtcacataccatctcacgcatacaggcataactggcatgtaaacttaggtaacttttcaccgaaacttttatgtgcagatgacagttctgattaaaggctatgatcaatatgtcctctgatatggacatatggttaaaatatcactgtgtagttttccctacagaaaagggtaataataaaaggatggtaataagatgaaaggtactctacaactctattagaaacaatagaaaaacaaagtcaatccaaaatcataggaggacaaaattacaaactattgtttttaaaataatgatctatcattttttagcacaatcttcaatttcaggtataagcttcaattcctatactcagaaattccaaaacgctgttatttaaattattaatgatttaacggaaattttataatactaaaacttaaagcttaaggtatcttggctaaatttttttgctaggtacattcattcaataattcattcagacatttaggtaataattaaatgactattaaagtcctactatattttgggtagtatgttagttcctatggtgacaatgagaagaaaaaagcagacacaattccgttttcatattactaatgccttgtgggaaccagacattaatcaataatcataaaattattatataactataaatagattttggagagaaaaatgagattccatgatagcatctgaggaaaaaaaattgacatgcttaagaagatttcactgagaaagtgatgtttaagctgatatgatagatgggtaggagtttagagactagcaaattaaagctaatagggaccaggattaatattaagaggttcttttttaaatgaatacataggtattcataggtagtaagagctgttgattagtaaattgttgggacaggaattaacgttgttacagtaataccttcaaaatagtttgttttcctaaattggcgagaaatcattctagaaatgctggccataggatctttgtgtttgacaaacccgtgttttgtaagacaaatttcagcaagttctttttccaattatcataaatttagaattatattttctgtcttcatccagtttcacactgctctaaagaactacctctgattgggtagtttatgaagaaaagaggattaattgacttaatagttccacaggctgtacaggaagcatgcctggggggcctcagaaaacttaaaggtgaaggggaagcaagcatggcttactatggaggagcaggagagagaaaatgaagagggaagtgctacacacttttaaccaaccagatctcggtgagaactcactcactatcatgagaacagcaagcgggaaatttgcacccatgatctgatcacctcccatcaagtccctcccccaacattggggattaaaatacaacatgagatttgggtggggacacagagcccaaccatatcagtgaaatcctaattgatgagactttagccacaatttaatgatataataaaactttctaaagataaaagtgtggttaggcatggtggctcatgcctgtaatcccagcactttaggaggtggaggcgggcagatcacaaggtcaggagatccagacaatcctggacaacatggtgaaaccctgtctctactaaaaatacaaaaattagctgggcatggtggtgcatgcctgtaatcccagctactcgggaggctgaggcaggagaatcgctagaaccaggtagttggaggttgcagtgagccaaaattgcaccggtgcactccaacctaggtaatggagtgagacgctttctcatggaaaaaaaaaaagtgactagaccacagtactatcttgtatactaaagaaatacagagttaaagagatgagattataattatattgcactaataaatggaaattcgtcatctttcctcctgcaaagtttaactaaaagacaaatatcttgttcaggaagaagcttgtcaagttttcattcctatcactgattatcctacaaacacacacacagacacaaaagtgagctaatttaagaaatcataaatttaaattactgagagttttgttataatgtttgaggtatatctaattttcactataaactgtaaatgctattataggagactcagaaaatgcaaaaagctagaaatttcagaagataaaattattcagaatcccatcactgcaaaatgagcactgtaaaaattttcatgtttgaattgtttttagtaataataattttcattctttaattgaatttttaattaatttcaaaaaacgtttatagctaatcaaactctctggtcattcagttttttgtactcttcagtaaagtccacagtaaaggctaatctgaatgctgacatcactgcctataactctctctgttgtggtttagccattttagctcccctttcaagaacagtaattccccctgaactaaatattgttaaccacagataaagaagtacaaaacaaagcctatgttgttttcctgtgaatccaaatgagaaataacgactttaaagcatttgatctatccctttaaaagatgtaacacattggagactataaatcttctccctataaatccaacagagcttttcttatccttcatcgttggaacagtttcttgtttgtttgttttgctttgttttgtttttatttcagttcagaaccatataaagtaactgaattggttttaggtcaaagctatgtattttttggtgtcatcaaatattagaatcactcagaatggcaagatgctcacatcctgagaagtaaacagggatggaagccaaccataactccaatctcactcagggtggtgagttcactaatcagcaagagcttatttaagtggaatagtgagagtacttgctcaataatttgataaaaatttcttttttaaatgaatgcatatggttaaatttgtgtaaattaagtatgtgtatattaactcacatttattgatgagattctactgtatttcatcccaactttcattagaatacatattctttctataatttaagaatttccatattgaaacctgcaaataatttgttctctgcttatattatccgaatgccctataaacctgtctgatacttaaattctgaatgaaacttctaggagatgtaagatgataatatccagaaaaataaagaggaaaaaggatgaaaacaacagaatgtgtcggtataaggacatgttacaaagtttttactgggtttagtctgtggttggtttatcattatattgcaaaaaactctcccataaactactaatgattgtaattcctattaaattgggctttcatattaaattgtttaaattagttctttactctgtaagcataatcataatccattgtcccccattagtcaatttctgctttgtaaaattaaatattctgaattttaacatgtgaggcattgaaatatacaatgcttttcacatacccaagacagaaagcctatgactaaacttatgaagaaacaaactatagagaaatagctgtgaaaaaatacttcttattgtgataaaaatatcaaatgatctgtttacagggagcaataaaaggcaccatttcaactttcaacataggttgttccttttcatttgtatttccaggaaagcgctgaaataaccaatagtcatccagtttaattattctttaaacttttttaatttaagctcaactatttgaatcatagcaagtttgtaagtttcacaaccaacgtcttaatattaaaaatgaagaacttaggcttagagagattgtatgaattatctcacatttttgcacttactcagtagcagcattagaacccaaactcaaatcttttccccgtcaagtattccattagaacactacagcatgttctattttgagtctctctaggctaagactacatagttcaagtgaaaattaataatgcataattaattatttgccaaacaggaggaatatttaaggttaacctttatcatgcaagcaacaattacttagataatacaaaatcaactgatttgacactttgattattataaatcacaaaacaaataaaaaactaggaatggctcccaggttggcccatagagggattattaagatccctacatgtattcataaaagtaatgcaataattttgatttttcttagctctttatgcttttcacactcaatattttactcttatagtgacttacaggcatcaggaaaatgcagaaattaattataagaagtgttaggacttgcctcaattctcctgctaatccatgtagaaggtcttcaacctcaggtctgagttcttatagaaatcaaaacttttataggagtccatgctttcctgacaacagacaaacattccaggggttccttgagacaaagccatgtacacaatgcaggtcccagtttcttggacttctttctattatcactaatatatatagccatagagtaattttaacttacaaacttttgctccctccaacttacaatcttttgctccctcctggtaatctctctctctctctctctctctctctctctctctctcactgtccactagccttggaagaaaccaactgtcatgtcataaggacactcaagcagccctacagacaggactttgtggtcagaaactgagacttcctaccaagaaccataggattaatccattttggaaacagattattctttagatgaccactgacctggtcaatatcttcactgcaacctacaagaggctctgaactagaagcacccagtaaagcaggtcccaaattcctgacccacagaaatagtgagataaatgtttgttgttttaagctgctaagtctgtggtaatttgttatatgacaatagatagcaaacacccactatgagaaatccaggttaactactgaatctgtttcttcaccgttacaatgagataatagagatataaatatctaacatatcgcattgttgtaaagataaagaatataaaaaacactgtccctagaagacagtaaaagctcaatgaatgtcattttttatttttctattaatattataactatcattatcaatctcagaagtttgccatgtttcataatcttttgctggctcatgtttacttcattagctgagcaagtgaaattcatacactaaaataaatacagataattgaaattaattatagagaacagtacaataaacgtattataagaaaacactaagaatattttcatagctttggggtagaaaaatgttccttggcataatccaaggtaaagaccctcaaaaagttgagagatatgactacataaaaattgaaaacatctttagagtaaataattccatataaaagttagaagtcaaatgccaaaagggtgaaaatattttatatatgtcaaaaagtgagtatctttaaaatacagtcttacaaaataatgagagatacatataagcatgtatgggagtgtgtaaaacattttttacagcagaataaaacaaaaacatgcaagtaagtgaatggaaatttcacagtagttcaaatgactagtaaacatataaagagatgctcaaaaaataaaggaaatacaaaatgaaaaagtcatgggtatcactttttaccttggcttagactgaaaatgtttattatcgatgagagggtagagaaactagcacaaccctgtgagaggtaaagaattcttgaagagtattctggcaatatgtatcataaccttatatgtgctccctcatgcccctgcaacctggcaatgattttatcctaaagaaataatcataaaagtcacacatgatttgcaaagagtcatggacactgatacacataaatacttgaaaaacaagcatctttcatatttttgcattttaacaagttagcttatagaataatatgtattatatgttgccatttttgtattttaaaaagtgtcttctcttcaaaagttattttaaaaataccgaactatactaatgattgcgtgagggtatgtggatagcatcaggaggatcttctgtttatatccagaaaataataaaccataaagctacctagttgtttaatagtcaaatcttaccatctcaattttatggtacaccatttatgtaagtggttatccatatttcattatagggtgtttgggcttaatatgagaaaaggaagagcaaagaagtagaataaggaataatgtactctctttatttaaccagaaaatatggattgagatgtagctacttaacaataacaggtttgtgtctaatgagagcctcaaggagttggagtcattctgttgtagcacatatctattccagaatatatgtgcttgtataaattctgttgagaataaaaataatctacatactctaattacttaaacataattttcaaaattattatagagtcaaaacagttaaccccttttcattatccttctgtcttctctaacacctctggtggatgagctgctattgcaactgtcattgcaattattgattgcaatttttgtcattgcatttattgatataagaaagtttaaatccattaactttaacttcgtatttcttttctgtcccatgtgttctttatttttttttctctttgtctgcctttttttgaaatagttgagtattcaatgttccattttatctctattttggccttactgttatatctctttattttgtaatgattattgtagggtttacaatatgtaacttttaacttatcaaggctaccttgaaataataatataccacttcatatataatatcaaaccatttcaacaacacacttctatttccctgctccaattatttatgtaatttatgtcaaacatcttactactatataacccacaatacattgttaattattttgctgcaaagtgttaccttttaaataaaattttaaaagaaaaaagtgtgttatatttactcatatatttaccatttctggtactcctctttactttgtgttattacaaatttccatcttatttggtatcattttccttcttcctgaagaacctccattaacacatcttgtagtgcttgtctgtgggtgatgatttctctttcagcttttatgtccccaaaagtctttattttatagaattctaggttgactctttttatctttcagcattttaaagatgtctatattagtccgttctcatgctgctaataaagatatactcaagactgggtaatttataaaagaaaaaatttaattgactcacagttcagcacagctggggtggcctcaggaaacttacaatcatgatggaagaggaggcaaacacatccttcttcacatggcagcagcaagaagtgctgagcaaaagggggaaaagccccttataaaaccatcagatcttgtgagaactcactcattatcatgagaacagcatgaggtaaccactcccgtgattaaattacctcccaccgggtccctcccacaacacggggattatgggaactacaattcccgatgagatttgggtggggacatagccaaacatatcaatgaaattctaagtcttctagtttatattgtttctgacaagaagtatttaatatttgtgtcttcctcctgtacataatgcctccatttcctgtctctttctgggattttcttgttatcaattgttttcaacaattttagtatcatgtgtcttgatgccatttccttcatttttctcctcttacttatagttgaaatctctagatctttgtaaatacagttttagtcaaatttgaaatattttcagtggccaggcatggtgggtcatgcctctaatcacagcactttgggaggctgaggcaggcagatcacttgaggtcaggagtttgagaccagcctggccaacatggcaaaaccctgtctctactagaaatacaaaaattagccgggcaaggtgggggttgcttgtagtcccagctactcaggaggttgaggcaggagaatcacttgaacccaggaggcagaggttgcagtaagccacgatgtgccactgcactccagcctgggcaacagagcaagactccatatatatatatttcagcctttgattgtccaagtaatttttcttccttccttccccacctcctttttaggactaacatacaggttaaactgcttcatagtgtcccataaatctctgaggttatatttgtgtgtctgtttcaatcttttttctcagattgtgtgtgtgcttcagattggatagtttctattgctatgtcttcacattcactaatcctttttctgtagtatctaatatcctgttataccataccaatgtagtaaattttttcattccaaatatatttttcatctctaaaagttccatttagttcccttttatgccactcatttctctcctgatcatagtcaagctttcctttaaatccttgatcacatttataataatggttacaaaatatttttcttctaattccgtcatctctgccatttctgaacgttttttcattggtaatttttttcccagttacatgtcacattttccagctttttcatgtaacataaattttattttgatgtcattcatcataaactttttgttgttgactgctgaattttgttgaacttcacaaagtattagacatttttctggcaggctggttaatagcttgcagatcagtttggtccttttgagtcttattcttaagctctattagggcaggcttgttaggccctactgaaaaagaattatcctttttgggatctcatttccctggctattaacaaagtgtctccactttggctgaacaaaactcaaacacttccaatccgcgaaagctccaggagtggttcaccttttcagctctctggttgttctttgccggccttctggaggtttacccaaagtatgcacagtttaatattcagcattcaataggctcaaggcaatccttttgcagatttccaaagttccttgtctgcatatctcccttcctccggtattctacctgcaaattctactgcctcatctccctgaatttcaatttctatctcctaatctcagtgtgatcactgtgctctgtttaggtttcccttctgtacattatgatcaggaaagtacatccaagcataaaattttttctatgcaacagaagaagatattatttttaagtgtatacctctccctattatgtcatacaaatttcagggcttattttcaagaaccatgtcttttatatggtatctggttatgttgttactattttgaaataaaatacaggaattgaatttattcagtgtttcatctttgaataacctgaaaattgtatagtaattccttatcttctcacccaaaccactgatatataaaatactatttaagacgacaagatcaaacaaggtcacttactatcttcctttgggcatacctatattttagccatgcttaactttgtatcattactcaaacaacctcttttaacacccatcttcttgattctatttttaagagaatgagatctatggtaaactgtctaagttcaaatcctgacccaactagtttataaagcaagttatacttaaagcatctttgacttcatattatcatgtccatgtagaaataataatatagtctacctcaaaatgattatgaagaataaaagaaacaatatacagtcaatgaatgtgagctaatgttatcacttgcaaaccttttccctatttctttatatgcaaaccctatccgtaattccatttcagttaaaatgccatctctacaggaaggctttcccgggatccatgctgagaggattctttcttaagatactcatcacagggcatttatgtgatttatatttttcttcttagcttctatactaagcaattaagttcttgaaaggagcttccatgttttactctctcttttttcaaaaagatatcccacagtggacagtaaattgctttgtatttagtaggctattcacaaatacttgcctcagaaaagaaaattaaacatgactatatgggggaagtttttcaaataacttatgaatctccctaaatctactgccatcattttatcaaatcccttgtttacaccaagatacatatgtttgcaaaattttcttagctaacaacccagttaactttatcagaaaaggagaaatgagattagtatgacatgacttgttcttggtaaaataacaccttggtttctacatggtcacaaataatctattcaatatttcagaattttgcaggagataaagttaactctgtaggttagagaattcacctttatttcatctttaatattttatatgtttgcttgtatccattattttatatcttccgattctccaaatatgatcatttctggaagttatgatgttcagtcaaagaaagtttagactttggagcaaaagtccttaggtttggattccagttgttctgatagacagcagtgtggcttgaaaaagatatatttactttcagttaacacatctataaatggagataataaaattttcttggagcatggtgattattaaatgagaataagtgaaaaggtatgacctactgcctactgctaaaaactttttatttgcttccttttggtttcctcacctgcaaaatgcaaatagtcatccctgtttacttttcaggattcccttaaggattcagtgaatacatacattgtgatactttgaaaaacacacattatataaatatgcaagtttttaaaaaaattatggtcattattattcttgaataaaagttaccaaactctgtggacttagattgtaaatttgccaaaatagtctcctattaaccaatttattgatttccattcatttcttctaatttgaagattattcttcttggaaagaaaaatataggcaaaatatttgttcatcatctctgccttctctgtgtcatctctgaaaattatgtcatattctcccaagtaatgcctctatctattcagtctgaggtgacttttcaaatctcttctaaaagtttacgattttacaagagtaaattagagtgttcttgtacacacacacaagagaccaaaaaaaatcagaacacattttcacaaacagctgaaactatttaatatgggtatccttaaaaacaataaaatattatgaacagtaaaagtcaattatttattttatgacagaaatatttcagtgtgattatatctgagtatatcttcaattttttttgttcaggcagcaagcattggtcctttttaccaaccactacaaattatgcaccctaaacattatgcactctatgctataaaatgacaatataaaaatataatccaatctacattaattgaacataaagtacattctgatactcagcttagactaaccataacacagaatttgtcattaaacgttcagttcacacacatacactcaaaactgatccaacaactcctattatgccagttaccagcattgccagcccctttgcccttcactgcctggagaacgtccatcagaaacagggaagcagagcaaactgccacaatgcaccattgatgtttgagcaaggctgcctaagcagctgcaataacagggcaactcttcaaagtgtcagcattgaaacttacaattctctctcccatacactatcaatgaaaacctttataagctacaatcaattataaaataaatctttgagacaaatcatgttctttcttcatttcttctctccttcttttcctcccaaaaccaaatgtccttggttaaaagaaaaattcaaggagaaatatcccccctttctatcttggtctctgcctctgcctctcttatgtctaaaaattctctcaaggaggtttaaggatatctgctaaacacttttgtttacaagacaagttctggggttttttgtttgtttgctgttgggtttttattgttggaatgtttttattttaaaaattcaaaaggcacttgatattttgagcacactcatactagatttttggcaaagcatgtttttgattattaaaagacaatctaaattctgaaatgcatgcaccaaatcacataacctccatatttttgtaaaccacaacaaaagtgcctcatattagctacagatgaatagctaatgagtcagcaaacagttaaaaacattccatgagaatagatgcactagccatgcaaagtttttgagggaaaaatatattaagtatttaaaaactacttagaatgaagggaaactattctttctttaacaaagcaactatgtttaatttgtcttatgattatacctaccaaaccaaatgaaagtttatctgtctttttctatttctccttagccatcaatagttaatgcctttttaaattttgtaacatatatttaaggtctcagaattgtagcaacaacttttagattcttcatcattgtttttatcattcaaacagcatgcgaaaaccccttcaaatataatgtcaaggtataactctaattcctgcagataacaaaaatatatacacttcatcatgagttaatctactacctgaacaatcaaagtccaaaatacttggtatctgagttcagggtgcaataataataaattgccatagacttggttaaacaacagaatttaacaacaaaaatgtatttctcacagttctgagggctgagaagtctgagattagaatgccagcatgaccaggttttgatgaatgcctttgtcctggtttgcatatagtagtcttctcactgcgtcctcacatgatggagggccaagagacagagtggaagcaagcttctataagggcactattcccatcttgagggccccaccttcatggcctaattacctaccaaaggccccatgtacaaatgccatcacattaaagattaggttttcaatatatgaattttgaggtgacacaaacattcagctcatagcatttagaaatctgtaagaatttttagttatcatttctcattattgtcaaagcaacacacacacacacacacacacacacacacaaacacacacacacagtttaccagttaaatagtaccacaaagtttatacaaaatacagcatcccgtatccaaaactttgaccctctgccaaaactcattctagtgtttgcctgatttctaaataatatgcttctattgttatttttatttataaattttagacataatatattaacttcctatcatggcagaagacttagttctttgatactacctcatttccctttcttccatccttccagtaatcagtgaagtaatatttttgaatacatttggtaccttgagtagtaacaatatttccttcctattgttaatattgtcactttgccccccacattcccaaggtttgcaacagaaatgtaaaacctctataaatataatatttcacactcttacacatgaagaatcctattctaattctttcccctgaagacatccctttcgggagttctccatcttctagctcaagtaaagactgcttatttttaagatcaatgcacagaagttatccagtaacttcccttcacctttctcacctcattttaatcacctgtttcctgaaccctctatcttggtcttttctcctcagtttttcctcacttggacgtagcatacccttgaaacaattccggagaaagcaagtgtgggggtacatttggagaaccatgtgtctaaaaataaaaatgttttttctacccttatacgtaattggtagtttgggtgtagaattcaaagttaaaagtaattttctctcataattctttttttttttttttttttttttttgagacggaatttcgctctcgtttcccaggctggagtgcaatggcaaaatcttggctcactgcaacctccgcctcccgggttcaagtgattctcctgcctcagcctcccaagtagctaggattacaggcatgtgccaacacacccagctagttttaaattttttagagatgaggtttcaccatgttggtcaggctggtctcgagctcctgacctcaggtgatccacctgcctcagcctcccaaagtgttgggattacttacaggcgtgagccaccgtgcccggccttctctctgaattttaaagccacatcttctagctttgaatgttgtcattaagaaatcagataccattctggttcttgagccaatgtatgaggcctatatttctctcgggaactttctattatcatctatttattactgttattttgaaattttccaattatgcatcttggtgtggaattgctttcacatttttatgggcactcagaagatccttccaaactggaacctttggggctgaaaaattttaccatatacttttataacagtttcctccctatcattttctttgctctcgcctgccttctgaacttcccattaatcagatgttcagcttgttggatcgtttgtttgatttttatctcttctctcctattttccatttatttgacttttttttgctctattttcaggaaaatttctatcatataaaagcttatttcagttattataaaagtgcttattctctggttatttcttctttttatataatcttgtcatgtttcatagtagcagtatcttctgctatctctctgagtatattaattatactttatttctacttcagctactgttttctacaggacatactgcctctaattcttaaacaggttctggagtatgaactgtcttgtttctcattgacacaacactctccagtcacatgtattcggctttcccatttctgccagttcctcctttacatcttccaaaagttgtgtctctttaatatgttgcttcctcttccttatgcctgtggatttatatattttttagtcttttgctcaaaatttttagtcccttactaggaaggaacatggaaaaacatgtgttcaatcacgaagtttaactggaagtctgctgttaaatttcctgaagatgttaatcctagagctataatcatgctattcacagggtcataaaatcatagggctcttactataaaaaggttatcagagatcatccgattcaaccctcttattttataaaagtgagaaaatggaaacccaaagaggttaagtggtttgtgcaaggttatttaaatagcaatccatacatttggtatttgacttgctttcattaccatagtgcctcctcaaatagatatccccttaaagtagtgactcagaagactcccagacacatcctagggttaacacatttgaataagccaatctagcttttggatataaaatggaggagagctgtcattaaagaaaatctgggaaaaaatgtctccaagaataaatatttgactctggacatcctgttttctactagtagaaattccctaatcaatactctcccatgaaactcattccccttattcagcttcagcataacacacttatcctaacttttactctttcaggttacagaatcacatcatattttctcaaagcaaggtaaatctgtgtttgaaattcaaatgaatcttttatatctttcctaagtttctaccctcaattccttcctgacctctggctggccaccaacctcctactcctaaaatagtccttttttttttctgcaaatggcaccacccaggtactcgagaaaaacatcttgagagtcatcctaaacttctctttttctttaacagcatccaacttccaccccttcaccgatacagtacccaaatcttatcaattctacttcctaaaaatcccttgaatccattcctcttaggttcctcatagcttcacagtcactgtttcagttcatgccctcactatacttcaccctgatttccattaattgtcttctaacagtctcacagactctggtctgctttcttcataccccttcttccacactcaattgctgaagtgctttttctcaatagaactaagaagtcatttcctcacttaaaacccttcagaggatcccacctcatttctgacttcttagtatagcatatataaggcacttcatgataggcacctacttatccctccatcttcatctcctgtggctcttcaccttgcatgttatggaactagaaatcagaaaatcaaaagtctcctctcgggtttctattcacactggattttcaacaccaaatgccaaatgtcccttcccctgtcttctcccaaataaaggaatccaacaaaagagagtgaaaagattaaaaaccagttaaaaccatttaaaattattaaagtgcttttaccataatattttacatttatatttataatattttatctttatcttttagggattatagtctgtttaaatatgttggtagtacattaaattattattcagaacactgaagatgtaaattaaatatgaccataacaataataattagactcttatcatgtgaaataattaaggaattaacacattattatagtaagggccaaatctaagaaatgtactataccataccaccagactgcacacttttagtagacaggactgtgtcttaatcatctttacattccctactatgccaaatactatccccaacataatagatgcacagtgaattagtaaatgattaaataaaattagaaataatatcacacccacaaacccgggaagcaattatttgcctactacttgatgaggccaataattcaatgatatttattattatagttgatcgagttagtcaaatgtcatgagtgcctcttaaaaaatttatatatatacacacatttttctgcagatctttatacggaacatcaatctaatctttatttgggcatataaatcattcaatggataacacagtgaaaattttcaacataacagaaagacatatgctatttgaaaaatcagtaaaaaaaaaaaaaaagatgattctattgttggtattcttatcttcagattgtcctccacagcacatccctctgatacagagaaataaaaactttcttacctagaactctgatcaagttactgccttttataccactataatgatattcaaactggcttctaagcaaaatagaacagaaacattgcacatgcacatgcacttgaattgtacacttcttctatcgtatcaacttcatgtaccatgatatgctcgccattaatatgcactaaagctaacttgctagcctgccgcaattttattgttgcagcaaaacaatagtggtggattaacccatcacctcaagtttagcaatacatcctggaccagttatagatatgcattaatccacaacttaaaatgtaaaatatcaaggagctgggccaatccaggcatatgagtcaagaacacagcacttcaaacatatccaaactgaaactggttcttttctctgcctagaaaggtacttaacaatgggttctgaatatcatgttgactgacaggtatgtcatataaagaaggaaatcctcttaaatcttacctccttaaaaatatcaggtttaacagaagagtatgatgtgtagatccctactagatagaagcctgaatacctaacccattatataaatagtatgtattgtatagtatataaaggctgcgattttctgggctgctgcctactttttatgttttactgttgtcttcatgtaaaataactgtatggaaatggtatacctaaagagacaaaacgggtgaaatttaaatcaaccaactaaagaataaacagtataggttaaaaaggatacatgttaacaaaatgatgacacacagcagaataaagaaaatatatgaagaatacacatctgagggcaaaaggctgaggacagttgaaattgatagaatttgtaatgactgaaataaaagcacaagaaagagtagagaagaaacttgaataatattcatagataggaatgaactgtggaaattccaatgccatgataaggcacgatatagaatgattgtatttcttttatccaaaagcttcacgacaggtaaagatagactataatctgaagaacaaatagacctaatttccattataggccccgaaagtgaccaatagtgatacttataatatttaagaaagcaactgggcacttaactttagattataccatttaaatttttttcaacttgggaaaatgtttcaaattccactttgctacctacttgctttattttttaaaaaattagaaaaatgccatgtaaatcactgtagatagtattgcattgcttgtttgaaaaaaaaaaaagttgacagtttgatagtgcattcattcttatgcctccagcactgaatcaaccactataacattcaaaccaagaggaaactttcagcagtcttgatgctgtctcctactctgaagtgtgagtctcttttctacaaagagcacatgcttagggaggaaaacaggatatgaaattacacaaaaatatgtgccccagcattcagaaagaaagcaggtaaaagcttaattctcctccaaaaaaagcagtttctaaatgtggattcattaatgaaaacttacaacctagcagtcagcagaagcatttaggaatggaaggcatacagtacaatgccaactattagaatcagtgttctactaccacacaactattctagcttagctaacagtcttttttgtcacgacttttgtttctttttcctttgtttcctctgttttcaatcgggagagaactgtgtgaagctgagtgttcgtttaagtcagaaacacgttggctagatctaggttcagtgtgggtgagtactgtgtaagcattccacacacctccactaatatgccacgaactctccatatcccaagctttctgataggattcagttgagactacacatagcgcttttacttatgtcacacatgtgatctcaggtctcagcacgtactgacataggtagttaccatcaaacttgctcttctcataaatcctgagaaaaaaaggtaggttggaggtagaaaatggacagaatgtctctgctaacctaaacagaactagtatgtgttgctgctaaaatattccaatagctggcagcaatgatccataacattatatttgtaatataagtatacataaacactacaacagatgatctcagattgtcattgataatgatgatggctaactttttttagtatgttacttgtaccaagcattgctctatgtactatacatctcatttaatcctcatatacaaaaaaaaaaaaatattcttgggtaaagttattttcattttcattttacacaaaaggacattgagatacagaaagaaactgaataaattgattttaacatatttaacttatttaaagttaaaacatgaaattatttactaaccctttgatgtaggaccaatggctgtcactgactcttgatctgctatataaagtttcatgttttccttcttgcttaaactacaccatgatgtatcacctatgatttcctgttttggtttatttaaactcaatgacagcttaaaggtacttggaaagcaaactgaatgagggatccttccagctttttacattttttcacccctacctcaggcaatctttcacagttgtctagcccacacctttttaaactgcaatttgttttagcaactcacctttaaaaagtctttccaaagcaccaacttaaatttcataaaatcaacaactctttatatttttgaactcatattttatcagtttgcataattaaattacaattgcacattcatttggcataaacaaattcaaaaacaaacacaaatgactgtagataagcatggcagcaggtaaacagatgaacagaaacacaccattttttcagagtattctgttggccagaagcaggaataacctaagagggagtctactgtatacctaccatttcctaattataaacaatactatttaataggtatattagctttctggaagaatggatttaccatggaaaaatacaaacaaatttagcagggaggttcacaatgataccaaaattctacactagaaaagtaatacattccttcttatctttctttaattagaaattgtaggagacttcttcactgacaaaaactaagagcacaaaattccaccccaaactcaattcagcataagaagactcctacccaaagcataaacatatatactcacataaaaaataaaaaaaacttttaaaattaataaagaaattaaggttttaagaaagaaactttctccctactagagaaaaccatcacctcttggtggggaaaactgaatttaaagttcaggttcgggcagttactacttatgtgatggagtaaatcaattcacctcactgagctatagtatccttttctgaaaaaaaaaagataataataatggttctctcctcacaaaactgtagtcagaattatataaaataaaatatataaagacactctgcaaactatcaatcatcttatacatataaattgttattactggaaatcctagcttatattttggacagagaatttcagagtcaagggaagtcatttcacaaatgacaaggctgtgattcaaaagcctaaattactttcctacttacagtggcatggatgacggagcagaaatagagaattcttgattaaccaggagaagaatatcataggcatgggtgtgagatcaactggagattcaaggaagctaaagtgcccagaatgaactaatgttgtaatgtagactgtgagcagagataaaattccagaagccaaggagtgttgtacggtaagtcctggcagtgcctttggtgaggagagtaaagaagaaatagaaagattagccaaaaaaaatttcaactataccaaattagtattccatcctgcacagtaaaattttgatgcctttacaaactaaacaaagtagggaatttaagataattcccatgtttatgctgtttctttccactggtcagaataattaaccataggttaggaagttaagaaaacaataggatagacgtcagtgaagttcaagtgctttaattggattcctttgggtacagtttgtttccctttttctctgaccattaatccagcagaggaaagtgatctaacacagcaccatgacatgaagggacggaccctgagagcctgtctctctatgatgactgttcttgtgcatccaggcagcctattgaaactaacaatgcctgctgctgctgccgaagaggatcatccaaactctgaaaatgaaacacatcacacaaagggatgaaagaattcttattccacagggtttagcttgcagctggtcatgcatgccagagggatgtgccacgaggatgacaaagaagcttccaaagagaatggaaggggcagccagccggacattttgaaatacttagaaaactattcttttgaaactaaggcaataaactagacttctttatggcagaacttgagaaatatcagggtttatttcttttatctctgcaattcacccacatttaaacattcttgcgagtaaaagaaatttgaataatttctaattggttatacagttttgagggtttcccattcataagagaccatattatataattgattattttttcctccgagttgaagctctatatcaccccagagtttaaaactgtatggaagaataggtattgggcttttctgtaactgatgtagatacaatgaataataaatatgcttgttataccaagtagcatgctggttaagatcacagactttgaggtctcagtgatgtaactgacggaatactcattgcatggcatcaggtctcatgggttctaaggatctcgaatagctgtgtcaggtaagagtttgcccacaggaagtgctccaaatagaattaagagtcataagaacctgccatacagctgccattgctcttggcccctcagttggtcacagcaacgcataatccaactcttaagctgccttggatatccatgtttaaagagggtcaaaagcagcacctaaagttttgaaagacaatgctgcactggggcatcggccttttctgattaagttcactcattcatagcaatctaaaaagaacactggctctccctctctggcccttctccactactgttccaaaaagctcaccttcctctgtttacaggataaacgtgaaaggctcttttcattgcccttaacagtacacacaatagacttggcaatcatttctaccaattacatcaatgactcatatgaactctgcataaccagatgcgtgactttgtggaagttatttaatctcatttagccttagattcctcattggtcaaatgaaaataatatctgtcttatgagattgttgtgaagaataataagataatatttacctcacagtttagttataagcacaaggggtgattcaataaatgtcagtcattatcagtgtcattttctataacaggagtaacaaatagttcatgtaagaaactgaaatgagaactggaacacagtatcaaaaatattcccctatcctgtcaggatgctgtcattgattcaaacattctgtcatttatttcaggttagaacacagtttaagaaaagcattgcttcctcaaaagattatgtcaaagtgaaaataactaattgggagaaatatttcttttccatgtattcaacttgtttgttctaaataatctacttcaaactactgtaaataagttcttgttaaaagtgttttaacttttcaaatggctactaatatacgatgttttacagataaatctttggcattggagggtttccctaattgttctgatatttcttattcccgactcctaccatccacttgctcagaagctcttccaacctctctcaaaaagagaaaataatttgaatgaaaactcatactacaaaagcaacgttaaaatatatttgagaaaaaatgactctcaccctaggtcatgctacaagtgctgtaccattcaatggcacaaaattaacttttagctctaagttcattaccaaagaattctaaagactaaagaaagcatagggaaattaaaaatatttataactataaacaaagataagagattataatgagaaaaaattgtatataaggagatatttataatataattaaaaattaaccgtatacaataaaatttaactcaaaataaacctttccctaagaattataaaatattttaaattcaaacttaattctagtaaactaaataaatccctaccattaattactactttgcattatgaaactttgctcccaaaattttatgctaaaatcttccacataagttctgaagaccaaaaaaatccctactatttcattctaaaacaattggtccataattagtgaaaatctaagtcatttttctcacctttcctttcagcaatgcccatccaatcaatcactagatcctgtcaattctttatttccactattatagcctagaatcctaaataatctaattattttcagcctcttacctctttcatccatatttatgcttcaagaattaccttctattaaaaagaaaggctcaaagaatttccctcacctcctcaaaaaccttagattgtttacagaataaaatgtatctctaagcatagcattcagtctttcacagtgtggcacagaactacaattaacagtaattaaataaatgtaaaaggtattcattaactgcctgataggttccagactccaaacttgatagtgggttggtagtggtgacaaagatgagctcaacacagtacctgttctcaaagaagccagtttagtaaggaagcaggtaagtaaactaaaacttgtactgccatttagttagtacaaaaaaggtaactaactacactgtgctactagaattagacagtaagtcccaactcattgaaaagtaaaatagaaatatgttggttttctgcttctgaaaatgatgaagtaacagaaatagcatacacctcctgccttaaacaactaaaaatctaaacaaaatatataaaatatttgcttgcagacattgcacaacaggcacagcacagcaattgctgagaaaaggaaattaacaaggttattcctgctattgctgtagtatgctgtcttgagagagttatcagaccatgactcagggaggtagaatcctaacagagattgttttatctagggtcacactaatagtgaggagtggagctgggcctctgataggaacctttctgactgcaaagtccccagaagttttaatttttactcacctctacctttttattttttcttttacactatagaaatcatacttcaaaatttaaatactaatgcattcagtgaatctccccgatcccaactgttcccagtcacagtaaagatattaccatcctctaaatactgtattactttgtgtttacggttatataacattaactttcctgctatatttaataataattttaatgtgaattaacatttattgaagccttactacattattttatgttagtaagaacacttaaaatgagatctaccctcttagcaaatcttaatagtacaatatttttaagtgtgcagtattgttgactacaggtacaatgctatacagaagatctctagaacttattcatctgcttaactgaaactttatgtccattaattagtaacttcccattttccctttccttcagcccttggcaaccaccatcattctattccttgattctatgaatttaattattttagatacttcatataagtggaatcatgtagtatctgtctttctatgactggctcatttcaattagcacagtgtcctcaagttttagccatgttgtctcattgcagtatttcctcttttttaaagactgaataatattccactgtgtatatataccattttccttatccattcatccatagaaggacatttaggttgtttccacatcttggtcattgctaatctttttgagatcccgatttcaattcctttagataaacaacaaagtaccaacagaagtaaagtacatcaacatgataagcacatatatgaaaaggctacatatcagttttcaatggaaaaaactgaaagctattcctctaaaatcagcaacacagcaaggatgttcactctcggcacttctattctacatagtactggaagtcttacccagggcaattaggaaagaaaaagaaacaaaagccattcaaattgtaaaggaaaaagtaaaattgtctagttggtagagtctatgcttttatatacagaaaatcctaaagactccattaaaaaactgttagaattaataaatgaattcaatagagttgtaggacacaaaatcaacagacaaaatcagctgcatttctatatattaacaaggaaccatctgaaaaaaaattggaaaaacattcccatctaaaatagcaccaagaagtataaaataggaagacaattaaggagattaaagattatatactgaaaactacaaaacattgatgaaagaaattcaagatggaagatatcctgtgttcatggattggaagactttaatattgttaaaatgtccatacccaaagtgatctatagagtcaattctacatttctgtaattcacatggaaccacaaataccatgaatagccaaatcgatcttgagaaagaaaaacaaagattgaggcatcacattttattgcttcaaaatatattacaaaacaaaaataatcaaaacaatatggttctggcataaagatagatatatagacaaatgaaacaaaatatagagccaagaaataaatctacacataaatggtcaactaattttttacaagggtgtcaagaatacacaatgagaaaaggatagtctcgtcaacaaatggttctgggaaaaacagcaaaataataaaattggacctttatcttacaacatacacaaaaataaactcaacatcgattaaagacttaaatgtaagacctgaaactaaaacttttagaataaaacatacaggaaaagcttcataacattcatcatagtaataatttcatggctgtaacatcaaaagtacaggcaacaaaaataaaaataaacaggtaagactatacatcttgactgcacagcaaacaacatagtgaaaaggcaacctatggaatagaagaaaatatctacaaaccttatatctcagtgattcccaacctttctggcaccaggaactggttttgtggaagacaatttatccaaggacaggaggatggttttgggatgaaactgttccctctcagatcctcaagcattagttagagccttataagaagtccacaatctagatcccttgcatgcacagttcgcaatagggttcacactcccatgagaatctcatgccactgctgatctgactggatgcagagctcaggcggtaatgctcactggccggacactcacctcctgctgggcagtccagttcctaacaggccagggaccattactggtctgcagcctggggcgtggcgagcaggggtgaattccctgatatatctgataaggggttaatatccaaaatacatgaagaactcctataatttaagagcaaaaagaaaaaaaaaactaataatccaacttttaataatgcactaaggaatttgctaaggtctgaatattacccctcccccaaattcatacgttgaaacttaattgcaatgtgatagtattaagaagcagggcttttaggaggtgattaaatcatgaaggcagatcactcatgaatgggactagtaattttaaaaagagatgatgagctgtttgcccttccacaatgtgtgggcacagaggccaccatctatgaagaagaggcccttaccagatacaaaaactgccagtgccttgaccttggactttccagcctccagaactacgagtaataaatttctgttgttcataaattaccctgtatttccttagagcagcccagactaagagacacttgaataaagatttatttaaagtagacatacaaatggccaagagatatatttaaaaatatttaacatcacttatcatcatcagagtaattcaaattacaaccacaatgaggaattgcctcacacctgtcagggctgttattaataaaacaaaagacaagtgttgatgaggatgtagagaaatttgaatccttgtacactgttggtaggaatgcaaaatggtgaagcactatggaagatagtctgaagtttcctcaaaaaattaaaaatagaactgttatacaattcagaattctcacttttaggtatttatcaaaagaaactaaaattagtatcttgaaaagagcttaccacggtatttctctaaatgatgcacttgtaccaaatcatttaatcctcaggacaacccaataggtactacttttagcctcaatttgtagataaggaaactgaaacccaggctaaataacttgcctgaagtgaaataactagtgagtttcagagcaggaattcaaaacagaaaatctggctccaaagtccatgcacataacctcattgcttccctatctgaatcacctaatagacttcttaaatatagagacaattcatataactaatcttgttatttgtatatctcacactatctagaacaacgtgttattgctaatagatattctatgttgtttttgatatgaatgaatgaataaaagagcaatatgaagctatggaggaataatcacactgagtgctaagccagaactctggtaaaccataaactatatataaagtgtgcctaaaattctttatgagaaattattcttcatcctcacaactcctcagaaattttatccacaagtaactaaagttttcacatgtttcactcataggatcttcactcttagctaacttcaatattggaaaattacagacgattattttatgtctattcttaatgaccattatggcacatatttcatacattttagtctaagtatagaacaacattatcagtaagaatatgtgtgtgtgtgtgtgtgtatatatatatatatatatatatatatgaagagtgagagagagagtggggtagatgatatgggggttgaggtagttgggaatgaagaaaccagcaatggtaataacaagataatagaaatgaaaacaactaacattttctcaaacacctatcaagagctcggcaccttattaggtcttttatgttaatcatctcacctggtcctcacaacaaccatgaggtaaaaaaaagttgaaccctgaaattttgatattccttttctttaacaatagattgtatcaagtgaattaaaagaatgtaaagtgaataaccattttattagagttgaagcttaaaagttattggactgctataatacatgaactacatttttttcaattagcgttttcaccaactttataaaaaaagttatataaagggctgacaatcactattattctgtttatactgataccatcatgagttcacatatgtttaatatttattccacataaacttatttacaagttagtacactgttcactaagaaaatatggtaaagttgtcagattcttgaggtagggcacaataacaagtgctagaatcaacacactgtatgaattgccttgaataatcactctagatgttcaagaagtttccacttactctccagggctaatgagtattacatgcaataatcataattaaaacagaagtaatggaaatatgtgcgcatagctacaaaatatcataatctcagaattaatcttcagttcctcaagtctttcttatttatttatttatttatttatttagagacagagtctccctctgtcacccaggctggagtgcagtggtgcaatctcagctcactgcatcctccgcctcctgggttcaagcgattctcctgcctcagcctcctgagtagctggaattgcagttgcctgccaccacacccaggtaatttttgtattattggtagagatggggtttcaccatgttgtccagtccaggctggtctcgaactcctgacctcaagtgatccacccaccttggcctcccaaagtgcagggattacaagtgtgagccactgcgccctgcccctagagtcttaaatcacaaatgtttatcaagaagtttaagttctgttcattaatttaattcactccattcttcgtaaaaaccctgatatgctaaaccttcaataattcaattgcatattatccatactttaaaaataattgctcaagtgacatattgcattacattacattacattattaatggatactagaaatagagtgcctacaatgtgctggggaaaatattaggtgtttacgatatgatcttatttattctccatcattctagtttggctttcttatctgcattttacagatgaggaaaatagctcagtgttacaaactgaatgttcatgcccaaatttatatgttgaaactatacccccaatgtaatgccactagcagatggggcttttgagaggtaactgggattagataaagtcatgaggtttatgggattagtactcttataaaagagacccccaagagctagcttgatctctttctaccagaaacacaatgaagagttagcagtctgcagcccagaagaaggtcttcaccagaactcaaccgtgctggcactctgatcttggacttccagcctccagaactgtgaggttacagcagcccaaattgactaagacactcagaataagctgtccatggtcttacaaagatcaaacattgtactagaaggggaactcaaatccaccttgggctaccacaaacaataagaaaattttgcaaaataggagactataaagttaacatacaaaaatcaacagccttcctacacagaaacaaatgccagctagaaaatatagaagaaaagagcctgtttagtatagtaaggctgtaagaaagtaagcaagtaaataaataagtggatgcaataccaaaaggcagacttaataataaatgtttaaacctaaagccaaaaggaaaattagaacatttcagcaagatacaacagttactgagcaaatggaaataaaaaacagattcttggataaaaagattcaccctcataagaacattaattgttgtgatgttaattcataaattccttataatttcaatagaaatgccatcagggattttctttttcctcaagatctgctagttgattataaagttcacttggaataacaagtatgcaagaaaagccagaaaacactgaaaaagagtaatggtagaagcagggagggaagctaacatttcagatataaaaacaagttataaagcttctataattaaaataatgtgataatatcacatgcatagacaggtcaatggcacagaatagaagaatatagaaatacatctgactgtatagaaaaacttactataggatatcatgcaagtactagaagaaacattgatgaattcccttacaaactggcactgggaaaactgtttctaattatgcttcaatgtgataatatccaagaaagtcaactaaacaactgggtattaaaggcaaatacctctttttatcaaataatcatcattctctggattctatgtaaagcaatatctaaaacaaccctgggaatcacataaatctcaaaattgttgagtagaacaaactttaacagtttctcttccttcatcatcatttttaaaccccagcagaaagatcacagtaatataaccaaaacctaaaagagcctaaaacacacatctgtagggtttggttggaaataaactacactatcctatatccagttcatatctaagacttttccttgcatttcagtacgatgctgcttactttttaagaaggattacaatccttgaatatctcaatccacaatttatatttaaaaatgcataagtaatttctatgtgctagagggcaagggcccttaatagatatttagatttatactataattaaaaaataataataatgcaaatgtatgtcaaagctctgtaaacaatattttcagaaaatttgttgtggagaaggacccctggtgtccagctggatttaagccagtctataatatagctgttgactgcattgccttcaaatctattatcagacagatctttacttaccttgaaatgtttgacttcaccataaaatatatcaagcttctaaaatttgtaaagattatatttatgaataaaaatattggtagtgctacatttccaaataaacattttgagaagcatgatatagattctttagacacggaatacaccatcactgactggcaggaatgtatctcagacacaatagttacagtgtctgattggtgtctctggaacgtatagatagcatctacatttataaaaataaatactatattcacaagtggcttctggaaaagcttcttttaaaaaaacaacattaaaatggcacattggcaaaagacatcacagccttgctgtatactaacactgccttgcaaatgaaaaacctgcactattccttatgatcagggtttcacccatttatttggttaatcattcaaatggctaaacagacctctaatttgaaaataaaaaccaattgatgcaatcacaaacaagttctaaaattgcggtttataaaaattgaaatcttgttctaagccaaaacacacacacagttaccttttcctaatcagagcattcatttctcctcattatgatctcacaagcacattaaaatcttattaacattaattacttctgagcgcctatgcatgagcagtgacagtcgtgagtgtgcgcgtgtctggatcatatctacatttatataccttgctgcactttgcttataaaacatgtgaaaatatttctgctaacaccaattagctaatttcacacacacacagatagtaaactgctgtctcactgcacagcctatcagaaaccagtaaacatatggacaaacggacgggaaagaaagcagaaacacctcttgaatgtgaaaactaaaatgccttatacttgagcctgaatacttaaggtgaaaacaagttgggaggacaaaataacaaaaatagaaaacaatttaaaatgataaaaccaagcatactattttctacacagatggtttcagtgataaaatgatagagacaaagaaaaactggcaagcaaaaagcagcaaacacaggagaaatatacagaaatgaaaatgtccttccttacatgtgtgtacatgcacacacatgcacaaacacacacatatctgctcctcttaaatatactcatattgtaatttgaataaaaacaatataaactttactctgaccataaggtaatagcacactacatttcaaagtcaaacaggtctatcctcacaagcaaataaatattcctgctcaaaccaaatgctttatggattctacttatactaagaacattatatacaggagccattaatacctacaatggaaactcaaggtaaatgcaaaaaccaaggcaattatagccacaaagctacatataactcttatctctttgcttcacaatctccttctctcagcatacaactattttatcattcatacatatactccatcaatttgtattcttctttgcctcatcatatgtccttcattaggaatattattaaagaataaccattgatcatcgcatccacattttctttttcaatccatgtgcccatcttctcctcacagcctagagtttataaatccaaagtcttattagataccactatatctatatagtctttctgccatctttaatttccttgttgccatcaaactatactgtttcacaaagaaaataccaaaaaagtctgtattccataatgaaattttcagtgatgaaaacacttaccctcattggattacaatacctatgtttgtaaacaaaggtgaataataaaacttaaacctaagagtattatactttttatagaaagttattttagaacatttgactacaaaataaatatagaaagaatatattcagccattcagcacaattcatgttaagttgatttaagcagttaagctataattatagctcatgctataattccaattttctacctattgtccagcaggctcattggcctatagcataggggtcaatgacccatagcaatataggtgtgcatgatagagatgggctacataacaaattcctaagtgctctctctgtagagtaggatatatattggagaagaaatggtagggagcagagagagggtttctaaatatttttgaaatagcattaaaatatatgacattggtattaatataaaatgtaaatggtaaccaagaatatactgtattttgttttaatttagtattattcaacatgctcataactgaacaaagtttagtggatattgtctgtgaaaactaaaacttgctaatataagcactattagctaataaagtgttaaaagtttttttaataaaggatagtaaaataatgttagatgcaataaaatggtatttaaagatgagcaagagttatttcaagtaatttccagtttaccataacaatttacaaattaaaattatcatccttacgatgtttacatagactttgtataggtaagtagcaactgtcacagtaatatttactacttgtaaatattctgacttaaccaggcttaccatactgcatgaagagtgccaaaaaaaaaaaaaaaaagactagagaactaagaaaataaaaagttgaaaacctaacagaattagtggttgcctgtctcataacacaatagcactctatgcttaaaaaaaatactgatttttaattagtaaacactgaaatatttgtttataggccatttatagcccactaaacaaaatctgtgaaccaaaaattaaagtattaacaacaattgccaaatgaaggtcaatctgtttttttaatatctaaattaacagatcagtggaaaaatatgagatttgtttttttaaaagattaatttatattaacatcttcaagaatactttgcattaagatagatccctaatgatcagaaaattatggaaaatcaggagtgaacaaagaaataatcttgagtaaatataaaaagtatcatcatgttaatcagttagctatgctgcagaaagcgtcccaagaatccactgacatatgaccaagaccgaactagcaaaaagtgcacaaatatgttgagacttagaacccaccttctctttcataaatgccccatcacaaactgcaaagattaggtggccaaatttcaacatcaaagattcacttggcattctgaaccagatctaagaatcatggtctttattttccagtaaaagctaataagctgagacttacttaacgctttcctgttttgttttgttgttgttgttgttgttgttttgagcttctcaaggaatactgaaattggagactacatgtgaaaacgatagttcatcttttccaaaaaaagatattcatccagattgccctccaatcggtgaaatctgagatgtctaaaaagtcttctttgtgaaagccttacaaatatatccaaagatgttgagtcccatatggctctgataaatgaaacccgttattgtgaatttcaagctcttccttaaatcaaaacactattgggtgaatttggtgctcatgaaataaagcactaattgcgtggcctaacaacactgaatcctctgcctagcagacattttaagttgtgccaaattggttttgggatgtgaacaaatatcctggagccagactctctcacatgcacacactactccctggaagtaagttggacactcttggaaactgcattaactctttcaggccaccagggaacctaactctcactaaaggaaaggcctcttttaagataaaaacaagtcatttcatctaaagttaaacctaagaaagaggtaaaagagcaaaaactaatttgtggctaaacactaaaatgtccatagacataaaatagtccttaaaccccagtggatgctttttcaaatgtatccagaaaatcttatttgggcataatttccaagacattaataagagttgtgtgcattcaggaaaagagaattcattttaagcttaatatgccacatttgcctcaggccgagtgataagaaacttttgtttctttggtaatcactctcaagcttattatatcaggaaatttcttgagtttctatttcaccacatgaaatatgatttccacactagaaatttttttatggtctttttgttctggttcagaaagatgcctacaaacatgaagctgagtatttaaatggcaattaatgtaatcccatctcccttgcactcaaatttaggagttcataaaaacaatttttaaaagcacctaaatataagaaaaatgtacaaaaacgggcgttgtatttctttctctattttttagtcttaatttcttcagcagtaatttcttagaaataagttgtttactttggtagggcattttaattaagcattttatttgcagtatgatgaaagcacagcatttctttccccttttatctcactaataaataccctggattatatttgtccccgggattacctaaactaactacaattttatgcttttaggtcactgtcattttgttgctgtcattcatctttcaccttaaaggcttatgaagatatagataaagtaaaaactacttttttggaggtggaaatagctaaatgcttgtgaaaatggtatttttcagtcatttctagtttaagccttctatatttcttagagaaccgtatttattttgtgtcaattggtgtgaatttaagagtattactagaaccctatgttccacctccaacaaagctttatattctaacaattagcctgcatgtgctgctgctattgactcttaataatatataaaaaaaacaacagccttgtcagccaaccctacaaggaaactagctgctatttgcaagtagacaggacacagttgtaaatcaaatgtgtgtagctgcttcgggcttctattggttcaaactgcaattcttagaatggaatacaggctatgggtgtgtttatatgaaggtcctctacctgattttctctggggttttggatctctgaataattcatatatttccaaatcaaaatttagaggatctgtagtgcactagtctgtgtttgtactatgtctgatgtgatggcatcacttctaagttctgttgcatattcagttagtcagctctggtaaccgagtaaaactcacactctagtagaaattgtttggtatctagaaccttactaaggacactaaggggtaaatggtaatattcaacagataccacattaaaaagttttcactaatttttaagtcaaatatttatcatatcagtgagaagttgatccaaaacatattcacaacttagggtgatactagggccaaatagcaactttcccctggggttcaagcacagaggctaactgggacagttataaactttatggaagtctaaaattctgattcgtatttctaccatggtcctcctttccaacttaaatccatctaatgatatcaatttaggaggaaaaggtatcaaaatttagcttatgttcatttcaaatacctcagattaactgtaattaggaggtaaaaataaaaatggcctgtctttaaataggtgtccattacatttttcacgtttagaactctgccatgagctcagaactatttattcaatgacatttcctttttccagttatatcttcattacttacatgatccaaataaaatagagaaaaaaaggcttcacgtggtggacactgtccttacagctcagctaattctaatggttttaaaagtctaaatatatttaataactagcctctacacctgagattatcagcagaatacttttttagatgttaaaagacagtagccaaagaaaagaaggaaagaaaacgtgagtagggatattaggagagcatctttatcagcaaaaaagctggattgtccaatttcctcactggagcaatgaataacctagttcccagtaccaaccccaacactgaaaactgctgtgtaactgtaggcaagttatttaacttcaactggctcctacttcttaatctgtgatgcaagggtaatatagtttcaggcaccaactgcttcctgcatccctatactggctaggatcttttaaaaattatttcctggacaaaacctcacccacatgccatcagttattttccctcctttttcctgcctcctttgcctctgcagggaaataaaattagcagtcaaagttaaacatgcccagtgggcaagacagactttggtttaaggaaagggatggagtaagttgtgttaaagtgcttatttggccccaaatggttcattgttgggataccacctcccacaactagctccactggaatttttctcaggaaaatggagaactgttttaagatagacatgccctgtaagctggtctcaaatcaaaataaatttaggatattcaaaaaatgccctacaggatttttcctgtggagcctaaataaatcactgaccaaattttccaattcatgctctgctgctaaaggggacgttctacaaaatcatgttttaatttctacatctgaaaaaggagtataggtaaagttcttcactttgggttttcattcttctctcttctctgacagtattctaaaagaatgccatttgagaaaagaccactcttagagaagaaaattgaaatataaccccaaatttccaataaacttgtaagtctgctaaagacaagaccataaccctggttagagattttgtgggtcttcctttaaaaaaaatgaaccttttaatacatagagaggtgttaagaatatcccaaaagtgtacacatatctaaatttacaaaatcatgattattttcacaactaaaggatatattttagagctcttttaaattgtgactgcccttactgcattttactgcatatcaataatttgcatattattaaatatttaaaaaatataaaaattacatttttagctatccatacaggataagtgagaaattgtacaagtttgcatacatgtgctgtcattttatactatgaggcattgtttttttcagacaagaacatcaggaatgctcaagagtcagtttttagatgttatgaagcactgaggcattgatgctgttaacactttcattgaaatttaaatgcaaaccaaatattttaagaccaataacaatggatatgccatgaaattgttgtgtttcacagcgtgtcataataggtaaaattggaattttccttcaaataatctgtcccatccaagagttttaactctcaaatataaatataaacaaaagattattcacttcaactgatttccctagaggattatgcattatcaattccaaactttacaagatttaagaaattactggactgattaagtgtggcaaactggtttgttccctacaaaggaaacaaacttaaatcccacaaagtttaattagcatttagtggctcaacaaatggaggaacagcctgattctgaataactgcaaagcagagtcagaaattgtatatactactggttaactttgctgtgaaaattagagtgaaccagaattcaatcccagttctgccacttactagatctgcaatcttcggtaaaccacttaaccattctaaatctttctttcctcatctttaaatagggttaagaaatacttcatagcaaaggcatggtggttaagagatcccataggcgaagttccttaacaattcattaactataattatcactacaatttagaccccttctgaccattgagaacccatgaattctacatccagctaaaaaccattttgcaatagaaaaattttttcaaaactcaatttacatggtctaagcaacaattatgatagcatgtcaggggctaatgtggtgccaaaagttagacattatcatttaacacaatgggaacctggtaaagatttactgaatgaggaaaaaatataataggatgtaatagaaagaacagagactaaatcttggctttgactcttagcagctgtgtgaatttggcaattttttctgtaagcttcagttttttcatctaaaacataggcagaaaaccagtgtatgcaacaaagttgttgtatgcaaagattaaattaaacagtttgtgtgaaaggtgcttagcaatatctcgcttccttaattttagcattataggacaagagttctaatcggttttcaagcctaaacttttcttatatagcagtatcaactctggcctcctacataaagtaagattatgtttagttaaggaataatgtgagagatgaggataaattcaggtgtgacagtaaatatattttaacaatataccctagaaacaagagtaatgattctcaaaccttgcaatattactaggatctttggtgtagtttttgcaaaatatggaagcccaaataccagtctagagactccaattttagatatgtgggagtagaacctaggaatctgtgtattttaaaagcccttggctgattccgacatataataatcaactaaagtcgagttttctgaagtatgtgggccagctacaactcaggatgcctgagttccattccatacccattaataatggagctcagaaatttgaattttaacaaaaatccgaagaatatcttatgtaaactaaagtttgagaaccactggactagaatatagtaagataatattgaaaagaatttttttcatatttggttatttaaacttttttccctctatttttaaataaacattactgtcaaaatttatgaatgatgggtaaaaattttatctaaagaaaatattagttttagggtaagtattatcattattattacaggtttcaaaatcaaaatgggaaatagagataacattttaagtcatctacagagggtccaccagcacagaaaagtatatcacctaggaaacaccatgcgtttcactgtttcttaaatttgtgtgttttgctttgacttagttttttattatccattccttctttaattagagcagtaatgccaataaataatatttgtatactactttactatttataaaaaaacttcatatatattaacttaattaatccttacaataaccttgtgaggtagataggaaaggtaatatatattatcacatttctgccaataagaaaactcttaaaaagtttgtgcaatttgcccagtcataagtttgctggtatttatggtaatacgtggactgaaacctctagatgtaaatttcatgcaaaactgtgtgaaatttaaaacttaggattcatttttaagtgctatgaatcaaactcaaaatagcatgagagtctctgaactgcaagtagtccatagtcctctaccaacctgtgggttcatcttactatataagttcattgtactttatttattatatggttaaagaatagaaggagagtggagctcaattaaccaaaaacaaatgaacaaaaaagtgaaaaacaaataaaaaaatggaatattcatccattataatactatttactctgcctacttgcaattcattcccctataagcccctttgcctcagtttcctcttctaaaacatgaaatatcaaatagcactttcaaaggctagcaatttcattttcaactatgatggtactttaaaaagtacaactaaatatacagctagaataatactaacatttgcccaatccctacaaaaatcctgtcaaatcaactagtccagtccactcattttatacataggaagtagacctaaaaaaacttaagtatgttaccccaaataatagcaaatttgttgtaaagctagaattaaaaattatctttacatcaaagtcaattacaatacacacttgtgaataggcaatgccttgttttcataatcaaaaagagaaaatggtcattttaagataaaaggaagaaggtaatttataaagggatgtttaggcaggaagtggtatcagaagctgtttttccaaagtaaaaaggctccaaacttatttacaacaaagaaatgtgtattttatatatatatatataacacacacatatatataatacatacatatatatatatatatacacgagaatgttataaaccagctagacataatcatttgtttagacctcaaatatttgcatagctctgtgctgaatgccaatagaaggttctggaggatgaataagacacagacactatcctcaagaagctcaaggtttagttggaagatgtgcttacaaacaatggcaatacaatgtgagaggtgatattgccaagttatgcatataaaattgctgtgggaatgtgaaagaaggagcacctcaatgcctgaaatgaccgagcttaagtgagtatctctgacaatccctgtcttctccatttccaattctaaattaaatacttccctgtttatgcctagaattgttaaagaattttttatataccctgataggagaaaagtagtaaagtgcacacatcctaactttttcttgggtaataagaaatttcaaagactaaaacatattatagaattttggtacagctactacgaaatcagggcctgaaacaatttgccaattttttgcaaatgtcctgtttttttgttgttgtttgtttttttcactaactcatgcatcagttacttgcacagcaacagggacacaaggtggcactgtcgtgctgacattcatttcagggtcctttctaaatggacaaatttgtaagagacagaatagaccctattgtgacaactaacaccacagttgtaatactggccgactgggtctaccaacattaacactggcctaaagaggagtattttgcatttcatgaatattatatcatgcctatatagaaataggacatattctctgatgacttctccaaaatgtcatgtgtgtattcatagaaatgtccaaaggcatagagtgcagctttgccattaggaagtcagaagtgaactgcttgctattggcaaggcagtggacacggatcgcctctccatctagtggccagtggagaggagtggagccatagtaaccatgctgcacttcattccattaaaaacagcccttttaccaaatcacccataggcaattaagtcagtttgtctgacaaatgactatttttggtttatggcattcgttcaatcattaaacagactcaataatacattatgatatgtagttaagctaagaaaaatcatcacaaaattaaagtgcctgtgctctctcaagccacataaatgtccgttattcttcctttattacccaccctaacttttctccatttatttgtgacttttagatagaaaatgcaagcaagattatctacatatatagctacttaaaatcacagtctttaagatgaaaaaatattttaaaaagctttctcctcattttacaggaaggaaactgagggacagagagatcatgatgtactcaaagtcacaaagtcagaacaaaaaaccagacctccagatttaaccactttaaatcctttttgatattgattaatacctcctgattccccaggaaatgctttttgtatcacaccataaagtttctttcaacataccagaaaaataatttctaaaaatgttttttattcatatattttcagactaaggtgatataagtgaaactactgtgtataggccgtaccacatcttcatatccataggtatattttgaatgtgttataagaacacaattatttttatattaaggaattacattcatccaacatttagaaagcgaaaaagcaagtggggtagggaataggtggatgtgttggtcaaaattactatacaaaaaatggtttcagaaagccattatgtgaaacaacctgaattcattcagactgctagaaaagttctttttgttttgtttcatacaaattatttgactttgtttttaaaaaggaaacacacgcacacttatccagctaatcacttcatctattttaattcagcatgtgatgctgtttgggggcatgttttgggaatgtgttgttggtaaagcttcttatcaaaacaaatgaaatctgtccaccaactataaaaatctgctcacaactccgaacccaagaattaaagggcaaaaggtatgaaggaaacctggcagtggatgttctagaaatgtgagatgttttgactttttcttctatgatcttctttggtggtaccactggaatctgtcttggagtgcagagggaatttatatagatctgctttagagagatgcaaaaactaatgctgtacagataagtcaaatgctttttaacgggagttagggaagaagtctttttatttcattatacttctaagtttagaagcttcaaaagcaccaacccctcagctaccctcagctttacccctgtaccctcagctttatcccttcacattatctcaacttctctctacttgtttcttaatcatctctagtcgtctcccttctagaaatgaggtgaggggataaagatcactgttgatttggagaactagagaaagtaagggctaatataaaaagtaagttatttttgccttacctaaagctaaggtaataggtacaagtaaccaagaagtggagaaattagtaaatatggtcagaaccagagtatatttattgggccaagaagaattttaatgtgtccagtatttaagaagaaaaaaaaacaaaaaatttataaagtcaccattacaaagtatttgcctagtctatttaaataataaaagagaggaacattttctcactgtttaaatgtcttggtgcctaaataagatatttttgtttatttaaaatgaagccacatagttttcacatacacatatatatcaactagaaaaattacatagcctggaacatttctagttttctgctagtaatagcttttttttttttttaactaagttttaagttgctacctgaacaaactgacaacattaattttctctcaattacattccatttacaggaaagaagttcatactataaaaggaattgcaacaacaaatcacaatttaattacaacagtaattcacagaaaatttttgaaaaggtaaaaatggcaaatatctaagctaattcagtaaaaaacaaaaatgtaaagccttctaaaaattagagaaaattaaaatttaaataattttaaatgtttcattttaaaaagtttaaattaagaattttcccaataacaaaaatagtactactatgtataagattcgtaattattaccatttctacatttttagttacaaccaattgggcatctatctttttgatatcccataaccccaacctcataccataattttatatttgttgaatgtaaatccttacattagtaatgtaatataaaaactttcaaatagattgaccttttaaatgcataatatgaacattaaattcatcatatctcaagacacagaagtattcagtgacaaaattacttccaatatcaagaaggtaaacatattatgctgtaattaccacattttctatcagagtttcaaaggtaagactgaatattcagaattaataaaaaatatgttcttcttccctctggaaactagatgaatcaatgaactcatagtccttgttccttgtctcagtattctcacttgaaagtcagtagccagctttccccaagttaagacaattacaaaggttgcattggttaactgaactacaaaacaccaaggctagagtttcagctgagtgtcaaaagattccagaaaggcaagctccatgtcctcaagctgattactttcaaatgaactatagaattaccaaaaggcttgatcctggagtataagagaggttatgaagccaaagtcaagcataatttttccacagtttagtacagaaatagcatgccacttattcattattacagttgaacagctagagtggcaaaaacaaaaaacaaaacaaaaaaaagccctttttcttataagcccttgaatgctgtttctaacaccggctgtagtggttactacatacatgatagtaatcatagatagcatatttcttcccatagcctcatcagcttgcctatgctgaattagaactaggggagctcaaggatattttgatatattaaacataattgtcatcaacattatttgatgattaatgtataatatctatgtaataggaaaacatgaattcaggtattctctagaatatctaagatatgtatattgccttcaggcttttggtaaagaataaaattgatcttgctagtttatttgacattagctatagttcctggagattatgcaaaatgctagaatttatttaagcaatggaaatgtatgaaatgggtttttcaagaaaattacaagtttcaagttttgtaaaatacctacacacctatacatgacttgaaagcttggtgtaaagtatcaaatgtaaatgctgactgtattagcactgtaaataatccatagtaattgtataaaataacaaaaatgtcttacacagtatgaaacaaattattttaaagatttggtttctaatttaatgataactctggcaggtacacacctgtccgattgctagtgtttattgtccttgatggagggtaaactgtttctatgtaggtaatacctgatttctataatgtccctgaaatagttacacagccatgcaaatgaaaatatttagaggttcttttcagtgctttgtgacttctcatggtaacttagatcttcactggttaagaaagtgagggataaggatactattttacttatgttttacagtaaaacatgtctcccaccaaaaatgtagtttgttaaaatatatttataaagtgacctccaagataaaccagctttaatgtccattttcaacatttagacttcagaggccacccttgaggctgaagaacccaggagctagcagcattcaaagaatatcaacaccagtcattcttttgccagaaaagatcactagttagcaatattagccaggtgctgctgcttcaacataccttgccagatgttggggtaacacgtttgctcagggcctgaatttggcttcctatgtggcggcatgaccggccactgcttagagttgggcaagtccatgaacacatccactgataatttctatatttatagaaagccagaacatgtgtagataatcacacaattagatatttatgtagtgccagattttatgaatacgagaatttgttaattagcacaaggactaatcattaaaattcaaaaatagataaataaacaggaatgccatttatttgttaacatttcatggggaaagtatgcagctgctatccttttgatgaatataggcttctggagataaaaatgtgcagaataaaaagtatctgcaatttttgaaaccctaatgagtaaaatccaataaatcactatatagtctttatattaaaaataatcatagtgattctcctcttaagttaaaaaagaagaaaaagtttaaactggcatatgcttagcatttgaattatatggtctggcattccattttatttgattttatttatttatttgttttgagacgtagtctcgctctgtcaccaggctgcagtgcagtggcacgatctcggctcactacaacctccacctcccgggttcaagggattctcctgcctcagcctcccgagtagctgggactacaggcatgcaccaccacgcccaggtagtttttgtattttttttttagtagagatggggtttcaccatgttggccaggatagtctcgatctcccgacctcgtgatctgcccgcctcggcctcccaaagtgccctattttttttaaaaaaaatctactgtttggtccttttcaaagagccaaagctgatttttatcagcacacacacgttaaaaagcacacacacgtcactcagtaccaaattgttttagctacagggcatggcaaagcatgaagtaacttcttagagcacttcctcatgtgggtgtgttaggtaactgtctgctccaacattaaaatgaaacacactgtgacctgaccaagactttggggatctaaacaggcagatatcatgtgctgataggaagagcccactataaccaataaggctgattaatgaatttttctggcattctatagcgctcctgtaacgcaagcctttcagctttccaaatccctatacagcagagtacagtggtttgaagtttatttatgcacattttataatgtccttctgtatttagattgtgacagtccctcccagaaaaggccaagattatttttcatactaaaaatattttagatctactgaaggttaagaattataatgcaaaagaaaacatatacacattctaaaaattaaaccaaacataaaaatggctacattattacttgcttttattcttgctaaaaggttaaaggaaattttcatttttctcttgaaattctctccattttttgtttgcttgtggttaacataaacacacataaagtgaaatttttaaaaatattgtatctgaaaagaagctgtgatgtatttatccatacatgtatgacttcgtgtcatacatgcacatgtatgcacagatatcgccactgtatgtgtgtacagaaaaagagaatgactaatcaagacatagatgaaagatttctattgataaaaacagtagaattttagatggtcctcacaaggctaacacagaaaatgacaggtgcatgagacatgtacacttttgacatacagtatcagttttgaaacaaatttttgggtcaccgtcagaaatggcataaagtatatataaaattgtatatgaaaaacaaaattatcgtgtaccatattaacataaaatactctcctaaagttccccttagaccttacggaaaaaaatctccgacgggacctgattgagcgtacttagtatttgtactactcttggtcaaagccagcctatccagtttaaaaaaactgttcaggcaagataagcaaattgaaagtctcagaattaattttttaaaagaagaggtaaaaaagtctttcagcagcaaaagttcatcaccttcctgaaataatggatttttaataaacattttactaggtttgaaccttgagaatgtgtttgggaatctgctctagtgtcccaggtgggttaagaatattgctttatggacttctttgtgttgtcagagaagcctaatggaattaagggggaaaaaagtctgccacttctgttaaataaataatttattacaaaaagatgactgttattatcaaagatctctacagatcagcatccattttctaacattgctctgtatatgccgaaacatttgtgtatctatgtgacttaaattttatcaaatgaagagcagttttactttgacaaatctgaaataaaattccattaagaagtccatttcaaatggcccttattaaaataatcctttcaattttgaagaacactattctgggaaaactcttcaacaatgtctgctagtttgaaatgtaacttttcccactataaaaaagaaaaaaagaaataaaggaaaagaaagcaccacaaaactgaatttgaaataaaaattatattatttatgctccccaaaatgttaaatgaatacttacagttgttgtgcaagatggcctgatacacttcatagcttccactttgtaaaaagatggccagcccctcactccaccctccccaagcataaataaacagtaacatactaaaaggaaactgtcctaggataaaaactgcttgttaagaaagttcgcattcttactaaccaaagtgatattcctataaatgtaaaagcccatctgcaaaataaaagttagaaaacagaataccttatttgtttaaaaatacatcccccagatgcaatgtttctatgtgtgtgatgacaaaaataattactccattcttacccaccctcagcaactacccctcaccttatgtccaatggcattaaataaacatgctggcaaaaagtattcaacctgcttcaaggatttaaactgtaaatatggactttaaacttcaacataaaacaaagaacaagagtctcactttagtaatacccacactggcactgcagctaaaactcattggcaaataactaacaaaaccgagttagcaataaataaggacaacatgatatatagacagacagatggaattgcataaacagacaagaaaagcaaagagacaaacatacggaagggtctgttttaaaagagtgaaagattctgatttatttggtactttagtgagaaaaatagatttgtttgtaattatttttaaagtaacaaaactgaatcacaagggcacacccctaagtaagtaggaagaaaattagtaaagggtaggcctcctacagatgttctaaattttaagctagcactagctctgtcaaacttaaatctggaaattaaaattcaagcaggaaagaataaaggcattgggggctaaaggagatgacagagggggcattgaggaagcaggatttttttttttttaagaaagttgtctgccctaccttcttccccagcgctgagtttctcttcttataatcggtgtctccctggaagtacagtgtgagtggtaatgactgcctgcctccctaatgagtccattttcctgctcttgatgttgtgtatatacacacactgcaacctaccttacaaaccacagagacgggaagagagagagagagcaagagagaggagggaggggggaagagagggagagagagacagagacagagcaagcgagtaagagagagagaagaggagagagagagagagagaaagaaaaacagaaagaaacagagagaaaggcacagacaaagccctcctaccagacagcagacagctctccttcccctatccagcaaaatgcaactcgtctaatgcagcaacaggttcagtattgccagactaacagagtgaaaaaggtatattctctatatcattattgcttgcaaataaacagtttaagagcagctggctccaccttctttatttatgctccattatgaggaatgtattgtttcagttctggcagtacatgtaattatcataaatacattttttgcatataagcaggaaatagtgaaatgcatagcttatttgtgcaatcttttaaatttatttttaatgtgagaagaatgtgaacaaatcagctctgacaaaagcctagtaatgattttaaagtcagagcagtcttaaaggaggctctgtaagaaacagactccatacaataggaaaactgatctcagacaaaactgataactgcaaagaagaaatcattgctcagttaataaatcgagaccatatacaaaattgcagacttacaaaattacagaccaaaacagaattaagcttaattaagtaactaataggctaggaacctagaagaagggagattggcttctcatttaaagcatctagctgtacaaacatcacaatgcaatgtactctgtgtgaacaggtgcaatgcgtatagtacatagtggtacaacaacagaaataaatcccataagaagctaccatcacaatcaggatgatatttcatagaatatgggactgaaactacagcagttacccttaatcttttattaggagggaaaaataaaaataatcaatgcttctaaataaacttgccttaaaagagaaaaaaaacagtttttctttgtctgatacttctaaccagattttttctatattctagttccaaaattatgatgttattatactcctcaccccatcacatgcttcccacccactttccccactcctaggtgccctttctcctgtaagtgatatatttgcagctatagaattacaaacatcagaaaacagaaatagttttaagccactctcctcgtccccgaatttttaaaaactagactctgcttgacgagtcatatctccttctagcactattatctatctagacacccaccttccttaatatatttctatacagtttggctatgtgtcatttagatgggacttaagaacattataatagaggtaaaattttctaaaaaatatttacacacaaataaaaaatataagtgcatttgacttattcaaaccctgcgtttgggcaacaataatcctaagtatatgaattgtaaaaatcatcctttttatgtggttttgtgtattaacatgcttcaaaaattagaatatgtccctctgcataaacaaaactaccttgaaacaacagcttcaattcttttgtttaaaaaaaatcagttttcaattaaaaattaaataactttcaatatataacttatagatcaaccgattcttcaccttattcacaaaaatctttaagaatgtcaaataaattttgggtcatgtttagaatacagatcaatattgctttagctattttcagggtggctaacctacagcacagacattagaatgtaatatctacctatacattatacaagctatcctgggaaaatttctagtaagaaaccaagagtccagaccactctagtctcatcgtaatccaccaattcaacctctctagtgctgcagtagtatatcaccctcccaagggtggatgattaaaaggagacagacacacactaaaaatgatttaacagtctcctacttcaggtcacttgtctgtagagaaacttttccaaaatatatttagtgtgcccaaggtaccagcatgtatctcctcctcactatttggcctggcagctctgcttttctactattgccctattgtttctccgaagctttattaaaatgtattaagaaaaatgtcaattaaaaaaacacataaaacttagagtttgacagatggatttgaattagatatttgtattttctgaatttttaaaataaggttctaggtattttattttgtttcattttgtttttattcaaggagaagacgtatttggtttctaccagcaggaatcaaaaggaatataaaggaccatgaaggctcttttctaaaaaacaacctgagagctaaatttaaaaggaaaacaaatcttttggcttaagtgaaaaatgagaccgggcacagtggctcacaccgtaatcccagcactttgggaggccgaggcaggcagatcacaaggtcaggagttcgagaccagactggccaacatagggaaaccccctctactaaaaatacaaaaattagctgggggtggtggtgcatgcctctagtcccagctgctcaggaggctgaggcaggagaatcgcttgaacccaggaggtggaggctgcagtgaaccaagatcacaccactgcactctagccttggcaacagagcaagactccatctcaaattaaaaaaaaaaaaggtgaagaagaagaagaagaatgtacaacatctcaaaacttttcccatatctgtacattttactagattcaaagcacaataagtagtacattgttagtacttactggaattcaagatatactttccctagttgggactggagacaataaggtctgaagaaatcattgtaattgactaccatactatggaagttataaagttatttaattaaattgcttcatgtgttgatatgtcatggggcaatttggttctgtagaaagatcctaaagtggaagttaaaaactggttctgtcccaaattgatctatagattcaattcaatcccaatcaaaatcccagaaagttattttgtggatatgaactaaatgattctaaaatttatatggagaggcaaaagactgaaaataaccaacataatattgaaagagaagaacaaagttggacaaatgaaactaccagacttcaggacttactataaagctacagtaatcaagaatgcatgatgctggcaaagaatagacacagcagatcagtgcaacaaaatagacagcccaggagaaggcccacatatgtatagtcaactgatctttgacttaaaaggaaaagcaatacaatggagcaaagacagtatttccaacaagtggtgacggaacgactggacgtctacatgcaaaaaaataaatccagacgcagactttacactcttcacataaattaactcaaaatggatggatcataaacctaaatgtaaaatgcaaaattctaagactcctaaataggaaaaaatctggataattctgggtttcacaatgactattttagatacaacaccaaagacataatccatgaaagaaataattgataagctggatttaattcaaattaaaaagttctactctgcaaaagacactgtaaaggtaatgaaaagacaagccacagactggaagaaaatatttgcaaaagatgcatctcataaaggactgttatctaaaacatgcaaagaattcttaaaactcaacagtaagaaaatattataacctgattaaaaatgggcagaagactttaacagtgacctcaccaaagaagatatacagatggcaaataagcgtatgaaaggggctccatattatatgtcattggggaaatgcacattaaaaataacaatgacataccaccacacatgtaatagaatggcccaaactcacagcactgacaacaccaaatgatgatgcggatgtggagcaacaggaactctcattcattgttggtaggaatgaaaaatggtacagccactttggaagacagtttggcagtttcttacaaaactaaacacatatacaatccagcaattgcagtggttggtatttatgcaaaggaattgaaaacttatgcccacacaaaaacctacacacagatgtttacagtaattttattcataattgccaatatttggaagaaattaatatgcccattagtagatgaatggataaattatggtacatccaggcagtgaaatattatttagtgctaaaacgaaatgagatatcaagccatgaaaagacatgtaggaaacttaaatgcatattactaagcaaaagaagccaatctgaaaagattgccttctatccactgtacgtatctatacactgtatgattccaactatatgacattctgaaaaggcaaaaccatggagacagcaaaaactcattgtttgcaagagtttagggtagagagagggatgaacaggaagaacacaggattttcaaggcagtgaaactactttgtataatacaatagtgacagatagatgtcatacatttgttcagacccacagaaggcacaacaccaagagtgaaccttaatgtaaactatgggcctggagtaataataatatgtcaaagttggcttatcatatgtaacaaatatatgactctggtgggggatattgatgatggggaggctgtgcatgtgtgaaggcagggggtatatgagaaatctctgtacctccccatcgattttactatgaaactaaaattactcaaaaaaaagtctattaaacaataaattaaaagaaaattggttctggtcccagcattgccacaaatagcttgcgtaccctcgtcaagtcatgcaaccatcctgagtttcagtttcttcctatgctaaaaataacaaatttaaaaggacggaattgaacagcgtatcataataatagttattaaagccaatgcttaagtgcttactatgtgtcaagaactgttctaagtactttttatttcttaactctttaaagcctaacaattaccctataatgtaggaattatttttagtctcattttccagatgaagaaaaaagagagattaagtgacttgcctgagatcacatagcataataataatgataggatttgaacccagcctgtctagcttagagtttatgtgtttaatccctacactatactgttttacccaatacctaaagatagttaaggccccatccagccatgactctgtggttgtgagtcaaatctagtaagtcctgatgatttcttaccctatcttgcttactaacacagaatagtgaaaatttgctgtttaatacccatagctctcaatacgttcaatttaatggtacccagcaactccatctaaagtacatactctatcatgcattcttaaaggttgcatagttcaagattcaaatatctaatagtaatgcaaataattgtttaaagaactaaataataaacacaataaaatatttcctattttctatagcctgagaaaggaattaaaaaagcaagaattcaattgtaaaggatttgtgtattttgggggttttgtttgtttgtttgttttttgagacagctccgtcgcccaggctggagtgcagtggtgcaatctcggctcactgcaatcttcgcctccccagttcaagcgattctcctgcctcagcctcctgactagctgggattacaggcgcgtgccaccatgcctgtctaatttttgtatttttagtagagacaggatttcaccatgttggtcaggctggtctcaaattcccgaccttgtgatccgcccacctcagcctcccaaagtgctgggattacaggcgtgagccaccgtgcccagacaagaaaagtctgggattagtgggtcaaaatgagtaattgctacgctaagtaaatgactttgccattgaggacaccaccataaagttaattgtaagtggcgtaattacacaataattctttttttttttttttttttgagacagagtctcactctgtcgcccaggctgtagtgcagtggcccgatcttagctcactgcaagctctgcctcccgggttcacaccactctcctgcctcagcctcccgagtagctgggactacaggtgcccgccaccacgcccagctaattttttgtatttttagcagaaacggggtttcaccatgttagccaggatggtctcgatctcctgaccttgtgttccgcctgcctcagcctcccaaagtaatggaattacaagcatgagccactgtgcccggccaattaggcaataattcttaaccctagtcatctattttaaaattgtatcccatcgggcccaaggacaatagtaggccaggagtaccatccttaaatgggaagagttgcacatctaatttaaattctaatcaacaaatgtttaaatttaaaactaaaataaagtattacatgtaaactaagtcattggaagtacatttattatggccagaggattttatatgcctctctccctacaagactaagagactccctccccaccatcgccaccttcttcccctctgccccccagagcagagaccctacttattaagctttgttggtctagcatctggcagtacacctgtaatatatctgaagctcaaaaaagttttcctgaaagaatgaatgactaaacaaacaacagtacatagggtttataaaccttggttaattaaaaacttaaataaatttgagatataaggatgatataaacaagtaaatagcatttcaaaaaatgtattgtcacatattaaacacatccttatcttaagatcttgtgacaaacaaaaatagaaaaagtaatcttcaactttgctgtatgtttgaaagaatttcacaataaaaagttggataaggctgcatgcagtggctcatgcctgtaatctcagcactttgggaggccaaggtaggagggtcacttgaatctaggagttagagaccagcctggacaatatactgagaccgcatgtctataaaaaaatcagccttgtatgatggcatgcacctgtagtcctagctacttgggaggctgaggtgagaggatttcttgagcccaggaggtcaaagcagcagtgagctatggttgcaccactgcactgcaacctgggtgacagagtgagactgtgtcaaaaaaaaaaaaaaaagtttgttaaaaaaagtattcatatctcacaccagtcagaatggggattattaaaaagtcaagaaacaacagatgctggcgaggctgcaaagaaatatgaacgcttttacaccattggtgggaatgttcaaccattgtggaagacagtgtggcgattcctcaaggatctagaaccagaaatgccatctgaccccacaatcccattactgggtatatacccaaaggaatataaatcattctactataaagatacatgcacaggtatgtttactgtagcactatttacaatagcagacatggaaccaaccaaaatgcccatcaataatagactgggtaaagaaaatgttgtacatatacaccatggaatactatgcagccataaaaaggaatgagatcatgtcctttgcatggacatagatgaatctggaagacataatcctcagcaaactaacacaggaatagaaaacactgcatgttctcactcatatgtgggagctgaacaatgagaacacatggacacagggagaggaacgacacacaccagggcctgtcggcgggtggggggtgagaggagggagagcatcaggacaaatagctaatgcatgtggggcttaaaacctagatgacgggttgatagatgcagcaaaccatgatggcacacgtatacctatgtaacaaatgtagaggttctgtgcatgtatcctggaacttaaaaaaaaaaaaagatattcccatacaactatcagaatttcaataaacatcatttctgaaaagaaaattcagcttgccttcacatttcatttatctattatttctttcaaatctataacataagtgtttgtaaaaggctgaagttggcttcagagtacttcatgggaatggaattgtcctctttgaggaaaacatcttgataagctgctggagtcagagagtgaggcatgaatatttcttgtggggttaaactgtactacataaaaaatgagtaacaatttgaagttaggggagcacagagatgagagggaggaagaagaggagtagtgggaatttcccaatgtaaacgtggccagattttttaaagtaatgcctaataataaattctatgaagtttatgttttgtgatgcaaatattctccttctctccaaactttcaggaaaggataatgtatattctacagtcttatatagtagtagaacgaagaatcaaataatgaaaaaatgaagttattgcctcacattcacccatatactgtagcctttataatcacggcagtttcctaataagacagaaaatattaccggagttcctcggagtgaccagtggtagagtgaacagtggccagtgaatagtaaatagcaaagagtagaaaatcaaaagtatctttaatatagaatgactcatatctatatatgagtcattttccacaattgtaaaggagaaatatgaccatggggaaaagtggcacggagtttagtatctgaatgataagattattatgctattatagctgttgttactactcctataagctgatcttaaatgatatgattatctttagaaatttagaagagggtacttttgtgacacaatcaataaatgctaaatcaatggattacaaaatataaaaatgttatttgtaatatctccctggctccagaacaacgtattagacacatatactatatgaactcttctgctgcctggtcaatcctctctactaaacaatctacaacaatgccagcaactatcttaaaagtttccacatctacataatttacttatatgtacagtttatatttaatacaaaaggaaaggaaagagaaactacagagtgcattctataggaaaaataaaagtcacagagaagatataaaaggtacatcttaattgccatagatgtttgtcaagcaggttggtgagatccttactgtttgacctggtgcggctatactcaaaaactcaatagtcttcatatctttccaaaatacaaaagttgctactattaataagaatgctttattaaaagttatctctactacatgtgtcagaaacagcccaacatacactttctcatttaatcccccaacagcattaaaagaaatctcattttcagattatacataaacaaaaagaggcccaaagacacagacctaataagtagtaaacgtcgggcctaacatctatccaaatagaatgtgtaaggaatagaaggaggggctttataaaattactccaaaaattatctagaataacagactggtgatattaggtagaaaaagaagactaatgatggggaacagatttgaaaggatatatgttccctagataatttcagaacttaaaattttatatttgtttgaggaaaagtatattaagtatctcaaagtaaaatttaaagaaaggataatggaaaagactagtatattaaaaaatagctttcaaaagcgatgaaagaaacataccatgaaccagtttgattaaagagttggaaacattaggcggggcactgtggctcacgcctgtaatcccagcactttgggaggccgaggtgggcagatcacctgaggtcaagagttcgcaaccagcctggccaacatggcgaaactccgtctctactaaaaatacaaaaaaattagctgggcatagtggcacatacctgtaatcccagctactcgggaggctgaggcaagagaatcacttgaacccgggaggcggaggttgcagtgagcagagatcacgccactgcactccagcctgggcgatagggactctgtcttagaaaaaaaaaaaaaaagagttggaaatattaatagcaatctgtccagcaattttgaagcgagttattaataacggagtcagcatgatagcagcctgctaagccctctgaggcaacaggccatagggatgattcaaaataggtagaaatggtatcttttatttttaagaaaaatcacttagccccaataagctgtaggcttatagccataactttttaaaaaatgtataaggtcagatcaaaagtttttataacataatctacataaaatatctatcttcttcatttgtattaaatacaaaaaattactttacagtatatacattcagaatgtatgtccgatatgtttggtaggattcttgaaaaataaaaatttgaaatgaattacattaaattttattttacacttatattgggtatttcaaaattgtcatttacttaattttgactagtttatcagtttatatctcaatgaagagaattgtatataaaacaaatccggccaggtgtggtggctcacgcctgtaatcccagcactttgggaggccaaggcaggtggatcacctaaggttgggagtgtgagaccagcctggccaacatggtaaaatgccatctctactaaaaatacaaaaattatccgggctaggtggcatgtgcctgtaatcccacctacccaagaggctgagacaggaaaaattacttgaacctgggaggcagaggctgcagtgagccgagcttgcgccactacactccagcttcggcaacagagtgagactccatctcaaaaaaataaaaataaaaataaataaataaataaataaataaataaataaataaataaaaataaaacaaatcctccttcatgttaaatgtccacacatttgaatggattgaatttacttatcactaaatatgatgtactactctatttcaaaccgatggcactttaccactgaaaatgtaataactggatcttccataacacaaataatactcccaacatcacttaaacctatgtgaaatttgaatatcaaacagtatctcaccagttgagaaaattttattagtaatcaacaaaagaacactgcccataatgaaatctgtattaattacaaaaagagttatgaaagaaataaatcattattatgaattttattttaaaaattaaatggtttgggactccaatacatacctcttatgatgttttatctgaaggtcacaaacggaaataaactgcaaaccactgtaagctaatatcttaataaaattcatgtaacttttgtctaaagtaattaaaattctctccctagtatttttccaccaataaatgcacttaatacccactcaataattaatttgcactttagcagtttaatcagatgtttaaaaatacatatttacaataaaacaatagatattatagaatatttgataacataaaataattcaataattaaattctgaagttttccaggcactacatttttactattactattattttaagttaccttaataagtgtatagaaataaataataaattagagaagttttaggtagtgctcagtggcagtcaaaatatttatagctcataaggaatgggcacagaagaaatgttaccatgactaatcaaaacagatgctggctgtaaatacagtgtgtattccctgaatatcaaccctagctttaggtgtcaaatcaaaatccatctcttaaagctaatcaagaaaagtgaagtaatatgtagttttaccactgagttccttcccctactctcaagaaattgattctccgattattaaaaagtgtatgctccctcagtaaaaacatttaaaactttgcacagatcactgttagttctcaactccattcctatctaaattttagattattactaaaattttaaggctcttccatgtttgggtgtgtattttctattacatttttgtgcttagatttaccttttattttttaaatgacataaagtatttatacatatttatggggtatatgtgatattttgttacatgcataaaatgtgtaatgacaaagtcagggtatttaggttatccatcaccctgagtatttataatttctatgtggttttctttttttttgagtactctcttctagctattttgcaatatagaatatttttattaactacagtcaccctactctgctattgaacattagaacttcttttgtctgacgtttgtacccattaaccaacctctcttcatcctctcccaacccactcaatcctcccagcctctattatctatcattctactttctgcctccatgagatcaacattttagctcccacatgagtgagaacacgagatatctgtatttctgtgcttggcttatttcacttaacataatgacctccagctccattcacattgctgcaaatgacattccttctgtcttacggccaaatagtatttcattgtgtgtatatatgccacatttttttatccatttgtccactgatggacacttaggtttaatttcatatctttgctactatgaatagtgctgcaataaacatgggagtgcgggtgttcctttgatatactgatttctttttgagggggatactcaatagagagattgcaatagagagatctgtttttcattttatgaaaaatgtccatactgtttttcataggggctgtacttatatacattcccatcaacagtgtataagagttcccttttctctacatccttaccagcatctgttattttctgtctttttaataatagccattctgaccagtgtaagatgttatctcattgtgggttttgatttgcatttctctgatgattagtgatgttgagcatttttcctatacctattggccatttgtacgtcttcttttgagaaatgtctactcatgtcctttgcccactttttaatgcaattaattgtttttactgttgagttgtttgagttccttatatattctggttattagtcccttgtcagatgaatagtttgcaagtattttctgctgtgtttaaaaggtttaattttaaaaaacagtaacaatgacatcctacagcagttatgtgtctcttgacttcgatttattcactaaaatagtttgcatataattgatgggtgaattcctcttccaggcactctttctatggtagaagttaaaaactacaattcttagatggctttgccagaatatgaagcattggtataagatcaaaggcaaagacagacttcttcctgcctcctgcttttggcactgaaaatctcagcaatggtgctccaacagggtctgcagcacagaagtcttggtatctaggctctggactgctgattgcaacactggttatgcaagtgcagaacaatgcaagtgcagaacaacagcagccaccacaagtgactggaagctccagcagctgttacaagcacaacagaattcaagaaattacatattatcctggattcttgaagtgtccataggagtgcggacacctggcttcctacagtgcagtgagattggtgattccaacagccacagcaaaatgtggaagcagcagcagcagcggcagcataatacttataggctctggataacaaaactttcccttgctttctgaaggaatttgttactaaataatattgccaccttctatttgctcaaccagactttccaacacttttgtaatcaattccctggattgaagttcctcttttctgagtcatttctgtttgtcttggcattgattaatataagcccatactccaatatatgcataattatttataatatacatacattactacaatacatacattacagaacatgcagcaatagatattttaaaagactgaggtaaacaagaagtaaacattctaaatttggggctctgtttatcaacaattttaaaacattttgctcttactgaagagcaaactgctcttgatgctcttactgaaaaacattaaaacaaaaatttgagtaaatatgtgtcattctctacgtcttggcttggttttacactttgtaaaacagtcatctgaaaatacagtactattttcaggttacttagatataatggttgtcatgggtgcagaggaggggtggtggtaagttgagggagaaagcctcacaaaatagtaaattcaaatggaagaagagtatcaatggctgtgcttactacatcaaaataatcaattttcaatattaatggccaattatgtaaaatactttgttgaaatttagctagtaaatttccatcttcagatgaataagtcattcctataaactaagaggtgtagcgttttattttttaacaaaaggattttaaaatcaatttaaagattacatttgaaagatcttaaagtaagttataacattatgttccaagttttacaaaatatgccaatatatttttgtacaattttcaatgtatatagaaactagttttacaaatacattggtttttggcaagaaaatcacattgtaatgaaaagaattacaaacattcaatatgaaatgttttctccataaccacaggtccttcaaaaagcagttaccttctcactcattattagtactactactttaaaaagacagatcgaatatgttatttttcaaaaatatacattagagcgcatagtatggacagtcacctgtcataacagaaaaggtgagtaaaattagaaccttgtcattctgtaaaagaaaaatgcataactgccataaatttcttattacttctcaatactctaccactggataaccagtgaacctcaagtggtgcaaatgatattcatggcccattctccatcttattacaaagtatcataaagattccactaaaattttaagattctttcacatttggtaacatatttttgactacattttaaagctttaacttaaaaaacgaaaacaaagtgaccacatcaatgatgtcctacagcacttgtgtgtacttgtgacttcaatttatttgttaaaatagcttgtctgtaaaagactgaagggatttcatgtgtagaagtagttctgtaacctgcctcggcaagcttttttctattccattcaaatcgaccactccaatattctaaaactatgtaactatagataacatagattttcaagaacacactgttttactgtagggcagtattttgctgtttagccacaatcttctccagtgattattttggtgatttataacaacatagttcttcgaattatttcaattgagcctagcaaatatcattggatgaaatgttagaaatattggtactttcatttaactatatagtaaacattccacactgcataatttgttcaatacttgtttttgcaaatcttcagcaatgttttctatacatattctagcagtatttgctgacaaatgtgatagtttgttgccatattatttttcacacattatttcagccattattgctcttgaagaacagtgtttccaatggtaaatatgtttgtattttaatattgttttttaaatccccaaaagtcttctaaatattaatttaatgattttgtaaagtctgtactgagtctcacgtgacattaaacactgcttgattcatgatctaggtagttagattttaatgccttaccaatgaaatggtcttccaccatcgcacaccatacactgagggtgacattctttttcaatgacagtgaatataaatcatttcaaatagacttcttgattattatttttgatcaatgttcaaatattgctaaatcatcattgttcttactttataatgtagtttacaaagtgttcataatatgtttcagggatgttctttttcaaatgggcttggattattagtatcatcttttctatgctttttttcagtcagttgtctgttttgtaagagttagttttagttaaactaatctgtcactaatctgtgactccacataacaaggcacagataacatttagtagctccaactctttaacaaactccactctctcccatcaggatgttctgtttaagtagcaatgcatgtaaataatgctctgatattgcccagctctatctgggcatattaactgctggtaactttaacttcttagattttttaaataaaaaacacaaataacaatttttatttcctctcaaaccctaacgcatcatcttgcatatttcttggaatgcatggactttatttttgaggccactattctacagtatgggctttggactcagattttaaaaatatttattggatatgtatattgaagcaggttacttatccatgagtctcatatagcttatctataaaataagaataactatatcacagaactgtttgataactacattagattgataataagagataacatttttgtgaacatacaaagtgcaaggctctagtcaaagcacacaaaatttattaattcttgagtatggcgtctacacacaatgagcatttgataaatattagttttcttccccaggaaagagagaaagagaaagaaagagagagacagagacagagagaaagaaaaagagagcaagagaaagagattaactgttcaaaataagcaatatttattagggcaaataaagttggttgtttacatgcctatctcttccacaaaaactcaaggctcctaatcatgctgtagtcatcatgtatctgtattcaaagtacaaagatctgaatatgttatgtgctcaacaattaaataaatattgttaagtgaatatacatagggtgacaccatagcttgctgtttattatctgtaaaaattacagcaaatccagcattgacaggatgttcaattaactgcacaaccattgcaaaacatgctattgtttttgccaaattctattatactgttgcagaaagtgcagaaagggtaacactctccagagcttttgaaaatacagtactctttgattatttatactaacagatgggacataaggtatggataatccaaaaataatttgtttggattttgaaatgtgtttttatatttatatctaagcattggcatacctaatattctataagaatgaatgtactttgaacaacaaaactagagtatgaaaagctgacttagaaaaaagtttaattttaacacaaattagtttctcttatctttttccttaacacttctgtgtaacctataccactttgattactccagctacatagaactcaccttttcccagaccttatcagattatctaaatgttggtttctacaggaatattttctgtataaagcagggaattctcatcaataaatctgaaatcaagtttgcctaggtattattaaaaaacaatcaacagaaatataaaatatgtcatctgcttcaaaattaggaatttttatttttaataaattattttattcctttgtgtattacaatccattaacgttctccacaactcttttttttttcagttaagaaaccagaggtagagaaaaactagcttgtgatatacaatatttagttatgtaatccatctgatatctcacaagttttcctgtcaaattcatagtgctcttatttttttaaaagataaataaattattgtgaaatgtttaaatatagtaaaaggaggaataataaatgcaaggcatcactgtgtctcaatgagaaactgaaagattagcttttcatcttactcttaattattcatgggccatacactctatctctaggtgtatgggaagcagagtgcttcggtagaaagaacgtggcttttaaagtcaaagcctggatttgaaagaagcttccacattcactacctgtgaccttaaacaagttactatttttccagaatttcagtttcctcatagcaaagagaaggcaaaagtattaaatgagaacatatataaagtgtttaacccttaggaaatattcattacatagtaatccaatttctacctttcttcccaaaccagaaattctcaaattttgttgtattgtagatctcttttttaatttttattttttagagatggagtctcactctgttgcccaggctagagtgcagttgtgtggtaataacttaactgcagactcaaactcctgtgctcaagcaatcctcccacctcagcctctgcagagtggctggaactacatgtgtgtgctactgttcctggtttgtattatagatctcttctaactactaatgattcacatcaataattgatacttctctatcacataagttataaaatttcttcacataaactgttgaattaaatcctcactgtcactctgtaatcatactttaacctaggtcaaccagcgcacttaacattccatcaagcctgctcccctattttaaaaaaaaagtcctcaccagaactaaccgttttacactaagaaagtgacatctaatgataataaatattattaaactatttggctaggtctaaataagagcatattcacataaatatcactagtggttctaggacctaaaactttacctggtacaaatttttttttttttttttttttttttttttttgagacggagtctcgctctgtcgcccaggctggatggagtgcagtggcgcgatctccactcactgcaagctccgcctcccgggctcacgccaagtacaaatgtttttgtaacactttcctacaaaacagcttatgaaacaaattaaagaaaatatgctcacatgaaaacttttaatagctattatgattattttagaaagagaatgaccctcaaataaaatttagtatattttctattctttagtaacacattaaatttcctcagtataatttatttctttgaaaacgatattgaaaaaatagataatgtctaaaatactgggtggtccatcaaaacaagatccccacttaacctaaccaactctgagagaatagttggttaatcacttagattatcctagggccacctctcaagaccacaatttaaaaatcatttattgatcctttaccttctcttgaatatgtttcttactaattagaaagaaacagagtataaaagttaaaggtatgtgggttctgattcagattgcttaagttcaaatcttggctttacttttaaatgaattccttaacattattaacccttttgtactcatcactaaaatgagggaaataaaaggacctatattatagagtttttctgatgattaaataagataattcaagtactggtaataaaagttgctaaaatttatcaggcattttaccatattcagacactgtgctaaatattttatacatattatctcatctaatattcacaaaaccctgtataatatatcttatagatgagaaatgtgagatccaaggtgccacaactcatacaccagaaccatgattaaagcacactaatcctacagtacaaacacttagtgctaggtacatgggaagctcaatgcctggcacatagaaagcattcaataaattttagcttgtgtttatttctattttatctaaataccaatttatttgaaagttctaaattgaataaagtagttctcaaatattcaatttcacgattccgattccttgcttttaccgtatccaaccccactgttctaaaacagagagagagaaagcacacaagcaagagtgtaatactgtgaattacttatatgacacttagctaataaaagtcaatagatggaggagtctttaatgcatattactaaatgaaagaagccaatctaaaaggctacatactgtatgattacaacaatatgatattctggaaaaggcaaaactatggagacagcttaaaaaaaaaatcagtggttgccaggggctgggggagagagggatgaataggtggtggacagataatttttaaggcagagaaattactctgtatgagtcttataatggtgggtacataatattatgcatttattcaaacccataaaatgtataacgccaaaagtgaatcctaacataaactatgactctgggtgacaaagatgtagaaacgtagttcatcaattgtaacaaatgtaccgctatgctggaaaacgttactaatggtggaggctatgtatgtggcggtaagatgtgtttagaaaatctccgtatcttatgctcaaatttgctgtgaacctacaattgctctaaaaaaaaatcaagtctattaaaaaatttatcatgtagtagatcttgtataaagtctcaacaaatatcaaagaattaacatcatacaaactctctaagcacaagcaacttaagtaaaaaattaacagaaaaaaattttttgagtcaataggagttattttgggaacaaaacacaaagtaaagacttgaggggattgaaaccatcaggatgaatgtaagccagacgggggcaaattgcagaatgtcaattgccttaacctaggaaaggtaaatttctaaaaatgataccaaatggttaaaaatcactaaatgaggaattgaagagaatttcaggttagaaggttgtaaaaagtgaaataattgtccaaagtcaccaaactagttcacgagaaagctggaactagaaactcatgcctctcaatccagtgttctttccactgtaacagattggcaccatagaacatgtttgactcaaggcagtaaattaagtacactgaagaaaaagataagaaaaaagtgataaaatgtaaagtctttgattcagacccaagtattacagctgctatggcaaaaaatagccacaatttctaagtgactttaaccaggaaaaaaagaaagagatgagatttgaaaaggaattaaatttcaagaatcaacaggaagtgatgacagccttccctatttggtagtttcaggcctgaacttttgtcattaaggtaataattcaaagtgctttaatgcctggactgaccacactaaataacaaaattataacccgttgagctacggtcagttttataaactgtgcctaaaatttcctgagttcaaatctgattataaatgggcaataaattcatctgttcattgggctgatttactttattttctgggtgcatttaaaatcttttttattgtggaaactttcaaacatacaaaaagagtacataataaatgattcccttgtacccatcattcaatttcaataagtcacattttgcctttcaaattttacctattgccactaacatcctttttttttctggagtagctgaactgatttaagatgaaggaggaaaaataaaggatgaaaggaatattttcaatctgttattcattgatactctagccaaaaagattccagattatgaggcaaaaagaaaaaaaagacaagagtcaagaagtcaagaataatgaagttgaagtctactagtgagatggtctagatgcattacttcaaaataaatggaactattgtctatgggggaggagattttaacaaactattttccaataatttaagtttgaccaaagaaaaatggcagagaatgttgtaaagctttattgatattatagtttatagagatgggcttatcttcaaggaacataatgattaatcacatcatgtttaaattcatataatcgctaacttaccatattccagtaagcacctataggaagaaaagtttgcactattcataaaatttcaatataaccaagtcttagtttattcttaaagctcaaagttcatttttatttcccttgaagtctgtgtttttctgtacttgagaaagatctcctcatttttaaatttggaaattttaaattagaatttaaagtgactttggtcaagttcagtggtcttttttaagtaatattaataaaattacatatttctggacctcgaaggattcttctgagcatttagaatcatactgcagtttccagactaaacactttagccagagactatgagaagcaggcaatgaggcaaatacaagcatatcgaaattatcttgatcgaaaagaaaatgtggataatgttatgctgaaccgtcttaatttctgtcatgaaacaaaggggaaaacttggcaagtaaagatgagagatgaatttctaatgggggaagaggagttaaaactgaaataactagtgaggcccaactaaggttttaaagcatgaatctaaataccaagatttttttttcatatttggttcctccctattgacttttgattgcaagaccaatggacagcgaccgtctaattctcttctcttatcttccttagcaaaatgttagcatatagctgtctcttgcttcccattctcccttaaatgtaaaaaagttcctcaaccaaaaaattacttcctacatttcatataaatcaagtcaaattatgtctccatacaatcctatatctctgaggagatccttggttctccatggattttaattcagtcaaaatgtgtcacagtccctcagtgcctttatttgtcctgcctctccataaaatctaagctctgccttcccattgaacatttgtctatgaagactttctatatattaatcctattcttcatctttctgaccatacattcctaaaatggctacacatcctgattaatacatttctatgcattatagattacccattttaagaacctcagtgtccaccaatcttcatcacctactggcaatcacctttccacaagcctacattgacatagctatatcatttaccaactactgctcactcctccaagttctgccttgtctacagactaattttcagagtcaaacacccattcttgaggcaaacacgtattaatcaaaaggtcagaacccagtaaattacctggaaactccaatcactgtgaaaaacatgcatgatttttcataaaggtctaattattgctctttttttcaaatgatctgtcacaggctagttctgtgtgccatgctacaatacacttctttctatggcatccacttgagctcagtgaagattcttctattttctcaaatttacattcccctaagatatttggtcagcaaagatgagaaatattaggactctcattaaacattagcactttgccattatctcttaatatttttgtgggcacctattttcattccatcccagaaaaacttctttccctataccattttcccttcacataatttaacaatatctagaatagcacattaatagttgaagatgttctaatgtatgaattattactaaaacaattatttacctatctgatcatataatttattttagaaatcaaaatagacacagagaatagaaaacaaaagaagtaagcattctagaaacacaaaagaattaagaatggaggcagattaaactgtcaaaaagtgtttctttactagaaacactaagcagaatgcttgtcaattctctgacaaatataccactttataagctctggacacctgagaagagaaaatggcaatgactgagggaagttcctccagccaaagctaaatatgacctaagacctgacatatgtcacatacacaatcaacttactgctcaaaaccagtaaacacacatccaatccatcatttctaaggcacttgtacatatttctcaacggttatgtaccttatattctttattccaagactggctttgatgctaatgtttgacttcattctcctgaataaaaatacgtggcactagtacaggactgaggagaggctggggtttctaaactatcaaaaagttagttctgtttaaggataactcagtaaagatttcacaaggcagcattccttagcactacccgaataaaccccacataaacaagctaccaagccacctgaccactcttggcctttgtttcctcatcaataaaattaggataataatgttaactacctcatagtgttgaaaagaaccaatgagttaaaatatgttaagcacttaaatgttgtctggcatgtagcgatattaaagagctaaaaatggtattaataatacctgaatggatgttatttcattgagtaatttagatttatacaaagttgctaaaaagtaatgtaagtgaatagtatatgttttatgctttgttaaattaagaaattatgatatcaacttagagtcttaaatatactgaacttgtagtagtattccaattgaattagtttgaatattataaggttgccattacattttgttggggcttttttcctttttatcccacaggttgacatcatcaacaaatgtaagccaaacaaagcagttactgtaagaaatgctttaaataaacctaaagacattttaaaaaatacatatgcattgataactaggttgtatatataaaaaatgaagcatgttctttctaaattaaaatttagcttggggaggagtgtccgacctttaagaaaaagataaaactcaagaaacaaattgtaggatacttgcccaaccacatataaggacttactgtaaagctgtactaattagtaaaatgtgttactggtatagagatagtccaatcaaccaagaaacagaaaacagagcctataaacaggcccttgcagatacagacccctgacagacaagagctggcacggcaaatcactgaggaaacacaagaacatacagtaaacataactggaaaacatgtttctctatagaaaataatttaaacttttatgtctaaataatatacaaaaatcaactcaagtgaatgatttaagaaaattaaaaagcatgaaccattaaagaaaatctgtatgagaacataaaaattaagatttttatgtttattagaataccctaataaacataggtaaacacgagtttacctataaacaaaccctgtgacacgagtttacctataaacaaacctgcacatgtacccctgaacttaaagttttttttaaaaaaaaaaggaaaatgtgatatacaggccaggcatgctggcttatgcctctaatcccagcactttggaaaaccaaggcagaaggactgcttgaggtaagagtctgagaccagcgtgggcaacacagtaagaccccacctctccaaaaaaattaaaaaattaactgagcatggtggcatgcgcctgtagtcccagctacgcaggaggttgagacaggatgatcccctgagcccaggaggtcaagacaggagtgaaccatgattgtgtcactgcactgcagcctgggcaacagagcaagaccctgcctcaaataaaaaaaaaaaaaagaaaatgtgacatacatacacaatggaatactattctgcattaaaaagaagaaaattctgtcattgtgacatcaatgaacctgaaagacactataccaagtgaaataatccaggcacggaaagacaaatacagcatgttctcactcatgtgggagctaaaacaatgaaactcatagaagcagagagaatggtgactaccaggagatggtgggtggggagatgggagagatgttggtttaaggatataaaatttcagttatacagaatgaataagttcaagagatgtacagtatggtgactatagttaataacaatgtattgtttgcttgaaaattgctaagagaatagattttaagtgttttcatcacaaaaatgtaaggtaattgcatgttaataaacttgatttagccatttcataatgtaaatgtattctaaaataatgttgtacattaatgcacataattgttgtcaattaaaaataagttaaatttttacatgtagaaaataaagctaataatcattttttaaaataatacacacatacatacaaaaagaatgccctaaaagaagtgaaaagacaagctacaagggagaagagatagaattagtatctataatataaagaactcatgcaaacaatagaaaaagaatcatacaaatttttaaaaagaagaaaaataggtataagaaccaccatttcacagaaggaaaagacacatgtaggaaaacacacatatacatgttcacagccttgtttcttgagaagcaagaaagttcacatcaagactactgtaaggtattttttatttactcaggtggcaaaaattaagaagtctgacaataccatatgttaaagagaatatgggtcaacagggatattttatacaatgctggtgggagtgtaaatggctaatatcattttaggaaaacaatttgacaatctcctgcaaagtagaccatttatacatcttatgacacagcgattccaatctcagaatatacctaaaagaatgtcctccaaatgtcaccaagaaacatgtgcaagaatgtttattctagcaccattcacagccacaataaaagggaaacaactcaaatgtccattggtagaagaaaggatagattatactgtggtatagtcacaaatattatatagaagtgaaaaggaacctgtaagttacaattacacacaacatgggtgaatcttaatatcttaatgttgaaaaaaaagcaaattctagcagataaatacagcaggctattaatgagttattgagctacagctaataagttaataattggtattatttgtgaccatctgcaggagtaatattaaaagtttataagtggtaaagctgtattatttatgaaaaaatggaacaataagcacaaagtttaagatagtggttacttctggttaagggaatataggtgtaaggaaatgtgagttttgatgttctaatactttggttaggtcttggactcacaggttatttcttttgatttaaaataacaaacgaatgaatgaatgaaagaaaaaaggagaacacatggaaaaatgactatgaactatgttatgattcaccaattctgtgtgcttaaagtccaattcttttaaatgacaaatgatttagtagtacttctcacactttctgtacatatgaatgacttggagtcttgttaaaatgaatataattattctttaggtctgaagtggagtttgagattctgcattttaagcttgtaggtggtatgaatgctgccagtccaaaaaaatctatgttatctatctagtcatttccaaatatgaggtgctggggaagctaaaaagattgattgagactattcaaggcaacaataaacgtcaagccttgttaatgcaaaagtttaaacaagtaagcatttttattcagacaacttaaatcttagtctttaaaaaaaggaacagttcaggtgtggtagctcacatttgtaatcccagcactttgggaggctaaggcaggcagatcacttgaggttaagagttcaagaacatcctgaccaacatgacgaaaccatgtctgtactaaaaatacacaaattagccaggcacgatggcatacacctataatccatcccagctactggggaggctgaggcacaaaaatcacttgaacctggaaggtggggattgcagtaagctgagatcatgccatgcactccagcctgggcaataaatcaaaactctgtctcaaaaaataagaaaataaaaataaataaattttaaaaaggaaaagaaaaaagcaaaaccacctccattgttttaagactgagcatcagtgattcaagaaattcagagacttgaaggagaaatcaaataaactcaactgaccgctgaataagataacaggtgtcatattttggaatgtttattacaatgctaagaaataattatttgatttctgtctattccaaagagaagcaggtcttgatagaagacaccagaattcagagtttatgttgaaatgaaagacacttctttcctaaattataagaaactgaaataataagaattaagagaagatcgctttggtttcttgaggattaaaataaacagatcgctttaatttcccatttccttggtgttctctacaaaactgcaactagcaattgggacagtgatcactggtggttagaaattttcttgaatagagaaagaaaaaaacaaaattaagagatgactggcaatgacatatgcatccaagaatgcacgcaacatatattaataggtcctactactcgagtaacattagtattattgagaaacagtgaagaaatatatttaaaaatatgtctatctcaattgctattaatttcacatttaataaagataatcaatacacaagtagaaggtgaaaacgggtttgatttattacaatggattcattacgtgaaagatataatatcaaagagaatcagttgaggtagttgtttctactagccttgcctaaagtccatttacagaaatgaaaagcaaagattgcctgcatgtagtgactcacacctgtaatcccaacactttgggaggctgaagcaggtggatcttctgaggtcaggagttcaagatcagcctggccaacatggtgaaagctcgtctctactaaaaacacaaaaattagctgggtgtggcggcacatgcctgtaatcctagctactcgggaggctgaagcatgagaatcgcttgaacccaggaggcggaggttgcagtgaaccaagatgacgccactgcactccatcctgggcaacagtgcaagattctgactcaaaaaaaaaagaaaagaaaagaaaagggaagggaaggggagggcagtggaggggaggggagggcagtggaggggagggaaggggaggggaggggagggaagggatgggaagggagaaagagcaaagactgttgttccttttaagatctacctttggcagggcacggtggctcacgcctgtaatcccagcactttgggaagcccaggcaggcagatcacgaggtcaggagatcgagaccatcctggctaacacagtgaaaccccgtctctactaaaaatacaaaaaattagtctggcgtggtgtcgggcgcctgtagtcccagctatttgggaggctgaggcaggagaatggcgtgaacccgggaggcagagcttgcagtgagccgagattgcaccactgcactccagcctgggcgacaaagcgagactccgtctcaaaaaaaaaaagatctctcttttcagctttcttataacatcatgtctactactggaagaatagagaatctgaagaagattaaactagttaaacatattttttaagaatatttatgaaaaaagtaaaagtcaaatgattagggaaagaaaattttaaaatggagacatactttggaaaaagagtccggtataatatatttagacttagacacattcatccattcaattttctccaaaccagaatctaggtatctttaatagtaccatacggtacagactatagtgtattaagatgatacttacgtttcttattataaaagaacgtctaagtttttagacttttatagtggtgttatcaaccaactaatgtaggtatttcctaatactctcacaaccaaaaaaatggccaatggcaaattaggtgtctggtaactgaaagatcataaagattttactatttcaaagcatttatgctagagtcacttttaagtacagctataaattacaaggagataatttccaatgaaatataaaacagattacaaagctgtatttagctgtctgtggccatttaataagtcaaaacataatgcagcattatcattacgtcaagatgtgacaaaggcccagacttcccacaaaatattcctgtctctatactagaataagacatcatcagaagtacctgaataaaatctcccctcaatgaccagaaaaataaacgaagaaattttagagacctatcttagactttcagcgattaaatgtactcacaccttccatgcattccactcttctatctgttggaggtttatatagcttcatcagtaatatgttctattgctgacatatcaaaaggcttaatatcacacacacagcttcaaatatatatataaatgtccattaagtgtaaaaaatgccttcagattttcattatcatcactgtatccacatcatgctttttcaagcacttcaacattattttacttgactctcacaaagattgtgtaactgaggaaaatatctctattttaaagataaagatcctgagatacaaaagtcaagtgatttgcctataatcatattctatgctgacttctagggtttttttcatctaatatctttaaattctttcatttctgcattctgttactttgttgaaatcattattgtacctgtaatctattaggtcaaatcagcaaatatttatcaatcaacttctatgtgcaaggactcaattaatgtgtaattggcataattaacttatttgtgacatcaacagggataatattaaaattatttaacaactgacacaaaaggtaccaactaaagaaactgaacactgaacaaagtgaaacatacgctctaagttttatcaagggatatcaactgcatgtcagctctgatgtgggcatgaccaatagagtctgatttaatcacaaactacaaatcatttgtagatgtttatttggcctgaaatgctagaagaacatctgaagatttaagagaacatgtagaaaattctggtagcacgtggtccaaaattaacttaaagaaaatgcaaatataaaggaaaaaaacaatctgcttgggtgccaagattcagaaatatgaactcattactaccaaaactagccataatattttaaattattttaatttctttttttgtttgttttttgagatggagtttcgctcttgttgcccaggctggagtgcaatggcaccatctcggctcaccacaacctgcacctcccaggttcaagtgattctactgcctcagcctcccaagtagctgggattacaggcatgcaccaccatgcccagataattttgaatttttagtagagacagggtttctccatgttgctcaggctggtcttgaactcccgacctcaggtgatccagctgcctcggcctcccaaagttctgggattacaggagtgagacaccgtgcccggccaattatttttatttatgcatttatattcaaatatacctaattttaataaaatacataagtggggttttgaacatgtttttagcacaacttttcttttcctttatttcttgggtatctgctcctctcctttcatatttcctctcataaatagttatccatttttataacttagtatgcatcctgctacattcttcttcctttaaaaataaccctactataaggtagatatatacatatgcagatattacttataaatatacatattcaaggatctttgtaattattttttaaaggctgaatattatacacacttttctataccttgctcttctcactcataagaaactcctggaaattctttcagaagatctgagatagctttatttcacatcatttaatgacagcataatagcccatggttgagtttccattatttactagcattaccttgttaatgggattactattttctgcagttttaccactacaataaagttacaacaacctggaaaccaaaaaatacacatgttcttaaatattgctacctatatttctatggaatatattcccaaaaatgagactgccaggttaaagtatttgcaaatcatatgcaaattataattttaataggtttttggtagtcttacaagactgcattttataacaggtagaatatatcacatttccaccagtaacaaatactgttaaggtgcaaaatgggaatatactttcatttttttacatggagatcatcagttatgccagtcccattaatttaaaaaatccatcattttccaactaagttgtcatctttttcagaatttgccaatcatttccactgatctattatgtatgcctaggccatgaccatgttgtttagatgagctgactttgtaatatgttctggtatgtgtaatacaagtccctcctcattgctttttcatatttgcttgcctttcgttaccatttaatcttccaagtagttttaaaataacactgttgacttcaaaaaagaaaaaaaaatctcccaagattctaattggaattgcattatataatttattaactttgaaataatatttttattgttttcccatcctaaaccagtttgtccttctcttaatcagatcctgttttatgcattttaatatctttgttttcatatagttcctgtacctttcttgaaaaacttattaataggcattttgtaatttgtgtttctatggaaaatggaataatattttcccattgggaaaaaaagtctcatagatgcccaaattcctccagagcagagttgttttcatcttatcttttatccaactaccttatcaatttttcttactcatttttctagattttaaaattcaagtttctataatttttagaccatatatcatcagcaagagacacctgacattcttctctacaaatgttaatgttatatcatttaccaactgtatatgataaagcctctaaaataatgttaaataattgtgatggttccttgtttagtttctgttgttaattaaaatgtttttaggatttaacaatttaggccatgtgcagtggctcacgcctgtaatcccagcactttgggtggaggctgaggtggcaggatcacttgaacccaggaggttgaggctgcagtgatccctgatcatgccactgcactccagcctgggtgacaaagtgagatcctgtctcaaaataaaagacaaaaaaaaacccccaaaatttagaataccttttgccatttattgagataaacatgatttttctcctttaatttgatgatgtaataaattaaattggtatatttcctattattgaatcatgcttacattcccacttaaaaatatattttaaaatagctactagtgagttattattttgattcactgttaatattttctaacattttccttagaattttttaatatacttcgtaagtgaaattatacattttttactatataatctttaacagaattagatattaaattatggaatattttgatatttttccatggcctagaatgatttaaattacatcaaaattatgtattccttacgtttaagtgacaacatctggtcaaatttctaatcttttctatgctaagtagcatctgctttctacttcttcttaggtcaatttttatcatttgtatttgactaaaagtccttttatttctcaagggttttaaatttgtcacacagctacattcttatttaacattcttttcatcttccagttttttcttctttttcatttctaattgtgtacttttgtcattctttttcctaaagctttattagtgaattaaaattcatataacataaactcaccattttaactgtattaaagtatataattcagtgacattcgcaaggttgtataaatatcaccaactacctccagaacattctcatcactccaaaaggaaaccctatacccattaagcagtcactccccatttttccttctcccagcccctggcaaccactaatctcctttctgtttccacctatatgcctactctggacacttcatataaatgaaatcacacagtatgtagccttttgagtgtggcctctttcactgagtatgttttcaaggttcatccatgttatagtatgtatcagtacttcattattttttatggctattatattgtatagatatatcatagatgaataatttttattccttcattcagcagttgatggatatgagttgcttccactttttggctactatgaataatgctgccatgaatatttgagtataaattttatgtgaacatatgctatcacttctcttgagtatatacctcagagtggaattgacaggctcattttcttttttgctttatcatcttcacaaggagtttatgtatcacattgatctttccaaagaaccagcctttagatttatttcgggttttactatatggtttttctatttcattactttcatctttctaacaatctcctcatcttctatcttgtattattctttatactaacttcttaacattaggttatctttatcttccctcttccttaataacaaaggcctttaaggccatcaattttcctctgacaactattttagctaattttcattggcttttacaaaaaatatttccttttcattgctttctaggtgatttcctcttcatccaaaagatatctgggaatgttttaatttctatgtagatttttttaaccttttagaaaaactgttaaaatttgatatatgttagcttacagtcagagaaagtgcctgcaaaatctctgctctctaaaactcagttttcttagcagccaagtgcagagatgctcaaaaatatttaaagaatgtcccactgtaattcctattattcacgttttgatttctagatctatcctccaaatctcatcttttttttttcaatatttcatcatgggtttttttatatgcttggatacatttcttgcatttggtcttttcattcactaattcatatttcgacagtgactatgctctcccacaaatcctgagttgttcaaatgagatatatttaatatctgaaattattttctgttctttgaatttccttaagtgctcccaatttttgttttcaaattcagttttcatgttttcgccagtagtcctagttacctggagtgtgtactctgattttcctctctcacttgctatgggtctccttaaatgaattgctatttttcgctaactcactggagctcaggtctggttgccagattatcctaaatggcagaaatatcacaggtggtgaaaagcaaaggtaaacagcctgtcagttccctgcaaaggcacatggacaaagagctctgttgtcctatctctatttctttttagcctccaaagacagagaggactccaccaggacattcagctactttagctttttagcagctagcgacacttcggtacttaaaatggataaatattgatctcctcctacaggagttcacaaacctctaaagcccaagctcttcgtcccaatgtctattgctttctcatatttacccatggactccagcaccattctccagttgcttgcccaacagaaggcagaagtttcaaagcagtgtttctctgcccaaggtgtcatgacagttgtttataggtcacagcagccatttgcttcagaaagccaggcagcttggaattggaagtgaagaagataaccatatatagctactttgttttcaaagtctttaattttaaaaaagcctggggtggagtggggtatgtgggtgtgaggtatgtctggacttcattatacttattcctaagaatcaatagtttcctcagaaagcatattcctgaatatataaaatgacaatatgttcttctgcatgctctttagattgaaatcgtgaaatacactccagctattaatcactttaagtaagctttaatgcaatcccagttttaattattccaggacttaattatcttttgttttgaaaacaacttcaaatcaatttgctgtagtttcagttagaaagacaaattatgactttagccaatcaagtctgccaatgtctaacaagttttataaatatgaaaaagtatgtcagctatttatataggaattacatgtgtcccacatgtggtttacacgatgttaccctctatattgttcacaacccaactaccttttttgctttctagaagagctaagtaattatattatattatcactaatattacagtgtttaactggataagacttctaaaaactcagataattaggtaaaataattaaacctattttttaattgtgtgaaattttatgaacattccttaagaattagaaagctcatataaaaagttcaaaatctcaattgcaatctatgaattacaaagcatagtgtgctttgtttgtccctctatccagataggaatcatataggatatgaaatatgggtttcatccttaaatcagcagataatataattctgtgtactctattcaacacaatatcctgaattgattgtagtagatttgctttaccactgatgggagatacctgacacatttcttttctgaatcatggtaaatgtaattttattggaatttttgccatgatagaatttcattaagtacctaaaaggatagaaaactgtgagcatgtacaaacacgttgggtcttggaaaagtacagggaaagtctataataggtaataattttaacaatgctaaatttgaactccaataagtaaacggatagcctagtaaggaaaaataattttcccaggataagtacaaaaaagcctgatcaacattgaattcctcctgtgtgccagatattaggctaaggactaaagctataaagataaataaagcatggtacctgttgttaaggaactgcagttaagtgtactataattctaaatgttacctttcctaagtgatgaatgtcaaagaatttaagttataagttaaactgcatataaaacatcacactgaatcaaactcactttacaccagatgcacccatttgtgcattataaaactcatcattacacatataagacagaaacagagtaatgcataccccaaatgacagaaacaaccatttatttttggctcttatacactttggtaattcgcttaacaacaaatgttgagactgtaatgtagaatatttgaatcagaagaacctagaattttgttcatttttcccatactgcttttcagctcaaatgacccctttaacacagtattgccttgctctcaatccctttctaaaacaagaaagattattaaaaacatgagtgttcaaaggtatttctctgagggtcagatgtataaaggacagtgagatacaaacaacatagctgttaagaacactaggtcccacaggctatcaaaattacaagaacaacagagtaccaccgatgatgaacttgaggagaaaggtgccatgcactaactgaatgttgataatttttctaactttaaaatacatttttcagtgatgtatccatttgaattatataaaatgattattatactatacttcttaatgcattaaaaataagagaataaagaaaatatcagatattctcataaggaacagtaaagacacataagggatggtatagcaatttcattattctttgactgcattcagatgatacagcttatatttgtaatatagcttaacagtaaacattatcttttgaaaactttttaagtttttagtaccttgtatacaaagggtatatgagtatgtatgtatacatgacagaagtacttggttggaggtcatttaaattatctgcaataaaaattcactttaaaggttactataattccttttaattcatgcatgctgactatactaaatataatccaaagtcatgtacactgactttacctgaactgatttgagactactactctgatagaaatgcatttacactatcagataaaattaaatctttctttcagtatagtgacaaatcaaggaaaagttaaagtacataataaaagtctagactgtattccactcaaagcatagtagaggctgttttaaaattccatgaatatgggaaggaggagacaaaagctaaattccataataaataaaacaaaattaaggtatataatattttacccctcatatccatcacatcctcaagaaagttaacagatgttttcctgtttttgaaaattggacagcaaacaacaatgtagattataaatgttcctagaacagtgatttccaaattgggtggcacacagtaggcattcaataaatggcttaccacacagattgtgctacattgcatatctttgtcatgcacttaaacttactgcctaactctaggttaggactgatgatcatgtttttgtgccaaaagcatagcagtctttgttttcgaaactctcagtgacccatatttaagccagctattggtttctgaaacaaatgttaagggcacaaagaacaaacaaacacaaaagccttccaaagtcataggatttgctaccctttgaatatactgtttctagtctccctcacccctatttctgcatgatacctggttcttggttattcagtcgggtttgatttagttttcctttttgacctctaccttcccagaactttcagtaatacttcctttgtcctgctcctacccatgatttccaaggcctgctttaacatggtacccagctccactgttgcaaatagaactaaatcaggcagcagttagagtctattcattgtacaacctttagacaaattctctatcatcatttttaattctagactgaagagttatattttaaaaagattctatcacagcaaccattgttcctacttacaactctttcaccttgtacccttctctagaaccttctccaaatctatgcctttctgaaataaaattgccattattaatctgggcaagcactgagttaaaatcgtcccagaatagtggtctgatggggtggtgattaagagcttaggttctccagagctgtacttgagtttaatttcccatgtgttttatacttagctgtgtgactttgaacaagatacttaccctttctgagccttcgcatatctttaaaattgggataataaaggtacctgtctcacgggattgtggaattaactgaaaaaatgcagatataaccaatgactgcaacaaagtaagatctcagtaaatgttggctactattggtgttggtggtgtgattagtattcctgtttaatacaaggatagaatgcatttacttttcactgtgcttcccactaataattttgctagtctttttggtactcatggctttagaagagttacagtgattcttcaatatgtatactgggtttcagttaacactaaaaccagcttcccttaagcacatttagaatatcttttccattatttgcatgcattgaagcattcataccaccttttgggtccaacaattgatctaaaattattcttacaatttctcctgattagctagatgtttggtaagctaaaatagcttaccatcatctaacagacagtatattttggctacgaggtgatttataaaatattatatgatcagtaccaggaacatctggagctgtgggtggatgtgaggaaatgagaggattcaggatagtatagcttcctgcagattgctgtttccatctaaggtaatgttagatagctttaagcctttcactaccattcatactagcaaaaaggatgagtcaattaaacagaaactgagagtaaaattttaaattagaactttgaggttatcattaaagatatatcaagtaggtatatagaaattgtatatagttgtttctttcaatatataacaggacaatatttgcaaagtcttttctaacagattctttcctagtcagatttctttgcctaccttatcttccttcctatgtaaatctatctgtgcatggatataatataagatcaaaaactaaatgcagtagttaaaaattaccaattttataagatctgcatggaggtggttcctgattactcaatgtatacctatgttttgcttagagaagagaatcacaaaaccaaatttatcttttatctttgaataaatgtatctatctatagattttatagaaatagaaaaatgtgagttgattcattctgttgttacctgcatcctcaattttaacaactttatgctgcatgaaatgcagagtcaagtttacaaattctattagcaatacaccttcctgagttaagatgagttggcaaagtatttatgtaaactaatagatttattatacttacccactatgaaagattataagtacttaatatcatatatctatactttactagtgtgctatgttagaaagcatgtatcattaaaattaaacttttataaaagactaaaagtggaaagcaaagtcaagtattttacatatactgtttctaggtgtcctaagcatcagtttcagtaacactaccagaagctaaaataacaattcaattgttgaaggaaacaaactcagatgattagaactgaaaatgaccctaaaaatgaaaaatctaaggtgctaaggtggagatccgcatagattatgcaacatgccatagatcatgtaactaattaatggccgcagtagaactagaacaacctctactaacttcacatctgagatttttgacaatgtataacaaagagttgaatttaatatatgagagattgaaaaggtagatattgtccccaagttaaaaatctttggatgtaattacttctacttacttaattttatattcctaagacgacacatttaaaatagcataaaactgtaaaaactcgttagaagtaatgaaaactacaaacaaaatttatgctttatcttaaatcaaaaccatggaaaaggccattttcttttgtctaaaggaagcctgagatttactgaaaatgtgtgtgagtgcgagagagtgtgtatgtgtgtgtggtggtggtaggggtctttgttttgttttgttttgtaaattgttagagattgttctattaatagtttccttttgtaatggtaatctgtgctccaaaatgagggcacactaaaatgaatttctgataatttataaagcagtgaaatacaaatacatttctagaaacttactaatgacagtaagaaaatgggtaccaagagtttcaaaattaaaaatcaaaatctttttaatattatgttgaattagaacatctttttaaaagccaaaagtaattgaaaagagattaaattggtacactcaactctctaaactgtgtgtatatttttcttaaagtgcatatctgtgagctgacagtaaagacaggctggctgctttgtttgactatagttctgtttacctcatactgtcaagaatggattttgacacagtattaatattgctatttttattgatataattagcactgctataaataatttcttgtgctgccatatgtaagtatatcattacaatcagcagtatttagtgcttttcttatatgacaccttgaaaacagactgttggcccaaagaacaaaagtgacctcatgatatgggaatcactgaaaaaaacattgccctgtcaatagagactactgttttgtgtatgacttcactaaacaaactagtttatatttgtttgaaactaaagtttctcaccaatctgctgtttcaatttcacatcacaccatattgtacctaaaacaggcaatctggattcctgttgctactttttcttcccccaaacagctcaggaatgggtttgaaatacaaggcttgaatacataaagcaaaataattaagacacccaaaattcagaatgggtgggtgaaaacaagtacacttgaaaccatttgtgtaactactagtgggtggcccactgtgagtttttgattatatgaaagcaaaatcaaaacatattttatcttgcctctagatcacatcagctgtgacaataacctcatctggaccttgaatagtttgttcataaaacaaagtagggtgactgacccagtgcatattcaacacagagtatgaaggccaaaagaaaatgacaataccattcaaaacaagtttgtggaaattttagactagtatattaaaacctttctttgtctctatcacttgacagatggttagccttcacacagcctagtatctctggcaaagaaatgactgtgtctagccaataacaccccaaattttgacttaaaatgcactgtacacatgcttagacttaccttacaaatatgaatattaataaacttagtcatgcttactttattactataaaaacttgatagatgtcaagatttcatcttctgccgttaaaaataccttcttgaaactcaactatcttaggtggatataaggttccatgaactctgcacttcagatttcattcatttcacaggttggctggtaatcatgcttaaaaaaatacttccaaaataacacttcatcccaaaaatataaaatttatagaaatttaattagcttgtgtttctatgctatccataggaaagttttggtaacaaagtggcttaaacaaaatcaccagggaaccctgaatacactccatgtcaaggaccacaggcaggactggaattatttatccagtattgatatgtctttattcaaaaactgctcatttataaatatatactcacacacacatgcaaacacacatcgatcaaccatccttaccagaaaacaggaaatggtcttactttttaacattcaattagccattcttccattttgctctttaaaaaaaattcaactgaggctgggcacggtggctcacacctgtaatcctagctctttgggaggccaaggcaggcagatcacgaggtcaggagatcaagaccatcgtggccaacatggtgaaaccctgtctctactaaaaataacaaaaaaattagtaggacgtggctgtgcgcgcctgtagtcccagctactcaggagactgaggcaggagaattgcttgaatctgggaggggaggctgcagcgggccaagattgtgccactacactccagcctggcgacagagcaagactccatcaaaaaaaaaaaaaaaaaattcaactgaaacaatgtattccattagttataaagtctgtttcctcctaaatcttcctatttatagttttcagatgctggcaagtccgtatacaaatagccagaggcaatcacaaactgctctaaagtgcattaatatgtacccttcctggaagaggctgattatgttccaaattagcataaatagagatctaatgtaggtataagcgtgacaaaccctccacggcacaggatgggagggctggaggagggaggattgtattaaaaaaagttattccacttaagaactaaacttgtatttggctaacaaagtaagactcaccatgacagatgggaaaaaaaattaaaaaggaaaaactgttatttgagaactatgaactaggttttggaaaggtgagacacccactacttgaagtcacaatctcagcattaaatcatatactcatttaaccaggtaccaactttccttctattagaaacccaggatttttacacctacagactaaatgattaaagtattgctaaaatcttctgtaatgttcctcttgcattacaaataagtctattaaagcagaaaagtgccaatcaaatgcttttgaaaaaatggtttaaataacaaagcattttttgcaggtctctcctctttaatgtcgcctataaactaattacaataaattttcaccttctcttgataaaatcacaactgaaactaggcatggtggcatgcaccttagtcccagctactaggaggctgaggcaggagggcggatcacttgagcccaggagttaaagtacagcctgggcaataaaaggagattcccatctcaaaaaacgaaaaagaaacccagaactgaaaaagatttaggtacttgatttttcagatatgttcctaaaaacaaatcccaaccaaaaattaacagatattctagcttttgttttaccatactttgctaacgggataatactatgtaggaattttatagtaactttcaagacacaagatttttttaatataaagcaacgttttattaatttcaaagacattattaaaatcatgaaaaaaatccctatctgttaaaattaccaactgaaatatatggagaaagtttcatgacaataacaaaaggtacaaataagaaataaactaagatctttctttcctatcactgccaactggtaaacaccttcctccttctcaaacttctgtaggctctttcaaactgtagttcctaagacaagaaagcagctaggttttaaagtttcattaaaaaatctcctcccctaacaatctaaaatgcacaaagtgtgtgtgacattagaatgtaagctccacaagggcaggcaattttctctcttgttcattattacactccaagtgtctagaacaatatgataaatttaaccatccatttcagaaaaatatgattatttcagagactaaagcaaagcccatcaatctctacttccgtattccaaatgtttttgaagaagtctctgcttgccactgattctgtgaagttattcaaaataatatgtaattattttataaattatagatcgcaggaacttagctgtagcttttattgcccttctaaaacaacctaattattcagactggcctttttttctagaaagtccaatttacctaattattcagactagcctttttactagaaagtccaatttgtctaaaaagtcttctgaaaactttcactaatgcaacaaaaatgattcgcttaaaatattttttccttagattttcttcctataccaagtagtcaaattcttattaacaggacaacaagaggaattagatgtttgcgggcctcaaaaactttctgatccaattatagaagaaactggcatcacatcaactggtagttctaaacacccccttccccaattatagccctcacatgaaagtttctctttcctctagtattccatttaatctcgtattttcttttagtagctagtcaatgtacacatgacctatatgtgcattttcttggttttgtagtaatcttaaaacacgggcctagatgggtaagcataaagacttcttcctggaaatggataaaatttgacaatttttaacctgatactttctttagcttgttaaaattaggacctcaccgtgaaagggcatattgctgtggaggctggtaggcagcaaacttgtcacctgatcttcatatgcacaaggcctgtattccactggtctataaaatctgaaatcataaaaccaaaaatatccaattgcccaactcactgagcagctaatatagttctagaaatctcacttttcttcttctcacctgtttacttcaacaccatgtgtccccaaacctaaggccctccaaaattgagctccataaaaatcaaaaccccaatcttgaaaattaagccttgagtactgaacagttacatcagcaattcctcaagggcaatttcaaaagctttcctgggagactactggaaagatggcacagggatatcaccatgcactatgtgtgcaacaactttgatatattctaagaatcacaaagaacaaaggcatgaaaatcaatgtaattttttttctttcactagaaaaatacagattcttcattttaaagcaaaaaagcaaaaagtagccacatcttgactggacaaacttacagttgaccctcagtatccatgggagattggttctgggacctctctaggaaaccaaaatccacagatgctcaagtcccttacataaaatagtgtagtatttgcatttaacctaatcacattctcccacatactttaaatcatctctaggttacttataacacctaatacaagtaaatgccatgtattaataaatcgttgttacactgtattgtttagggaattgtggcaagaaaaaaactatatatattctattccatctattcccccacacccaaaatatttttgatctgcagctggttaaatccacagatgcagaacccaggcacaggaagggctgactgtatgtgaccgggagtggagggggatctatataaatatttccacaaaatagcaaagggtacttgggattgggagcatgaacagaaatgaaaacaaaccattataaatttaaagatgactggttatcacttaaatttagtgtctacagctatttatttataaaatggtaattgtgttttaaaactttcaatggcaacaagttacaacagtaacttcagaatagcgttcacttgaaaacattgggtgaatggcctctataatttttttagctgaaatgtatacaccgccacgcagtgaggaaacttgactttagcacccttttggtatttttaatagaaaaaacagtggagaagattttcacatgtctagaaaggtaacatgttcaacttaggtttggccaatgctgattctgaggacagtactacacccgcaagcttccaaactacttcctgattcattcagattttcattggagagctgtcatcctgctactgacctcattcaacccagttcggagtgagagatcagcggattaccgcgctaggtaccgtagctgtacgccatattgtgtttttcgctaatgtttagtttgtgtgtgtgcctagcatatgtttgtgcaagtgtgtttatcaatagaacttttagaaaatccctgcctcctgcctcttcagcatccttaaaaaggataacagctgggggcggggggtggggggaggacccaaaagccacacagacaggaatacattaaacagtgtacgagagacggcatttgttttaaactttcaagaaccttccaaccatttttatatcaggaatcaaaaagtgttaacatgttttaatgtttccgaagtggcccaaagaagagaaagaaggaaaggtgtgtcttcccttcccaagccccctcctctctagtcgtagaagcgaagcaggcgggggccgggagctccggcgtctggagagacatccagcggctgtggggccaggacacctcctgccccccagttctctgaagacgctccagagaccgcgagagccacggcaagcgggggagggcgaggagggagggggcagaagacaagcgggcgcctctagcagctcctgagccccggctagtccccctcagctcctcttcttggaagcagcggctccaggcgcagggagtagagagaagaaggcagaagacacgtttccagctgcgggacgtcccgcccgccccgccacccttcgaccctcccgcgcctccctcccacctccccgccgggtcgggcgaggcagccgccgggcgctaagaagggcgccgggggagggggcgcgggcggggcggggcggggcggggcgcgggggcgcgcgcgctcatccagctcagggcccgctggctcgccgctctgtaactcgctcccccaaccccaccccgctcccctccttcccagtcccgccgccccccactccaggcgcctcgcagacgcctcatccccctcggcacgcacacactcctccctctctcccgcccgtcccacaacaaattagagtttgtggcattacctcctcgcgctctttaatcttctttcctcaactcctaaacttccccccgcccctacttcttc
